United States Patent 9,061,059 (MODIFIED POLYNUCLEOTIDES FOR TREATING PROTEIN DEFICIENCY) - sequence listing, part 79

SEQ ID NO: 152041 - DNA, 3807 bp, Artificial Sequence
  Description of Artificial Sequence: Synthetic coding sequence
atggaccagaagatcctgagcctggccgctgagaagacagctgacaagctgcaggagttcctgcagaccctgcgggagggggacctgaccaacctgctgcagaaccaggccgtgaagggcaaggtggccggggccctgctgcgggccatcttcaagggcagcccctgcagcgaggaggccggcaccctgcggcggaggaagatctacacctgctgcatccagctggtggagagcggggacctgcagaaggagatcgccagcgagatcatcggcctgctgatgctggaggcccaccacttccctggccccctgctggtggagctggccaatgagttcatctctgctgtgcgggagggcagcctggtgaatggcaagagcctggagctgctgcccatcatcctgacagccctggccaccaagaaggagaacctggcctacggcaagggcgtgctgagcggggaggagtgcaagaagcagctgatcaacaccctgtgcagcggccgctgggaccagcagtatgtgatccagctgacctccatgttcaaggatgtgcccctgacagctgaggaggtggagtttgtggtggagaaggccctgtccatgttcagcaagatgaacctgcaggagatcccccccctggtgtaccagctgctggtgctgagcagcaagggcagcaggaagtctgtgctggagggcatcatcgccttcttcagcgccctggacaagcagcacaatgaggagcagagcggagatgagctgctggatgtggtgacagtgcccagcggggagctgcggcacgtggagggcaccatcatcctgcacatcgtgtttgccatcaagctggactatgagctgggccgggagctggtgaagcacctgaaggtgggccagcagggcgacagcaacaacaacctgagccccttcagcatcgccctgctgctgtctgtgacccgcatccagcgcttccaggaccaggtgctggacctgctgaagacctctgtggtgaagagcttcaaggacctgcagctgctgcagggcagcaagttcctgcagaacctggtgccccacaggagctatgtgtccaccatgatcctggaggtggtgaagaacagcgtgcacagctgggaccacgtgacccagggcctggtggagctgggcttcatcctgatggacagctatggccccaagaaggtgctggatggcaagaccatcgagaccagccccagcctgagcaggatgcccaaccagcacgcctgcaagctgggcgccaacatcctgctggagaccttcaagatccacgagatgatccggcaggagatcctggagcaggtgctgaacagagtggtgacccgggccagcagccccatcagccacttcctggacctgctgagcaacatcgtgatgtatgcccccctggtgctgcagagctgcagcagcaaggtgacagaggcctttgactacctgtccttcctgcccctgcagacagtgcagaggctgctgaaggctgtgcagcccctgctgaaggtgtccatgtccatgagggactgcctgatcctggtgctgaggaaggccatgtttgccaaccagctggatgccaggaagtctgctgtggccggcttcctgctgctgctgaagaacttcaaggtgctgggcagcctgagcagcagccagtgcagccagagcctgtctgtgtcccaggtgcacgtggatgtgcacagccactacaacagcgtggccaatgagaccttctgcctggagatcatggacagcctgcggcgctgcctgagccagcaggctgatgtgcggctgatgctgtatgagggcttctatgatgtgctgcggaggaacagccagctggccaacagcgtgatgcagaccctgctgagccagctgaagcagttctatgagcccaagccagacctgctgccccccctgaagctggaggcctgcatcctgacccagggcgacaagatcagcctgcaggagcccctggactacctgctgtgctgcatccagcactgcctggcctggtacaagaacacagtcatccccctgcagcagggcgaggaggaggaggaggaggaggaggccttctatgaggacctggatgacatcctggagagcatcaccaacaggatgatcaagtctgagctggaggactttgagctggacaagtctgctgacttcagccagagcaccagcatcggcatcaagaacaacatctgtgccttcctggtgatgggcgtgtgtgaggtgctgattgagtacaacttcagcatcagcagcttcagcaagaacagatttgaggacatcctgagcctcttcatgtgctacaagaagctgagtgacatcctgaatgagaaggccggcaaggccaagaccaagatggccaacaagaccagtgacagcctgctgtccatgaagtttgtgagcagcctgctgacagccctcttccgggtgctgctgtggagatacaccagcatccccacctctgtggaggagagcggcaagaaggagaagggcaagagcatcagcctgctgtgcctggagggcctgcagaagatcttctctgctgtgcagcagttctaccagcccaagatccagcagttcctgcgggccctggatgtgacagacaaggagggggaggagagagaagatgctgatgtgtctgtgacccagaggacagccttccagatccggcagttccagaggagcctgctgaacctgctgagcagccaggaggaggacttcaacagcaaggaggccctgctgctggtgacagtgctgaccagcctgagcaagctgctggagcccagcagcccccagtttgtgcagatgctgtcctggaccagcaagatctgcaaggagaacagccgggaggatgccctcttctgcaagagcctgatgaacctgctcttcagcctgcacgtgtcctacaagagccctgtgatcctgctgcgggacctgagccaggacatccacggccacctgggggacatcgaccaggatgtggaggtggagaagaccaaccactttgccatcgtgaacctgaggacagctgcccccaccgtgtgcctgctggtgctgagccaggccgagaaggtgctggaggaggtggactggctgatcaccaagctgaagggccaggtgtcccaggagaccctgtctgaggaggccagcagccaggccaccctgcccaaccagcctgtggagaaggccatcatcatgcagctgggcaccctgctgaccttcttccacgagctggtgcagacagccctgcccagcggcagctgtgtggacaccctgctgaaggacctgtgcaagatgtacaccaccctgacagccctggtgcgctactacctgcaggtgtgccagagcagcggcggcatccccaagaacatggagaagctggtgaagctgagcggcagccacctgacccccctgtgctacagcttcatctcctatgtgcagaacaagagcaagagcctgaactacaccggggagaagaaggagaagccagctgctgtggccacagccatggcccgggtgctgcgggagaccaagcccatccccaacctgatctttgccatcgagcagtatgagaagttcctgatccacctgagcaagaagagcaaggtgaacctgatgcagcacatgaagctgagcaccagccgggacttcaagatcaagggcaacatcctggacatggtgctgcgggaggatggagaagatgaaaatgaggagggcacagccagcgagcacggcggccagaacaaggagcccgccaagaagaagaggaagaagtag

SEQ ID NO: 152042 - DNA, 3987 bp, Artificial Sequence
  Description of Artificial Sequence: Synthetic coding sequence
atggaccagaagatcctgagcctggccgctgagaagacagctgacaagctgcaggagttcctgcagaccctgcgggagggggacctgaccaacctgctgcagaaccaggccgtgaagggcaaggtggccggggccctgctgcgggccatcttcaagggcagcccctgcagcgaggaggccggcaccctgcggcggaggaagatctacacctgctgcatccagctggtggagagcggggacctgcagaaggagatcgccagcgagatcatcggcctgctgatgctggaggcccaccacttccctggccccctgctggtggagctggccaatgagttcatctctgctgtgcgggagggcagcctggtgaatggcaagagcctggagctgctgcccatcatcctgacagccctggccaccaagaaggagaacctggcctacggcaagggcgtgctgagcggggaggagtgcaagaagcagctgatcaacaccctgtgcagcggccgctgggaccagcagtatgtgatccagctgacctccatgttcaaggatgtgcccctgacagctgaggaggtggagtttgtggtggagaaggccctgtccatgttcagcaagatgaacctgcaggagatcccccccctggtgtaccagctgctggtgctgagcagcaagggcagcaggaagtctgtgctggagggcatcatcgccttcttcagcgccctggacaagcagcacaatgaggagcagagcggagatgagctgctggatgtggtgacagtgcccagcggggagctgcggcacgtggagggcaccatcatcctgcacatcgtgtttgccatcaagctggactatgagctgggccgggagctggtgaagcacctgaaggtgggccagcagggcgacagcaacaacaacctgagccccttcagcatcgccctgctgctgtctgtgacccgcatccagcgcttccaggaccaggtgctggacctgctgaagacctctgtggtgaagagcttcaaggacctgcagctgctgcagggcagcaagttcctgcagaacctggtgccccacaggagctatgtgtccaccatgatcctggaggtggtgaagaacagcgtgcacagctgggaccacgtgacccagggcctggtggagctgggcttcatcctgatggacagctatggccccaagaaggtgctggatggcaagaccatcgagaccagccccagcctgagcaggatgcccaaccagcacgcctgcaagctgggcgccaacatcctgctggagaccttcaagatccacgagatgatccggcaggagatcctggagcaggtgctgaacagagtggtgacccgggccagcagccccatcagccacttcctggacctgctgagcaacatcgtgatgtatgcccccctggtgctgcagagctgcagcagcaaggtgacagaggcctttgactacctgtccttcctgcccctgcagacagtgcagaggctgctgaaggctgtgcagcccctgctgaaggtgtccatgtccatgagggactgcctgatcctggtgctgaggaaggccatgtttgccaaccagctggatgccaggaagtctgctgtggccggcttcctgctgctgctgaagaacttcaaggtgctgggcagcctgagcagcagccagtgcagccagagcctgtctgtgtcccaggtgcacgtggatgtgcacagccactacaacagcgtggccaatgagaccttctgcctggagatcatggacagcctgcggcgctgcctgagccagcaggctgatgtgcggctgatgctgtatgagggcttctatgatgtgctgcggaggaacagccagctggccaacagcgtgatgcagaccctgctgagccagctgaagcagttctatgagcccaagccagacctgctgccccccctgaagctggaggcctgcatcctgacccagggcgacaagatcagcctgcaggagcccctggactacctgctgtgctgcatccagcactgcctggcctggtacaagaacacagtcatccccctgcagcagggcgaggaggaggaggaggaggaggaggccttctatgaggacctggatgacatcctggagagcatcaccaacaggatgatcaagtctgagctggaggactttgagctggacaagtctgctgacttcagccagagcaccagcatcggcatcaagaacaacatctgtgccttcctggtgatgggcgtgtgtgaggtgctgattgagtacaacttcagcatcagcagcttcagcaagaacagatttgaggacatcctgagcctcttcatgtgctacaagaagctgagtgacatcctgaatgagaaggccggcaaggccaagaccaagatggccaacaagaccagtgacagcctgctgtccatgaagtttgtgagcagcctgctgacagccctcttccgggacagcatccagagccaccaggagagcctgtctgtgctgcggagcagcaatgagttcatgagatatgctgtgaatgtggccctgcagaaggtgcagcagctgaaggagaccggccacgtgtctggcccagatggccagaaccctgagaagatcttccagaacctgtgtgacatcaccagggtgctgctgtggagatacaccagcatccccacctctgtggaggagagcggcaagaaggagaagggcaagagcatcagcctgctgtgcctggagggcctgcagaagatcttctctgctgtgcagcagttctaccagcccaagatccagcagttcctgcgggccctggatgtgacagacaaggagggggaggagagagaagatgctgatgtgtctgtgacccagaggacagccttccagatccggcagttccagaggagcctgctgaacctgctgagcagccaggaggaggacttcaacagcaaggaggccctgctgctggtgacagtgctgaccagcctgagcaagctgctggagcccagcagcccccagtttgtgcagatgctgtcctggaccagcaagatctgcaaggagaacagccgggaggatgccctcttctgcaagagcctgatgaacctgctcttcagcctgcacgtgtcctacaagagccctgtgatcctgctgcgggacctgagccaggacatccacggccacctgggggacatcgaccaggatgtggaggtggagaagaccaaccactttgccatcgtgaacctgaggacagctgcccccaccgtgtgcctgctggtgctgagccaggccgagaaggtgctggaggaggtggactggctgatcaccaagctgaagggccaggtgtcccaggagaccctgtctgaggaggccagcagccaggccaccctgcccaaccagcctgtggagaaggccatcatcatgcagctgggcaccctgctgaccttcttccacgagctggtgcagacagccctgcccagcggcagctgtgtggacaccctgctgaaggacctgtgcaagatgtacaccaccctgacagccctggtgcgctactacctgcaggtgtgccagagcagcggcggcatccccaagaacatggagaagctggtgaagctgagcggcagccacctgacccccctgtgctacagcttcatctcctatgtgcagaacaagagcaagagcctgaactacaccggggagaagaaggagaagccagctgctgtggccacagccatggcccgggtgctgcgggagaccaagcccatccccaacctgatctttgccatcgagcagtatgagaagttcctgatccacctgagcaagaagagcaaggtgaacctgatgcagcacatgaagctgagcaccagccgggacttcaagatcaagggcaacatcctggacatggtgctgcgggaggatggagaagatgaaaatgaggagggcacagccagcgagcacggcggccagaacaaggagcccgccaagaagaagaggaagaagtag

SEQ ID NO: 152043 - DNA, 3288 bp, Artificial Sequence
  Description of Artificial Sequence: Synthetic coding sequence
atggaccagaagatcctgagcctggccgctgagaagacagctgacaagctgcaggagttcctgcagaccctgcgggagggggacctgaccaacctgctgcagaaccaggccgtgaagggcaaggtggccggggccctgctgcgggccatcttcaagggcagcccctgcagcgaggaggccggcaccctgcggcggaggaagatctacacctgctgcatccagctggtggagagcggggacctgcagaaggagatcgccagcgagatcatcggcctgctgatgctggaggcccaccacttccctggccccctgctggtggagctggccaatgagttcatctctgctgtgcgggagggcagcctggtgaatggcaagagcctggagctgctgcccatcatcctgacagccctggccaccaagaaggagaacctggcctacggcaagggcgtgctgagcggggaggagtgcaagaagcagctgatcaacaccctgtgcagcggccgctgggaccagcagtatgtgatccagctgacctccatgttcaaggatgtgcccctgacagctgaggaggtggagtttgtggtggagaaggccctgtccatgttcagcaagatgaacctgcaggagatcccccccctggtgtaccagctgctggtgctgagcagcaagggcagcaggaagtctgtgctggagggcatcatcgccttcttcagcgccctggacaagcagcacaatgaggagcagagcggagatgagctgctggatgtggtgacagtgcccagcggggagctgcggcacgtggagggcaccatcatcctgcacatcgtgtttgccatcaagctggactatgagctgggccgggagctggtgaagcacctgaaggtgggccagcagggcgacagcaacaacaacctgagccccttcagcatcgccctgctgctgtctgtgacccgcatccagcgcttccaggaccaggtgctggacctgctgaagacctctgtggtgaagagcttcaaggacctgcagctgctgcagggcagcaagttcctgcagaacctggtgccccacaggagctatgtgtccaccatgatcctggaggtggtgaagaacagcgtgcacagctgggaccacgtgacccagggcctggtggagctgggcttcatcctgatggacagctatggccccaagaaggtgctggatggcaagaccatcgagaccagccccagcctgagcaggatgcccaaccagcacgcctgcaagctgggcgccaacatcctgctggagaccttcaagatccacgagatgatccggcaggagatcctggagcaggtgctgaacagagtggtgacccgggccagcagccccatcagccacttcctggacctgctgagcaacatcgtgatgtatgcccccctggtgctgcagagctgcagcagcaaggtgacagaggcctttgactacctgtccttcctgcccctgcagacagtgcagaggctgctgaaggctgtgcagcccctgctgaaggtgtccatgtccatgagggactgcctgatcctggtgctgaggaaggccatgtttgccaaccagctggatgccaggaagtctgctgtggccggcttcctgctgctgctgaagaacttcaaggtgctgggcagcctgagcagcagccagtgcagccagagcctgtctgtgtcccaggtgcacgtggatgtgcacagccactacaacagcgtggccaatgagaccttctgcctggagatcatggacagcctgcggcgctgcctgagccagcaggctgatgtgcggctgatgctgtatgagggcttctatgatgtgctgcggaggaacagccagctggccaacagcgtgatgcagaccctgctgagccagctgaagcagttctatgagcccaagccagacctgctgccccccctgaagctggaggcctgcatcctgacccagggcgacaagatcagcctgcaggagcccctggactacctgctgtgctgcatccagcactgcctggcctggtacaagaacacagtcatccccctgcagcagggcgaggaggaggaggaggaggaggaggccttctatgaggacctggatgacatcctggagagcatcaccaacaggatgatcaagtctgagctggaggactttgagctggacaagtctgctgacttcagccagagcaccagcatcggcatcaagaacaacatctgtgccttcctggtgatgggcgtgtgtgaggtgctgattgagtacaacttcagcatcagcagcttcagcaagaacagatttgaggacatcctgagcctcttcatgtgctacaagaagctgagtgacatcctgaatgagaaggccggcaaggccaagaccaagatggccaacaagaccagtgacagcctgctgtccatgaagtttgtgagcagcctgctgacagccctcttccgggtgctgctgtggagatacaccagcatccccacctctgtggaggagagcggcaagaaggagaagggcaagagcatcagcctgctgtgcctggagggcctgcagaagatcttctctgctgtgcagcagttctaccagcccaagatccagcagttcctgcgggccctggatgtgacagacaaggagggggaggagagagaagatgctgatgtgtctgtgacccagaggacagccttccagatccggcagttccagaggagcctgctgaacctgctgagcagccaggaggaggacttcaacagcaaggaggccctgctgctggtgacagtgctgaccagcctgagcaagctgctggagcccagcagcccccagtttgtgcagatgctgtcctggaccagcaagatctgcaaggagaacagccgggaggatgccctcttctgcaagagcctgatgaacctgctcttcagcctgcacgtgtcctacaagagccctgtgatcctgctgcgggacctgagccaggacatccacggccacctgggggacatcgaccaggatgtggaggtggagaagaccaaccactttgccatcgtgaacctgaggacagctgcccccaccgtgtgcctgctggtgctgagccaggccgagaaggtgctggaggaggtggactggctgatcaccaagctgaagggccaggtgtcccaggagaccctgtctgtgtccccaggagtgtctgagctgcggaggaacagcaagaagtatggcaaggccggggaggccgtgtggttcagcagtgacccccctgtgctcttcttccacttcctgaggacagaatag

SEQ ID NO: 152044 - DNA, 222 bp, Artificial Sequence
  Description of Artificial Sequence: Synthetic coding sequence
atgttcaaggatgtgcccctgacagctgaggaggtggagtttgtggtggagaaggccctgtccatgttcagcaagatgaacctgcaggagatcccccccctggtgtaccagctgctggtgctgagcagcaagggcagcaggaagtctgtgctggagggcatcatcgccttcttcagcgccctggacaagcagcacaatgaggagcagagcggagatgaatag

SEQ ID NO: 152045 - DNA, 501 bp, Artificial Sequence
  Description of Artificial Sequence: Synthetic coding sequence
atggcccagaccagcagctacttcatgctgatcagctgcctgatgttcctgagccagagccagggccaggaggcccagacagagctgccccaggcccgcatcagctgcccagagggcaccaatgcctaccgcagctactgctactacttcaatgaagatcgggagacctgggtggatgctgacctgtactgccagaacatgaacagcggcaacctggtgtctgtgctgacccaggccgagggcgcctttgtggccagcctcatcaaggagagcggcacagatgacttcaacgtgtggattggcctgcatgaccccaagaagaacagacgctggcactggagcagcggcagcctggtgtcctacaagtcctggggcatcggggcccccagctctgtgaaccctggctactgtgtgtccctgaccagcagcacaggcttccagaagtggaaggatgtgccctgtgaggacaagttctcctttgtgtgcaagttcaagaactag

SEQ ID NO: 152046 - DNA, 384 bp, Artificial Sequence
  Description of Artificial Sequence: Synthetic coding sequence
atggctgtgacagaggccagcctgctgcggcagtgccccctgctgctgccccagaacagaagcaagacagtgtatgagggcttcatcagcgcccagggccgggacttccacctgcgcatcgtgctgcctgaggacctgcagctgaagaatgcccggctgctgtgctcctggcagctgcggaccatcctgagcggctaccacagaattgtgcagcagaggatgcagcacagcccagacctgatgtccttcatgatggagctgaagatgctgctggaggtggccctgaagaaccggcaggagctgtatgccctgcccccaccaccccagttctacagcagcctgattgaggagatcggcaccctgggctgggacaaggccccctag

SEQ ID NO: 152047 - DNA, 6147 bp, Artificial Sequence
  Description of Artificial Sequence: Synthetic coding sequence
atgagcggccggcagaggaccctcttccagacctggggcagcagcatcagccgcagcagcggcaccccaggctgcagcagcggcacagagcggccccagagccctggcagcagcaaggcccccctgcctgctgctgctgaggcccagctggagagtgatgatgatgtgctgctggtggccgcctatgaggccgagcggcagctgtgcctggagaatggaggcttctgcaccagcgctggggccctgtggatctaccccaccaactgccctgtgcgggactaccagctgcacatcagcagagctgccctcttctgcaacaccctggtgtgcctgcccaccggcctgggcaagaccttcatcgctgctgtggtgatgtacaacttctaccgctggttccccagcggcaaggtggtgttcatggcccccaccaagcccctggtgacccagcagatcgaggcctgctaccaggtgatgggcatcccccagagccacatggccgagatgacaggcagcacccaggccagcaccaggaaggagatctggtgcagcaagagggtgctcttcctgaccccccaggtgatggtgaatgacctgagcagaggagcctgcccagctgctgagatcaagtgcctggtgattgatgaggcccacaaggccctgggcaactatgcctactgccaggtggtgcgggagctggtgaagtacaccaaccacttccgcatcctggccctgagcgccaccccaggcagtgacatcaaggctgtgcagcaggtgatcaccaacctgctgattggccagatcgagctgcggtctgaggacagcccagacatcctgacctacagccatgagaggaaggtggagaagctgattgtgcccctgggggaggagctggccgccatccagaagacctacatccagatcctggagagctttgcccggagcctcatccagagaaatgtgctgatgagaagagacatccccaacctgaccaagtaccagatcatcctggcccgggaccagttcaggaagaaccccagccccaacatcgtgggcatccagcagggcatcattgaaggagaatttgccatctgcatcagcctgtaccacggctatgagctgctgcagcagatgggcatgaggagcctgtacttcttcctgtgtggcatcatggatggcaccaagggcatgaccaggagcaagaatgagctgggcagaaatgaagacttcatgaagctgtacaaccacctggagtgcatgtttgcccggaccaggagcaccagcgccaacggcatcagcgccatccagcagggcgacaagaacaagaagtttgtgtacagccaccccaagctgaagaagctggaggaggtggtgattgagcacttcaagtcctggaatgctgagaacaccacagagaagaagagagatgagaccagggtgatgatcttcagcagcttccgggacagcgtgcaggagattgctgagatgctgagccagcaccagcccatcatccgggtgatgacctttgtgggccacgccagcggcaagagcaccaagggcttcacccagaaggagcagctggaggtggtgaagcagttcagagatggcggctacaacaccctggtgtccacctgtgtgggggaggagggcctggacatcggggaggtggacctgatcatctgctttgacagccagaagagccccatccggctggtgcagaggatgggccgcactggaaggaagaggcagggcagaattgtcatcatcctgtctgagggccgggaggagcgcatctacaaccagagccagagcaacaagaggagcatctacaaggccatcagcagcaaccggcaggtgctgcacttctaccagaggagccccaggatggtgcctgatggcatcaaccccaagctgcacaagatgttcatcacccacggcgtgtatgagcctgagaagcccagcaggaacctgcagaggaagagcagcatcttctcctacagagatggcatgaggcagagcagcctgaagaaggactggttcctgtctgaggaggagttcaagctgtggaacagactctaccgcctgcgggacagtgatgagatcaaggagatcaccctgccccaggtgcagttcagcagcctgcagaatgaggagaacaagccagcccaggagagcaccaccggcatccaccagctgagcctgtctgagtggaggctgtggcaggaccaccccctgcccacccaccaggtggaccacagcgaccgctgccgccacttcatcggcctgatgcagatgattgagggcatgagacatgaggagggggagtgcagctatgagctggaggtggagagctacctgcagatggaggatgtgaccagcaccttcatcgcccccagaaatgaaagcaacaacctggccagtgacaccttcatcacccacaagaagagcagcttcatcaagaacatcaaccagggcagcagcagcagcgtcatcgagagtgatgaagaatgtgccgagatcgtgaagcagacccacatcaagcccaccaagatcgtgtccctgaagaagaaggtgtccaaggagatcaagaaggaccagctgaagaaggagaacaaccacggcatcattgattctgtggacaatgacaggaacagcacagtggagaacatcttccaggaggacctgcccaatgacaagaggaccagtgacacagatgaaattgctgccacctgcaccatcaatgaaaatgtcatcaaggagccctgtgtgctgctgacagagtgccagttcaccaacaagagcaccagcagcctggccggaaatgtgctggacagcggctacaacagcttcaatgatgagaagtctgtgagcagcaacctcttcctgccctttgaggaggagctgtacatcgtgaggacagatgaccagttctacaactgccacagcctgaccaaggaggtgctggccaacgtggagcgcttcctgagctacagccccccacccctgagcggcctgagtgacctggagtatgaaattgccaagggcacagccctggagaacctgctcttcctgccctgtgccgagcacctgcggagtgacaagtgcacctgcctgctgagccacagcgctgtgaacagccagcagaacctggagctgaacagcctgaagtgcatcaactaccccagcgagaagagctgcctgtatgacatccccaatgacaacatcagtgatgagcccagcctgtgtgactgtgatgtgcacaagcacaaccagaatgaaaacctggtgcccaacaacagagtgcagatccacaggagccctgcccagaacctggtgggggagaacaaccatgatgtggacaacagcgacctgcctgtgctgagcacagaccaggatgagagcctgctgctgtttgaagatgtgaacacagaatttgatgatgtgtccctgagccccctgaacagcaagtctgagagcctgcctgtgtctgacaagacagccatcagcgagacccccctggtgtcccagttcctgatcagtgatgagctgctgctggacaacaacagcgagctgcaggaccagatcaccagagatgccaacagcttcaagagccgggaccagaggggcgtgcaggaggagaaggtgaagaaccacgaggacatctttgactgcagccgggacctcttctctgtgacctttgacctgggcttctgcagcccagacagtgatgatgagatcctggagcacaccagtgacagcaaccggcccctggatgacctgtatggccgctacctggagatcaaggagatcagtgatgccaactacgtgagcaaccaggccctgatcccccgggaccacagcaagaacttcaccagcggcaccgtcatcatccccagcaatgaagacatgcagaaccccaactacgtgcacctgcccctgtctgctgccaagaatgaggagctgctgagccctggctacagccagttcagcctgcctgtgcagaagaaggtgatgagcacccccctgagcaagagcaacaccctgaacagcttcagcaagatcaggaaggagatcctgaagaccccagacagcagcaaggagaaggtgaacctgcagcgcttcaaggaggccctgaacagcacctttgactacagcgagttcagcctggagaagagcaagagcagcggccccatgtacctgcacaagagctgccacagcgtggaggatggccagctgctgaccagcaatgaaagtgaagatgatgagatcttccggaggaaggtgaagagggccaagggaaatgtgctgaacagccctgaggaccagaagaacagcgaggtggacagccccctgcatgctgtgaagaagaggcgcttccccatcaacagaagtgagctgagcagcagtgatgaaagtgagaacttccccaagccctgcagccagctggaggacttcaaggtgtgcaatggaaatgcccggcggggcatcaaggtgcccaagaggcagagccacctgaagcacgtggccaggaagttcctggatgatgaggccgagctgtctgaagaagatgctgaatatgtgtccagtgatgaaaatgatgaaagtgaaaatgagcaggacagcagcctgctggacttcctgaatgatgagacccagctgagccaggccatcaatgattctgagatgagggccatctacatgaagagcctgcggagccccatgatgaacaacaagtacaagatgatccacaagacccacaagaacatcaacatcttcagccagatccctgagcaggatgagacctacctggaggacagcttctgtgtggatgaggaggagagctgcaagggccagagcagcgaggaggaggtgtgtgtggacttcaacctgatcacagatgactgctttgccaacagcaagaagtacaagacccggcgggctgtgatgctgaaggagatgatggagcagaactgtgcccacagcaagaagaagctgagccgcatcatcctgcctgatgacagcagcgaggaggagaacaacgtgaatgacaagcgggagagcaacattgctgtgaaccccagcacagtgaagaagaacaagcagcaggaccactgcctgaacagcgtgcccagcggcagcagcgcccagagcaaggtgcgcagcaccccccgggtgaaccccctggccaagcagagcaagcagaccagcctgaacctgaaggacaccatcagcgaggtgtctgacttcaagccccagaaccacaatgaggtgcagagcaccaccccacccttcaccaccgtggacagccagaaggactgcaggaagtttcctgtgccccagaaggatggcagcgccctggaggacagcagcaccagcggggccagctgcagcaagagccggccccacctggccggcacccacaccagcctgcggctgccccaggagggcaagggcacctgcatcctggtgggcggccacgagatcaccagcggcctggaggtgatcagcagcctgcgggccatccacggcctgcaggtggaggtgtgccccctgaatggctgtgactacatcgtgagcaacaggatggtggtggagaggaggagccagagcgagatgctgaacagcgtgaacaagaacaagttcatcgagcagatccagcacctgcagagcatgtttgagcgcatctgtgtgattgtggagaaggaccgggagaagacaggagacaccagcaggatgttccggaggaccaagagctatgacagcctgctgaccaccctcatcggggccggcatccgcatcctcttcagcagctgccaggaggagacagctgacctgctgaaggagctgagcctggtggagcagaggaagaatgtgggcatccacgtgcccaccgtggtgaacagcaacaagtctgaggccctgcagttctacctgagcatccccaacatctcctacatcacagccctgaacatgtgccaccagttcagctctgtgaagaggatggccaacagcagcctgcaggagatctccatgtatgcccaggtgacccaccagaaggccgaggagatctaccgctacatccactacgtgtttgacatccagatgctgcccaatgacctgaaccaggaccggctgaagagtgacatctag

SEQ ID NO: 152048 - DNA, 2010 bp, Artificial Sequence
  Description of Artificial Sequence: Synthetic coding sequence
atgagcggccggcagaggaccctcttccagacctggggcagcagcatcagccgcagcagcggcaccccaggctgcagcagcggcacagagcggccccagagccctggcagcagcaaggcccccctgcctgctgctgctgaggcccagctggagagtgatgatgatgtgctgctggtggccgcctatgaggccgagcggcagctgtgcctggagaatggaggcttctgcaccagcgctggggccctgtggatctaccccaccaactgccctgtgcgggactaccagctgcacatcagcagagctgccctcttctgcaacaccctggtgtgcctgcccaccggcctgggcaagaccttcatcgctgctgtggtgatgtacaacttctaccgctggttccccagcggcaaggtggtgttcatggcccccaccaagcccctggtgacccagcagatcgaggcctgctaccaggtgatgggcatcccccagagccacatggccgagatgacaggcagcacccaggccagcaccaggaaggagatctggtgcagcaagagggtgctcttcctgaccccccaggtgatggtgaatgacctgagcagaggagcctgcccagctgctgagatcaagtgcctggtgattgatgaggcccacaaggccctgggcaactatgcctactgccaggtggtgcgggagctggtgaagtacaccaaccacttccgcatcctggccctgagcgccaccccaggcagtgacatcaaggctgtgcagcaggtgatcaccaacctgctgattggccagatcgagctgcggtctgaggacagcccagacatcctgacctacagccatgagaggaaggtggagaagctgattgtgcccctgggggaggagctggccgccatccagaagacctacatccagatcctggagagctttgcccggagcctcatccagagaaatgtgctgatgagaagagacatccccaacctgaccaagtaccagatcatcctggcccgggaccagttcaggaagaaccccagccccaacatcgtgggcatccagcagggcatcattgaaggagaatttgccatctgcatcagcctgtaccacggctatgagctgctgcagcagatgggcatgaggagcctgtacttcttcctgtgtggcatcatggatggcaccaagggcatgaccaggagcaagaatgagctgggcagaaatgaagacttcatgaagctgtacaaccacctggagtgcatgtttgcccggaccaggagcaccagcgccaacggcatcagcgccatccagcagggcgacaagaacaagaagtttgtgtacagccaccccaagctgaagaagctggaggaggtggtgattgagcacttcaagtcctggaatgctgagaacaccacagagaagaagagagatgagaccagggtgatgatcttcagcagcttccgggacagcgtgcaggagattgctgagatgctgagccagcaccagcccatcatccgggtgatgacctttgtgggccacgccagcggcaagagcaccaagggcttcacccagaaggagcagctggaggtggtgaagcagttcagagatggcggctacaacaccctggtgtccacctgtgtgggggaggagggcctggacatcggggaggtggacctgatcatctgctttgacagccagaagagccccatccggctggtgcagaggatgggccgcactggaaggaagaggcagggcagaattgtcatcatcctgtctgagggccgggaggagcgcatctacaaccagagccagagcaacaagaggagcatctacaaggccatcagcagcaaccggcaggtgctgcacttctaccagaggagccccaggatggtgcctgatggcatcaaccccaagctgcacaagatgttcatcacccacggcgtgtatgagcctgagaagcccagcaggaacctgcagaggaagagcagcatcttctcctacagagatggcaagtag

SEQ ID NO: 152049 - DNA, 1968 bp, Artificial Sequence
  Description of Artificial Sequence: Synthetic coding sequence
atggctgactacagcacagtgcccccacccagcagcggcagcgctgggggcggcggcggcggcggcggcggcggcggcgtgaatgatgccttcaaggatgccctgcagagggcccggcagattgctgccaagattggaggagatgctggcaccagcctgaacagcaatgactatggctacggcggccagaagaggcccctggaggatggagaccagccagatgccaagaaggtggccccccagaatgacagctttggcacccagctgccccccatgcaccagcagcagagccgctctgtgatgacagaggagtacaaggtgcctgatggcatggtgggcttcatcatcggccggggcggggagcagatcagccgcatccagcaggagagcggctgcaagatccagatcgccccagacagcggcggcctgcctgagaggagctgcatgctgaccggcaccccagagagcgtgcagagcgccaagaggctgctggaccagatcgtggagaagggccgcccagcccctggcttccaccacggagatggccctggaaatgctgtgcaggagatcatgatcccagccagcaaggccggcctggtgattggaaaaggaggagagaccatcaagcagctgcaggagagagctggggtgaagatggtgatgatccaggacggcccccagaacacaggagctgacaagcccctgcgcatcaccggggacccctacaaggtgcagcaggccaaggagatggtgctggagctgatccgggaccagggcggcttccgggaggtgagaaatgaatatggcagccgcatcggcggcaatgaaggaattgatgtgcccatccccaggtttgctgtgggcatcgtgattggaagaaatggagagatgatcaagaagatccagaatgatgctggggtgcgcatccagttcaagccagatgatggcaccaccccagagcgcatcgcccagatcaccggccccccagaccgctgccagcacgccgctgagatcatcacagacctgctgcggtctgtgcaggccggcaaccctgggggccctggccctgggggccggggccggggccggggccagggcaactggaacatgggccccccaggcggcctgcaggagttcaacttcatcgtgcccaccgggaagacaggcctcatcatcggcaagggcggggagaccatcaagagcatcagccagcagagcggggcccgcatcgagctgcagaggaaccccccaccaaatgctgaccccaacatgaagctgttcaccatccggggcaccccccagcagattgattatgcccggcagctgattgaggagaagattggaggccctgtgaaccccctgggcccccctgtgccccacggcccccatggagtgcccggcccccacggccccccaggccccccaggccctggcacccccatgggcccctacaacccagccccctacaaccctggccccccaggccctgcccctcatggccccccagccccctatgccccccagggctggggcaatgcctacccccactggcagcagcaggcccccccagaccctgccaaggccggcacagaccccaacagcgctgcctgggccgcctactatgcccactactaccagcagcaggcccagcccccacctgctgccccagctggggcccccaccaccacccagaccaacggccagggcgaccagcagaacccagccccagctggccaggtggactacaccaaggcctgggaggagtactacaagaagatgggccaggccgtgcctgcccccactggagcccctcctgggggccagcctgactacagcgctgcctgggccgagtactaccggcagcaggccgcctactatgcccagaccagcccccagggcatgccccagcaccccccagccccccagggctttgccaaccacgcccggagccaccaccacctgtactag

SEQ ID NO: 152050 - DNA, 1935 bp, Artificial Sequence
  Description of Artificial Sequence: Synthetic coding sequence
atggctgactacagcacagtgcccccacccagcagcggcagcgctgggggcggcggcggcggcggcggcggcggcggcgtgaatgatgccttcaaggatgccctgcagagggcccggcagattgctgccaagattggaggagatgctggcaccagcctgaacagcaatgactatggctacggcggccagaagaggcccctggaggatggagaccagccagatgccaagaaggtggccccccagaatgacagctttggcacccagctgccccccatgcaccagcagcagagccgctctgtgatgacagaggagtacaaggtgcctgatggcatggtgggcttcatcatcggccggggcggggagcagatcagccgcatccagcaggagagcggctgcaagatccagatcgccccagacagcggcggcctgcctgagaggagctgcatgctgaccggcaccccagagagcgtgcagagcgccaagaggctgctggaccagatcgtggagaagggccgcccagcccctggcttccaccacggagatggccctggaaatgctgtgcaggagatcatgatcccagccagcaaggccggcctggtgattggaaaaggaggagagaccatcaagcagctgcaggagagagctggggtgaagatggtgatgatccaggacggcccccagaacacaggagctgacaagcccctgcgcatcaccggggacccctacaaggtgcagcaggccaaggagatggtgctggagctgatccgggaccagggcggcttccgggaggtgagaaatgaatatggcagccgcatcggcggcaatgaaggaattgatgtgcccatccccaggtttgctgtgggcatcgtgattggaagaaatggagagatgatcaagaagatccagaatgatgctggggtgcgcatccagttcaagccagatgatggcaccaccccagagcgcatcgcccagatcaccggccccccagaccgctgccagcacgccgctgagatcatcacagacctgctgcggtctgtgcaggccggcaaccctgggggccctggccctgggggccggggccggggccggggccagggcaactggaacatgggccccccaggcggcctgcaggagttcaacttcatcgtgcccaccgggaagacaggcctcatcatcggcaagggcggggagaccatcaagagcatcagccagcagagcggggcccgcatcgagctgcagaggaaccccccaccaaatgctgaccccaacatgaagctgttcaccatccggggcaccccccagcagattgattatgcccggcagctgattgaggagaagattggaggccctgtgaaccccctgggcccccctgtgccccacggcccccatggagtgcccggcccccacggccccccaggccccccaggccctggcacccccatgggcccctacaacccagccccctacaaccctggccccccaggccctgcccctcatggccccccagccccctatgccccccagggctggggcaatgcctacccccactggcagcagcaggcccccccagaccctgccaaggccggcacagaccccaacagcgctgcctgggccgcctactatgcccactactaccagcagcaggcccagcccccacctgctgccccagctggggcccccaccaccacccagaccaacggccagggcgaccagcagaacccagccccagctggccaggtggactacaccaaggcctgggaggagtactacaagaagatgggccaggccgtgcctgcccccactggagcccctcctgggggccagcctgactacagcgctgcctgggccgagtactaccggcagcaggccgcctactatgcccagaccagcccccagggcatgccccagcaccccccagccccccagggccagtag

SEQ ID NO: 152051 - DNA, 1965 bp, Artificial Sequence
  Description of Artificial Sequence: Synthetic coding sequence
atggctgactacagcacagtgcccccacccagcagcggcagcgctgggggcggcggcggcggcggcggcggcggcggcgtgaatgatgccttcaaggatgccctgcagagggcccggcagattgctgccaagattggaggagatgctggcaccagcctgaacagcaatgactatggctacggcggccagaagaggcccctggaggatggagaccagccagatgccaagaaggtggccccccagaatgacagctttggcacccagctgccccccatgcaccagcagcagaggtctgtgatgacagaggagtacaaggtgcctgatggcatggtgggcttcatcatcggccggggcggggagcagatcagccgcatccagcaggagagcggctgcaagatccagatcgccccagattctgggggcctgcctgagaggagctgcatgctgaccggcaccccagagagcgtgcagagcgccaagaggctgctggaccagatcgtggagaagggccggcctgcccctggcttccaccacggagatggccctggaaatgctgtgcaggagatcatgatcccagccagcaaggccggcctggtgattggcaagggcggggagaccatcaagcagctgcaggagcgggccggcgtgaagatggtgatgatccaggacggcccccagaacacaggagctgacaagcccctgcgcatcactggagacccctacaaggtgcagcaggccaaggagatggtgctggagctgatccgggaccagggcggcttccgggaggtgagaaatgaatatggcagcagaattggaggaaatgaaggaattgatgtgcccatccccaggtttgctgtgggcatcgtcatcggcagaaatggagagatgatcaagaagatccagaatgatgctggggtgcgcatccagttcaagccagatgatggcaccaccccagagagaattgcccagatcactggacctccagaccgctgccagcacgccgctgagatcatcacagacctgctgcggtctgtgcaggccggcaaccctgggggccctggccctgggggccggggccggggccggggccagggcaactggaacatgggccccccaggcggcctgcaggagttcaacttcatcgtgcccaccgggaagacaggcctcatcattggaaaaggaggagagaccatcaagagcatcagccagcagagcggggccagaattgagctgcagagaaatcctcctccaaatgctgaccccaacatgaagctgttcaccatccggggcaccccccagcagattgattatgcccggcagctgattgaggagaagattggaggccctgtgaaccccctgggcccccctgtgccccacggcccccacggcgtgcccggcccccacggccccccaggccccccaggccctggcacccccatgggcccctacaacccagccccctacaaccctggccccccaggccctgccccccacggccccccagccccctatgccccccagggctggggcaatgcctacccccactggcagcagcaggcccccccagaccctgccaaggccggcacagaccccaacagcgctgcctgggccgcctactatgcccactactaccagcagcaggcccagcccccacctgctgccccagctggggcccccaccaccacccagaccaacggccaggagggggaccagcagaacccagccccagctggccaggtggactacaccaaggcctgggaggagtactacaagaagatgggccaggccgtgcctgcccccactggagcccctcctgggggccagcctgactacagcgctgcctgggccgagtactaccggcagcaggccgcctactatgcccagaccagcccccagggcatgccccagcaccccccagccccccagtgccgctttgatcctgccagcattgagctggccctgtag

SEQ ID NO: 152052 - DNA, 1890 bp, Artificial Sequence
  Description of Artificial Sequence: Synthetic coding sequence
atggctgactacagcacagtgcccccacccagcagcggcagcgctgggggcggcggcggcggcggcggcggcggcggcgtgaatgatgccttcaaggatgccctgcagagggcccggcagattgctgccaagattggaggagatgctggcaccagcctgaacagcaatgactatggctacggcggccagaagaggcccctggaggatggagaccagccagatgccaagaaggtggccccccagaatgacagctttggcacccagctgccccccatgcaccagcagcagaggtctgtgatgacagaggagtacaaggtgcctgatggcatggtgggcttcatcatcggccggggcggggagcagatcagccgcatccagcaggagagcggctgcaagatccagatcgccccagattctgggggcctgcctgagaggagctgcatgctgaccggcaccccagagagcgtgcagagcgccaagaggctgctggaccagatcgtggagaagggccggcctgcccctggcttccaccacggagatggccctggaaatgctgtgcaggagatcatgatcccagccagcaaggccggcctggtgattggcaagggcggggagaccatcaagcagctgcaggagcgggccggcgtgaagatggtgatgatccaggacggcccccagaacacaggagctgacaagcccctgcgcatcactggagacccctacaaggtgcagcaggccaaggagatggtgctggagctgatccgggaccagggcggcttccgggaggtgagaaatgaatatggcagcagaattggaggaaatgaaggaattgatgtgcccatccccaggtttgctgtgggcatcgtcatcggcagaaatggagagatgatcaagaagatccagaatgatgctggggtgcgcatccagttcaagccagatgatggcaccaccccagagagaattgcccagatcactggacctccagaccgctgccagcacgccgctgagatcatcacagacctgctgcggtctgtgcaggccggcaaccctgggggccctggccctgggggccggggccggggccggggccagggcaactggaacatgggccccccaggcggcctgcaggagttcaacttcatcgtgcccaccgggaagacaggcctcatcattggaaaaggaggagagaccatcaagagcatcagccagcagagcggggccagaattgagctgcagagaaatcctcctccaaatgctgaccccaacatgaagctgttcaccatccggggcaccccccagcagattgattatgcccggcagctgattgaggagaagattggaggccctgtgaaccccctgggcccccctgtgccccacggccccccaggcacccccatgggcccctacaacccagccccctacaaccctggccccccaggccctgccccccacggccccccagccccctatgccccccagggctggggcaatgcctacccccactggcagcagcaggcccccccagaccctgccaaggccggcacagaccccaacagcgctgcctgggccgcctactatgcccactactaccagcagcaggcccagcccccacctgctgccccagctggggcccccaccaccacccagaccaacggccagggcgaccagcagaacccagccccagctggccaggtggactacaccaaggcctgggaggagtactacaagaagatgggccaggccgtgcctgcccccaccggggcccctcctgggggccagcctgactacagcgctgcctgggccgagtactaccggcagcaggccgcctactatgcccagaccagcccccagggcatgccccagcaccccccagccccccagggccagtag

SEQ ID NO: 152053 - DNA, 699 bp, Artificial Sequence
  Description of Artificial Sequence: Synthetic coding sequence
atggctgactacagcacagtgcccccacccagcagcggcagcgctgggggcggcggcggcggcggcggcggcggcggcgtgaatgatgccttcaaggatgccctgcagagggcccggcagattgctgccaagattggaggagatgctggcaccagcctgaacagcaatgactatggctacggcggccagaagaggcccctggaggatggagatggctcctggaccagccccagcagcaccacccactgggagggcatgcccagccccttcaaggaccagccagatgccaagaaggtggccccccagaatgacagctttggcacccagctgccccccatgcaccagcagcagaggtctgtgatgacagaggagtacaaggtgcctgatggcatggtgggcttcatcatcggccggggcggggagcagatcagccgcatccagcaggagagcggctgcaagatccagatcgccccagacagcggcggcctgcctgagaggagctgcatgctgaccggcaccccagagagcgtgcagagcgccaagaggctgctggaccagatcgtggagaagggccgcccagcccctggcttccaccacggagatggccctggaaatgctgtgcaggagatcatgatcccagccagcaaggccggcctggtgattggaaaaggaggagagaccatcaagcagctgcagtag

SEQ ID NO: 152054 - DNA, 1998 bp, Artificial Sequence
  Description of Artificial Sequence: Synthetic coding sequence
atggctgactacagcacagtgcccccacccagcagcggcagcgctgggggcggcggcggcggcggcggcggcggcggcgtgaatgatgccttcaaggatgccctgcagagggcccggcagattgctgccaagattggaggagatgctggcaccagcctgaacagcaatgactatggctacggcggccagaagaggcccctggaggatggagatggctcctggaccagccccagcagcaccacccactgggagggcatgcccagccccttcaaggaccagccagatgccaagaaggtggccccccagaatgacagctttggcacccagctgccccccatgcaccagcagcagagccgctctgtgatgacagaggagtacaaggtgcctgatggcatggtgggcttcatcatcggccggggcggggagcagatcagccgcatccagcaggagagcggctgcaagatccagatcgccccagattctgggggcctgcctgagaggagctgcatgctgaccggcaccccagagagcgtgcagagcgccaagaggctgctggaccagatcgtggagaagggccggcctgcccctggcttccaccacggagatggccctggaaatgctgtgcaggagatcatgatcccagccagcaaggccggcctggtgattggcaagggcggggagaccatcaagcagctgcaggagcgggccggcgtgaagatggtgatgatccaggacggcccccagaacacaggagctgacaagcccctgcgcatcactggagacccctacaaggtgcagcaggccaaggagatggtgctggagctgatccgggaccagggcggcttccgggaggtgagaaatgaatatggcagcagaattggaggaaatgaaggaattgatgtgcccatccccaggtttgctgtgggcatcgtcatcggcagaaatggagagatgatcaagaagatccagaatgatgctggggtgcgcatccagttcaagccagatgatggcaccaccccagagagaattgcccagatcactggacctccagaccgctgccagcacgccgctgagatcatcacagacctgctgcggtctgtgcaggccggcaaccctgggggccctggccctgggggccggggccggggccggggccagggcaactggaacatgggccccccaggcggcctgcaggagttcaacttcatcgtgcccaccgggaagacaggcctcatcattggaaaaggaggagagaccatcaagagcatcagccagcagagcggggccagaattgagctgcagagaaatcctcctccaaatgctgaccccaacatgaagctgttcaccatccggggcaccccccagcagattgattatgcccggcagctgattgaggagaagattggaggccctgtgaaccccctgggcccccctgtgccccacggcccccacggcgtgcccggcccccacggccccccaggccccccaggccctggcacccccatgggcccctacaacccagccccctacaaccctggccccccaggccctgccccccacggccccccagccccctatgccccccagggctggggcaatgcctacccccactggcagcagcaggcccccccagaccctgccaaggccggcacagaccccaacagcgctgcctgggccgcctactatgcccactactaccagcagcaggcccagcccccacctgctgccccagctggggcccccaccaccacccagaccaacggccagggcgaccagcagaacccagccccagctggccaggtggactacaccaaggcctgggaggagtactacaagaagatgggccaggccgtgcctgcccccaccggggcccctcctgggggccagcctgactacagcgctgcctgggccgagtactaccggcagcaggccgcctactatgcccagaccagcccccagggcatgccccagcaccccccagccccccagggccagtag

SEQ ID NO: 152055 - DNA, 1260 bp, Artificial Sequence
  Description of Artificial Sequence: Synthetic coding sequence
atgcccctgagccgctggctgcggtctgtgggcgtcttcctgctgcctgccccctactgggccccccgggagcgctggctgggcagcctgcggcggcccagcctggtgcacggctaccctgtgctggcctggcacagcgcccgctgctggtgccaggcctggacagaggagccccgggccctgtgcagcagcctgaggatgaatggagaccagaacagtgatgtgtatgcccaggagaagcaggactttgtgcagcacttcagccagatcgtgcgggtgctgacagaagatgagatgggccaccctgagattggagatgccatcgcccggctgaaggaggtgctggagtacaatgccatcggcggcaagtacaacagaggcctgactgtggtggtggccttccgggagctggtggagcccaggaagcaggatgctgacagcctgcagagggcctggacagtgggctggtgtgtggagctgctgcaggccttcttcctggtggctgatgacatcatggacagcagcctgacccggcggggccagatctgctggtaccagaagccaggagtgggcctggatgccatcaatgatgccaacctgctggaggcctgcatctaccgcctgctgaagctgtactgccgggagcagccctactacctgaacctgattgagctgttcctgcagagcagctaccagacagaaattggccagaccctggacctgctgacagccccccagggcaatgtggacctggtgcgcttcacagagaagcgctacaagagcatcgtgaagtacaagacagccttctacagcttctacctgcccatcgccgccgccatgtacatggccggcattgatggagagaaggagcacgccaatgccaagaagatcctgctggagatgggagagttcttccagatccaggatgactacctggacctgtttggagaccccagcgtgacaggcaagattggaacagacatccaggacaacaagtgctcctggctggtggtgcagtgcctgcagagggccaccccagagcagtaccagatcctgaaggagaactacggccagaaggaggccgagaaggtggcccgggtgaaggccctgtatgaggagctggacctgcctgctgtgttcctgcagtatgaagaagattcctacagccacatcatggccctgattgagcagtatgctgcccccctgcccccagctgtgttcctgggcctggccaggaagatctacaagaggaggaagtag

SEQ ID NO: 152056 - DNA, 1260 bp, Artificial Sequence; identical to SEQ ID NO: 152055
  Description of Artificial Sequence: Synthetic coding sequence

SEQ ID NO: 152057 - DNA, 1062 bp, Artificial Sequence
  Description of Artificial Sequence: Synthetic coding sequence
atgaatggagaccagaacagtgatgtgtatgcccaggagaagcaggactttgtgcagcacttcagccagatcgtgcgggtgctgacagaagatgagatgggccaccctgagattggagatgccatcgcccggctgaaggaggtgctggagtacaatgccatcggcggcaagtacaacagaggcctgactgtggtggtggccttccgggagctggtggagcccaggaagcaggatgctgacagcctgcagagggcctggacagtgggctggtgtgtggagctgctgcaggccttcttcctggtggctgatgacatcatggacagcagcctgacccggcggggccagatctgctggtaccagaagccaggagtgggcctggatgccatcaatgatgccaacctgctggaggcctgcatctaccgcctgctgaagctgtactgccgggagcagccctactacctgaacctgattgagctgttcctgcagagcagctaccagacagaaattggccagaccctggacctgctgacagccccccagggcaatgtggacctggtgcgcttcacagagaagcgctacaagagcatcgtgaagtacaagacagccttctacagcttctacctgcccatcgccgccgccatgtacatggccggcattgatggagagaaggagcacgccaatgccaagaagatcctgctggagatgggagagttcttccagatccaggatgactacctggacctgtttggagaccccagcgtgacaggcaagattggaacagacatccaggacaacaagtgctcctggctggtggtgcagtgcctgcagagggccaccccagagcagtaccagatcctgaaggagaactacggccagaaggaggccgagaaggtggcccgggtgaaggccctgtatgaggagctggacctgcctgctgtgttcctgcagtatgaagaagattcctacagccacatcatggccctgattgagcagtatgctgcccccctgcccccagctgtgttcctgggcctggccaggaagatctacaagaggaggaagtag

SEQ ID NO: 152058 - DNA, 2760 bp, Artificial Sequence
  Description of Artificial Sequence: Synthetic coding sequence
atgacaggctacaccatgctgagaaatggaggagctggaaatggaggccagacctgcatgctgcgctggagcaaccgcatccggctgacctggctgtccttcaccctgtttgtgatcctggtgttcttccccctcatcgcccactactacctgaccaccctggatgaagcagatgaggccggcaagaggatcttcggcccccgggtgggcaatgagctgtgtgaggtgaagcacgtgctggacctgtgccgcatccgggagagcgtgtctgaggagctgctgcagctggaggccaagaggcaggagctgaacagcgagatcgccaagctgaacctgaagattgaggcctgcaagaagagcattgaaaatgccaagcaggacctgctgcagctgaagaatgtcatcagccagacagagcacagctacaaggagctgatggcccagaaccagcccaagctgagcctgcccatccggctgctgcctgagaaggatgatgctggcctgcccccacccaaggccacccggggctgccgcctgcacaactgctttgactacagccgctgccccctgaccagcggcttccctgtgtatgtgtatgacagcgaccagtttgtgtttggcagctacctggaccccctggtgaagcaggccttccaggccacagcccgggccaacgtgtatgtgacagaaaatgctgacatcgcctgcctgtatgtgatcctggtgggggagatgcaggagcctgtggtgctgcggcctgctgagctggagaagcagctgtacagcctgccccactggaggacagatggccacaaccacgtgatcatcaacctgagcaggaagagtgacacccagaacctgctgtacaacgtgtccacaggccgggccatggtggcccagagcaccttctacacagtgcagtaccggcccggctttgacctggtggtgagccccctggtgcacgccatgtctgagcccaacttcatggagatccccccccaggtgcctgtgaagaggaagtacctgttcaccttccagggcgagaagattgagagcctgcggagcagcctgcaggaggcccggagctttgaggaggagatggagggggaccccccagctgactatgatgaccgcatcatcgccaccctgaaggctgtgcaggacagcaagctggaccaggtgctggtggagttcacctgcaagaaccagcccaagcccagcctgcccacagagtgggccctgtgtggggagagagaagatcggctggagctgctgaagctgagcacctttgccctgatcatcacccctggggacccccggctggtgatcagcagcggctgtgccacccggctgtttgaggccctggaggtgggcgctgtgcctgtggtgctgggggagcaggtgcagctgccctaccaggacatgctgcagtggaatgaagctgccctggtggtgcccaagccccgggtgacagaggtgcacttcctgctgcggagcctgagtgacagcgacctgctggccatgaggcggcagggccgcttcctgtgggagacctacttcagcacagctgacagcatcttcaacacagtgctggccatgatccgcacccgcatccagatcccagctgcccccatccgggaggaggccgctgctgagatcccccacaggtctgggaaggctgctggaacagaccccaacatggctgacaacggggacctggacctgggccctgtggagacagagcccccctatgccagcccccgctacctgaggaacttcaccctgactgtgacagacttctaccgctcctggaactgtgcccctggccccttccacctgttcccccacaccccatttgatcctgtgctgcccagcgaggccaagttcctgggcagcggcaccggcttccggcccatcggcggcggggccggcggcagcggcaaggagttccaggccgccctgggcggcaatgtgccccgggagcagttcaccgtggtgatgctgacctatgaaagagaggaggtgctgatgaacagcctggagcggctgaatggcctgccctacctgaacaaggtggtggtggtgtggaacagccccaagctgcccagcgaggacctgctgtggccagacattggagtgcccatcatggtggtgaggacagagaagaacagcctgaacaaccgcttcctgccctggaatgaaattgaaacagaggccatcctgagcattgatgatgatgcccacctgcggcatgatgagatcatgtttggcttccgggtgtggagggaggcccgggaccgcatcgtgggcttccctggccgctaccacgcctgggacatcccccaccagagctggctgtacaacagcaactacagctgtgagctgtccatggtgctgaccggggccgccttcttccacaagtactatgcctacctgtacagctatgtgatgccccaggccatccgggacatggtggatgagtacatcaactgtgaggacatcgccatgaacttcctggtgagccacatcaccaggaagccacccatcaaggtgaccagccgctggaccttccgctgccccggctgcccccaggccctgagccatgatgacagccacttccacgagcggcacaagtgcatcaacttctttgtgaaggtgtatggctacatgcccctgctgtacacccagttccgggtggacagcgtgctcttcaagacccggctgccccatgacaagaccaagtgcttcaagttcatctag

SEQ ID NO: 152059 - DNA, 1125 bp, Artificial Sequence
  Description of Artificial Sequence: Synthetic coding sequence
atggagtttgtgaagtgcctgggccaccctgaggagttctacaacctggtgcgcttcagaattggaggcaagaggaaggtgatgcccaagatggaccaggacagcctgagcagcagcctgaagacctgctacaagtacctgaaccagaccagccgcagctttgctgctgtgatccaggccctggatggagagatgagaaatgctgtgtgcatcttctacctggtgctgcgggccctggacaccctggaggatgacatgaccatctctgtggagaagaaggtgcccctgctgcacaacttccacagcttcctgtaccagcctgactggaggttcatggagagcaaggagaaggaccggcaggtgctggaggacttccccacctactgccactacgtggccggcctggtgggcatcggcctgagccgcctcttcagcgccagcgagtttgaggaccccctggtgggggaggacacagagcgggccaacagcatgggcctcttcctgcagaagaccaacatcatccgggactacctggaggaccagcagggcggccgggagttctggccccaggaggtgtggagccgctacgtgaagaagctgggggactttgccaagccagaaaatattgacctggccgtgcagtgcctgaatgaactcatcaccaatgccctgcaccacatcccagatgtgatcacctacctgagccggctgaggaaccagagcgtcttcaacttctgtgccatcccccaggtgatggccatcgccaccctggccgcctgctacaacaaccagcaggtgttcaagggagctgtgaagatcaggaagggccaggccgtgaccctgatgatggatgccaccaacatgcctgctgtgaaggccatcatctaccagtacatggaggagatctaccaccgcatcccagacagcgaccccagcagcagcaagacccggcagatcatcagcaccatccgcacccagaacctgcccaactgccagctgatcagccgcagccactacagccccatctacctgagctttgtgatgctgctggccgccctgtcctggcagtacctgaccaccctgagccaggtgacagaggactatgtgcagacaggagagcactag

SEQ ID NO: 152060 - DNA, 999 bp, Artificial Sequence
  Description of Artificial Sequence: Synthetic coding sequence
atgaccatctctgtggagaagaaggtgcccctgctgcacaacttccacagcttcctgtaccagcctgactggaggttcatggagagcaaggagaaggaccggcaggtgctggaggacttccccaccatcagcctggagttcaggaacctggccgagaagtaccagacagtgattgctgacatctgcaggaggatgggcatcggcatggccgagttcctggacaagcacgtgaccagcgagcaggagtgggacaagtactgccactacgtggccggcctggtgggcatcggcctgagccgcctcttcagcgccagcgagtttgaggaccccctggtgggggaggacacagagcgggccaacagcatgggcctcttcctgcagaagaccaacatcatccgggactacctggaggaccagcagggcggccgggagttctggccccaggaggtgtggagccgctacgtgaagaagctgggggactttgccaagccagaaaatattgacctggccgtgcagtgcctgaatgaactcatcaccaatgccctgcaccacatcccagatgtgatcacctacctgagccggctgaggaaccagagcgtcttcaacttctgtgccatcccccaggtgatggccatcgccaccctggccgcctgctacaacaaccagcaggtgttcaagggagctgtgaagatcaggaagggccaggccgtgaccctgatgatggatgccaccaacatgcctgctgtgaaggccatcatctaccagtacatggaggagatctaccaccgcatcccagacagcgaccccagcagcagcaagacccggcagatcatcagcaccatccgcacccagaacctgcccaactgccagctgatcagccgcagccactacagccccatctacctgagctttgtgatgctgctggccgccctgtcctggcagtacctgaccaccctgagccaggtgacagaggactatgtgcagacaggagagcactag

SEQ ID NO: 152061 - DNA, 1233 bp, Artificial Sequence
  Description of Artificial Sequence: Synthetic coding sequence
atggagtttgtgaagtgcctgggccaccctgaggagttctacaacctggtgcgcttcagaattggaggcaagaggaaggacagcctgagcagcagcctgaagacctgctacaagtacctgaaccagaccagccgcagctttgctgctgtgatccaggccctggatggagagatgagaaatgctgtgtgcatcttctacctggtgctgcgggccctggacaccctggaggatgacatgaccatctctgtggagaagaaggtgcccctgctgcacaacttccacagcttcctgtaccagcctgactggaggttcatggagagcaaggagaaggaccggcaggtgctggaggacttccccaccatcagcctggagttcaggaacctggccgagaagtaccagacagtgattgctgacatctgcaggaggatgggcatcggcatggccgagttcctggacaagcacgtgaccagcgagcaggagtgggacaagtactgccactacgtggccggcctggtgggcatcggcctgagccgcctcttcagcgccagcgagtttgaggaccccctggtgggggaggacacagagcgggccaacagcatgggcctcttcctgcagaagaccaacatcatccgggactacctggaggaccagcagggcggccgggagttctggccccaggaggtgtggagccgctacgtgaagaagctgggggactttgccaagccagaaaatattgacctggccgtgcagtgcctgaatgaactcatcaccaatgccctgcaccacatcccagatgtgatcacctacctgagccggctgaggaaccagagcgtcttcaacttctgtgccatcccccaggtgatggccatcgccaccctggccgcctgctacaacaaccagcaggtgttcaagggagctgtgaagatcaggaagggccaggccgtgaccctgatgatggatgccaccaacatgcctgctgtgaaggccatcatctaccagtacatggaggagatctaccaccgcatcccagacagcgaccccagcagcagcaagacccggcagatcatcagcaccatccgcacccagaacctgcccaactgccagctgatcagccgcagccactacagccccatctacctgagctttgtgatgctgctggccgccctgtcctggcagtacctgaccaccctgagccaggtgacagaggactatgtgcagacaggagagcactag

SEQ ID NO: 152062 - DNA, 999 bp, Artificial Sequence; identical to SEQ ID NO: 152060
  Description of Artificial Sequence: Synthetic coding sequence

SEQ ID NO: 152063 - DNA, 1062 bp, Artificial Sequence
  Description of Artificial Sequence: Synthetic coding sequence
atgagaaatgctgtgtgcatcttctacctggtgctgcgggccctggacaccctggaggatgacatgaccatctctgtggagaagaaggtgcccctgctgcacaacttccacagcttcctgtaccagcctgactggaggttcatggagagcaaggagaaggaccggcaggtgctggaggacttccccaccatcagcctggagttcaggaacctggccgagaagtaccagacagtgattgctgacatctgcaggaggatgggcatcggcatggccgagttcctggacaagcacgtgaccagcgagcaggagtgggacaagtactgccactacgtggccggcctggtgggcatcggcctgagccgcctcttcagcgccagcgagtttgaggaccccctggtgggggaggacacagagcgggccaacagcatgggcctcttcctgcagaagaccaacatcatccgggactacctggaggaccagcagggcggccgggagttctggccccaggaggtgtggagccgctacgtgaagaagctgggggactttgccaagccagagaacatcgacctggccgtgcagtgcctgaatgagctgatcaccaatgccctgcaccacatcccagatgtgatcacctacctgagccggctgaggaaccagagcgtcttcaacttctgtgccatcccccaggtgatggccatcgccaccctggccgcctgctacaacaaccagcaggtgttcaagggagctgtgaagatcaggaagggccaggccgtgaccctgatgatggatgccaccaacatgcctgctgtgaaggccatcatctaccagtacatggaggagatctaccaccgcatcccagacagcgaccccagcagcagcaagacccggcagatcatcagcaccatccgcacccagaacctgcccaactgccagctgatcagccgcagccactacagccccatctacctgagctttgtgatgctgctggccgccctgtcctggcagtacctgaccaccctgagccaggtgacagaagattatgtgcagacaggagagcactag

SEQ ID NO: 152064 - DNA, 1062 bp, Artificial Sequence; identical to SEQ ID NO: 152063
  Description of Artificial Sequence: Synthetic coding sequence

SEQ ID NO: 152065 - DNA, 921 bp, Artificial Sequence
  Description of Artificial Sequence: Synthetic coding sequence
atggagagcaaggagaaggaccggcaggtgctggaggacttccccaccatcagcctggagttcaggaacctggccgagaagtaccagacagtgattgctgacatctgcaggaggatgggcatcggcatggccgagttcctggacaagcacgtgaccagcgagcaggagtgggacaagtactgccactacgtggccggcctggtgggcatcggcctgagccgcctcttcagcgccagcgagtttgaggaccccctggtgggggaggacacagagcgggccaacagcatgggcctcttcctgcagaagaccaacatcatccgggactacctggaggaccagcagggcggccgggagttctggccccaggaggtgtggagccgctacgtgaagaagctgggggactttgccaagccagaaaatattgacctggccgtgcagtgcctgaatgaactcatcaccaatgccctgcaccacatcccagatgtgatcacctacctgagccggctgaggaaccagagcgtcttcaacttctgtgccatcccccaggtgatggccatcgccaccctggccgcctgctacaacaaccagcaggtgttcaagggagctgtgaagatcaggaagggccaggccgtgaccctgatgatggatgccaccaacatgcctgctgtgaaggccatcatctaccagtacatggaggagatctaccaccgcatcccagacagcgaccccagcagcagcaagacccggcagatcatcagcaccatccgcacccagaacctgcccaactgccagctgatcagccgcagccactacagccccatctacctgagctttgtgatgctgctggccgccctgtcctggcagtacctgaccaccctgagccaggtgacagaggactatgtgcagacaggagagcactag

SEQ ID NO: 152066 - DNA, 1140 bp, Artificial Sequence
  Description of Artificial Sequence: Synthetic coding sequence
atggccgccacagagggcgtgggggaggccgcccagggcggggagcccggccagcctgcccagcccccaccccagccccaccccccaccaccccagcagcagcacaaggaggagatggctgctgaggccggggaggccgtggccagccccatggatgatggctttgtgtccctggacagccccagctatgtgctgtacagagacagagctgagtgggccgacattgatcctgtgccccagaatgatggccccaaccctgtggtgcagatcatctacagcgacaagttcagagatgtgtatgactacttccgggctgtgctgcagagagatgagaggtctgagcgggccttcaagctgaccagagatgccatcgagctgaatgctgccaactacacagtgtggcacttcagaagagtgctgctgaagagcctgcagaaggacctgcacgaggagatgaactacatcacagccatcatcgaggagcagcccaagaactaccaggtgtggcaccaccggcgggtgctggtggagtggctgcgggaccccagccaggagctggagttcatcgctgacatcctgaaccaggatgccaagaactaccacgcctggcagcaccggcagtgggtgatccaggagttcaagctgtgggacaatgagctgcagtatgtggaccagctgctgaaggaggatgtgaggaacaacagcgtgtggaaccagcgctacttcgtcatcagcaacaccaccggctacaatgacagagctgtgctggagcgggaggtgcagtacaccctggagatgatcaagctggtgccccacaatgaaagtgcctggaactacctgaagggcatcctgcaggaccggggcctgagcaagtaccccaacctgctgaaccagctgctggacctgcagcccagccacagcagcccctacctgattgccttcctggtggacatctatgaggacatgctggagaaccagtgtgacaacaaggaggacatcctgaacaaggccctggagctgtgtgagatcctggccaaggagaaggacaccatcaggaaggagtactggagatacatcggccgcagcctgcagagcaagcacagcacagaaaatgacagccccaccaacgtgcagcagtag

SEQ ID NO: 152067 - DNA, 939 bp, Artificial Sequence
  Description of Artificial Sequence: Synthetic coding sequence
atggccgccacagagggcgtgggggaggccgcccagggcggggagcccggccagcctgcccagcccccaccccagccccaccccccaccaccccagcagcagcacaaggaggagatggctgctgaggccggggaggccgtggccagccccatggatgatggctttgtgtccctggacagccccagctatgtgctgtaccgccacttccggcgggtgctgctgaagagcctgcagaaggacctgcacgaggagatgaactacatcacagccatcatcgaggagcagcccaagaactaccaggtgtggcaccacagaagagtgctggtggagtggctgcgggaccccagccaggagctggagttcatcgctgacatcctgaaccaggatgccaagaactaccacgcctggcagcaccggcagtgggtgatccaggagttcaagctgtgggacaatgagctgcagtatgtggaccagctgctgaaggaggatgtgaggaacaacagcgtgtggaaccagcgctactttgtgatcagcaacaccaccggctacaatgacagagctgtgctggagcgggaggtgcagtacaccctggagatgatcaagctggtgccccacaatgaaagtgcctggaactacctgaagggcatcctgcaggaccggggcctgagcaagtaccccaacctgctgaaccagctgctggacctgcagcccagccacagcagcccctacctgattgccttcctggtggacatctatgaggacatgctggagaaccagtgtgacaacaaggaggacatcctgaacaaggccctggagctgtgtgagatcctggccaaggagaaggacaccatcaggaaggagtactggagatacatcggccgcagcctgcagagcaagcacagcacagaaaatgacagccccaccaacgtgcagcagtag

SEQ ID NO: 152068 - DNA, 1314 bp, Artificial Sequence
  Description of Artificial Sequence: Synthetic coding sequence
atggccagccccagcagcttcacctactactgcccccccagcagcagccctgtgtggagcgagcccctgtacagcctgcggcctgagcacgcccgggagcggctgcaggatgattctgtggagaccgtgaccagcattgagcaggccaaggtggaggagaagatccaggaggtgttcagcagctacaagttcaaccacctggtgccccggctggtgctgcagcgggagaagcacttccactacctgaagaggggcctgcggcagctgacagatgcctatgagtgcctggatgccagccggccctggctgtgctactggatcctgcacagcctggagctgctggatgagcccatcccccagatcgtggccacagatgtgtgccagttcctggagctgtgccagagccctgagggcggctttggaggcggccctggccagtacccccacctggcccccacctatgctgctgtgaatgccctgtgcatcattggaacagaggaggcctatgacatcatcaaccgggagaagctgctgcagtacctgtacagcctgaagcagccagatggcagcttcctgatgcacgtgggcggggaggtggatgtgcgcagcgcctactgtgccgcctctgtggccagcctgaccaacatcatcaccccagacctgtttgagggcacagctgagtggatcgcccgctgccagaactgggagggcggcattggaggagtgcccggcatggaggcccacggcggctacaccttctgtggcctggccgccctggtgatcctgaagcgggagaggagcctgaacctgaagagcctgctgcagtgggtgaccagccggcagatgagatttgagggcggcttccagggccgctgcaacaagctggtggatggctgctacagcttctggcaggccggcctgctgcccctgctgcaccgggccctgcacgcccagggcgaccctgccctgtccatgagccactggatgttccaccagcaggccctgcaggagtacatcctgatgtgctgccagtgcccagctgggggcctgctggacaagccaggcaagagccgggacttctaccacacctgctactgcctgagcggcctgagcatcgcccagcacttcggcagcggggccatgctgcatgatgtggtgctgggcgtgcctgaaaatgccctgcagcccacccaccctgtgtacaacattggaccagacaaggtgatccaggccaccacctacttcctgcagaagcctgtgcccggctttgaggagctgaaggatgagaccagcgctgagcccgccacagactag

SEQ ID NO: 152069 - DNA, 1953 bp, Artificial Sequence
  Description of Artificial Sequence: Synthetic coding sequence
atggccagcaacatggaccgggagatgatcctggccgacttccaggcctgcaccggcattgaaaatattgatgaggccatcaccctgctggagcagaacaactgggacctggtggccgccatcaacggggtcatcccccaggagaatggcatcctgcagagtgaatatggaggagagaccatccctggccctgccttcaacccagccagccacccagccagcgcccccaccagcagcagcagcagcgccttccggcctgtgatgcccagccggcagatcgtggagcggcagcccaggatgctggacttccgggtggagtacagagacagaaatgtggatgtggtgctggaggacacctgcaccgtgggggagatcaagcagatcctggagaatgagctgcagatccctgtgtccaagatgctgctgaagggctggaagacaggagatgtggaggacagcacagtgctgaagagcctgcacctgcccaagaacaacagcctgtatgtgctgaccccagacctgcccccacccagcagcagcagccatgctggggccctgcaggagagcctgaaccagaacttcatgctgatcatcacccaccgggaggtgcagcgggagtacaacctgaacttcagcggcagcagcaccatccaggaggtgaagagaaatgtgtatgacctgaccagcatccctgtgcgccaccagctgtgggagggctggcccaccagcgccacagatgacagcatgtgcctggccgagagcggcctgagctacccctgccaccggctgactgtgggcagaagaagcagccctgcccagacccgggagcagagcgaggagcagatcacagatgtgcacatggtgtctgacagtgatggagatgactttgaagatgccacagaatttggagtggatgatggagaggtgtttggcatggccagcagcgccctgaggaagagccccatgatgccagaaaatgcagaaaatgaaggagatgccctgctgcagttcaccgctgagttcagcagccgctatggagactgccaccctgtgttcttcatcggcagcctggaggccgccttccaggaggccttctacgtgaaggcccgggacaggaagctgctggccatctacctgcaccatgatgagagcgtgctgaccaacgtgttctgcagccagatgctgtgtgccgagagcatcgtgtcctacctgagccagaacttcatcacctgggcctgggacctgaccaaggacagcaacagagcccgcttcctgaccatgtgcaacagacacttcggctctgtggtggcccagaccatccgcacccagaagacagaccagttccccctcttcctgatcatcatgggcaagaggagcagcaatgaggtgctgaatgtcatccagggcaacaccaccgtggatgagctgatgatgaggctgatggccgccatggagatcttcaccgcccagcagcaggaggacatcaaggatgaagatgagcgggaggccagagaaaatgtgaagcgggagcaggatgaggcctaccgcctgagcctggaggccgaccgggccaagcgggaggcccacgagcgggagatggccgagcagttccggctggagcagatcaggaaggagcaggaggaggagcgggaggccatccggctgagcctggagcaggccctgcccccagagcccaaggaggagaatgctgagcctgtgtccaagctgcgcatccgcacccccagcggggagttcctggagcggcgcttcctggccagcaacaagctgcagatcgtgtttgattttgtggccagcaagggcttcccctgggatgagtacaagctgctgagcaccttccccaggagagatgtgacccagctggaccccaacaagagcctgctggaggtgaagctgttcccccaggagaccctcttcctggaggccaaggagtag

SEQ ID NO: 152070 - DNA, 1473 bp, Artificial Sequence
  Description of Artificial Sequence: Synthetic coding sequence
atgatcctggccgacttccaggcctgcaccggcattgaaaatattgatgaggccatcaccctgctggagcagaacaactgggacctggtggccgccatcaacggggtcatcccccaggagaatggcatcctgcagagtgaatatggaggagagaccatccctggccctgccttcaacccagccagccacccagccagcgcccccaccagcagcagcagcagcgccttccggcctgtgatgcccagccggcagatcgtggagcggcagcccaggatgctggacttccgggtggagtacagagacagaaatgtggatgtggtgctggaggacacctgcaccgtgggggagatcaagcagatcctggagaatgagctgcagatccctgtgtccaagatgctgctgaagggctggaagacaggagatgtggaggacagcacagtgctgaagagcctgcacctgcccaagaacaacagcctgtatgtgctgaccccagacctgcccccacccagcagcagcagccatgctggggccctgcaggagttcagcagccgctatggagactgccaccctgtgttcttcatcggcagcctggaggccgccttccaggaggccttctacgtgaaggcccgggacaggaagctgctggccatctacctgcaccatgatgagagcgtgctgaccaacgtgttctgcagccagatgctgtgtgccgagagcatcgtgtcctacctgagccagaacttcatcacctgggcctgggacctgaccaaggacagcaacagagcccgcttcctgaccatgtgcaacagacacttcggctctgtggtggcccagaccatccgcacccagaagacagaccagttccccctcttcctgatcatcatgggcaagaggagcagcaatgaggtgctgaatgtcatccagggcaacaccaccgtggatgagctgatgatgaggctgatggccgccatggagatcttcaccgcccagcagcaggaggacatcaaggatgaagatgagcgggaggccagagaaaatgtgaagcgggagcaggatgaggcctaccgcctgagcctggaggccgaccgggccaagcgggaggcccacgagcgggagatggccgagcagttccggctggagcagatcaggaaggagcaggaggaggagcgggaggccatccggctgagcctggagcaggccctgcccccagagcccaaggaggagaatgctgagcctgtgtccaagctgcgcatccgcacccccagcggggagttcctggagcggcgcttcctggccagcaacaagctgcagatcgtgtttgattttgtggccagcaagggcttcccctgggatgagtacaagctgctgagcaccttccccaggagagatgtgacccagctggaccccaacaagagcctgctggaggtgaagctgttcccccaggagaccctcttcctggaggccaaggagtag

SEQ ID NO: 152071 - DNA, 1953 bp, Artificial Sequence; identical to SEQ ID NO: 152069
  Description of Artificial Sequence: Synthetic coding sequence

SEQ ID NO: 152072 - DNA, 1497 bp, Artificial Sequence
  Description of Artificial Sequence: Synthetic coding sequence
atggccagcaacatggaccgggagatgatcctggccgacttccaggcctgcaccggcattgaaaatattgatgaggccatcaccctgctggagcagaacaactgggacctggtggccgccatcaacggggtcatcccccaggagaatggcatcctgcagagtgaatatggaggagagaccatccctggccctgccttcaacccagccagccacccagccagcgcccccaccagcagcagcagcagcgccttccggcctgtgatgcccagccggcagatcgtggagcggcagcccaggatgctggacttccgggtggagtacagagacagaaatgtggatgtggtgctggaggacacctgcaccgtgggggagatcaagcagatcctggagaatgagctgcagatccctgtgtccaagatgctgctgaagggctggaagacaggagatgtggaggacagcacagtgctgaagagcctgcacctgcccaagaacaacagcctgtatgtgctgaccccagacctgcccccacccagcagcagcagccatgctggcaccctgcagcagttctcctaccgctatggagactgccaccctgtgttcttcatcggcagcctggaggccgccttccaggaggccttctacgtgaaggcccgggacaggaagctgctggccatctacctgcaccatgatgagagcgtgctgaccaacgtgttctgcagccagatgctgtgtgccgagagcatcgtgtcctacctgagccagaacttcatcacctgggcctgggacctgaccaaggacagcaacagagcccgcttcctgaccatgtgcaacagacacttcggctctgtggtggcccagaccatccgcacccagaagacagaccagttccccctcttcctgatcatcatgggcaagaggagcagcaatgaggtgctgaatgtcatccagggcaacaccaccgtggatgagctgatgatgaggctgatggccgccatggagatcttcaccgcccagcagcaggaggacatcaaggatgaagatgagcgggaggccagagaaaatgtgaagcgggagcaggatgaggcctaccgcctgagcctggaggccgaccgggccaagcgggaggcccacgagcgggagatggccgagcagttccggctggagcagatcaggaaggagcaggaggaggagcgggaggccatccggctgagcctggagcaggccctgcccccagagcccaaggaggagaatgctgagcctgtgtccaagctgcgcatccgcacccccagcggggagttcctggagcggcgcttcctggccagcaacaagctgcagatcgtgtttgattttgtggccagcaagggcttcccctgggatgagtacaagctgctgagcaccttccccaggagagatgtgacccagctggaccccaacaagagcctgctggaggtgaagctgttcccccaggagaccctcttcctggaggccaaggagtag

SEQ ID NO: 152073 - DNA, 1227 bp, Artificial Sequence
  Description of Artificial Sequence: Synthetic coding sequence
atgaggaacctgctggagatgtgcctggccgagagcggcctgagctacccctgccaccggctgactgtgggcagaagaagcagccctgcccagacccgggagcagagcgaggagcagatcacagatgtgcacatggtgtctgacagtgatggagatgactttgaagatgccacagaatttggagtggatgatggagaggtgtttggcatggccagcagcgccctgaggaagagccccatgatgccagaaaatgcagaaaatgaaggagatgccctgctgcagttcaccgctgagttcagcagccgctatggagactgccaccctgtgttcttcatcggcagcctggaggccgccttccaggaggccttctacgtgaaggcccgggacaggaagctgctggccatctacctgcaccatgatgagagcgtgctgaccaacgtgttctgcagccagatgctgtgtgccgagagcatcgtgtcctacctgagccagaacttcatcacctgggcctgggacctgaccaaggacagcaacagagcccgcttcctgaccatgtgcaacagacacttcggctctgtggtggcccagaccatccgcacccagaagacagaccagttccccctcttcctgatcatcatgggcaagaggagcagcaatgaggtgctgaatgtcatccagggcaacaccaccgtggatgagctgatgatgaggctgatggccgccatggagatcttcaccgcccagcagcaggaggacatcaaggatgaagatgagcgggaggccagagaaaatgtgaagcgggagcaggatgaggcctaccgcctgagcctggaggccgaccgggccaagcgggaggcccacgagcgggagatggccgagcagttccggctggagcagatcaggaaggagcaggaggaggagcgggaggccatccggctgagcctggagcaggccctgcccccagagcccaaggaggagaatgctgagcctgtgtccaagctgcgcatccgcacccccagcggggagttcctggagcggcgcttcctggccagcaacaagctgcagatcgtgtttgattttgtggccagcaagggcttcccctgggatgagtacaagctgctgagcaccttccccaggagagatgtgacccagctggaccccaacaagagcctgctggaggtgaagctgttcccccaggagaccctcttcctggaggccaaggagtag

SEQ ID NO: 152074 - DNA, 951 bp, Artificial Sequence
  Description of Artificial Sequence: Synthetic coding sequence
atgacccagggcaagctgtctgtggccaacaaggcccctggaacagagggccagcagcaggtgcacggggagaagaaggaggccccagctgtgcccagcgcccctccttcctatgaggaggccaccagcggggagggcatgaaggccggggccttccccccagcccccacagctgtgcccctgcaccccagctgggcctacgtggaccccagcagcagcagcagctatgacaatggcttccccaccggggaccacgagctgttcaccaccttctcctgggatgaccagaaggtgagaagagtgtttgtgaggaaggtgtacaccatcctgctgatccagctgctggtgaccctggccgtggtggccctcttcaccttctgtgaccctgtgaaggactatgtgcaggccaaccctggctggtactgggccagctatgctgtgttctttgccacctacctgaccctggcctgctgcagcggcccccggcggcacttcccctggaacctgatcctgctgactgtgttcaccctgtccatggcctacctgaccggcatgctgagcagctactacaacaccacctctgtgctgctgtgcctgggcatcacagccctggtgtgcctgtctgtgaccgtcttctccttccagaccaagtttgacttcaccagctgccagggcgtgctgtttgtgctgctgatgaccctcttcttcagcggcctcatcctggccatcctgctgcccttccagtatgtgccctggctgcatgctgtgtatgctgccctgggcgctggggtcttcaccctcttcctggccctggacacccagctgctgatgggcaacagaagacacagcctgagccctgaggagtacatctttggagccctgaacatctacctggacatcatctacatcttcaccttcttcctgcagctgtttggcaccaaccgggagtag

SEQ ID NO: 152075 - DNA, 951 bp, Artificial Sequence; identical to SEQ ID NO: 152074
  Description of Artificial Sequence: Synthetic coding sequence

SEQ ID NO: 152076 - DNA, 813 bp, Artificial Sequence
  Description of Artificial Sequence: Synthetic coding sequence
atgaaggccggggccttccccccagcccccacagctgtgcccctgcaccccagctgggcctacgtggaccccagcagcagcagcagctatgacaatggcttccccaccggggaccacgagctgttcaccaccttctcctgggatgaccagaaggtgagaagagtgtttgtgaggaaggtgtacaccatcctgctgatccagctgctggtgaccctggccgtggtggccctcttcaccttctgtgaccctgtgaaggactatgtgcaggccaaccctggctggtactgggccagctatgctgtgttctttgccacctacctgaccctggcctgctgcagcggcccccggcggcacttcccctggaacctgatcctgctgactgtgttcaccctgtccatggcctacctgaccggcatgctgagcagctactacaacaccacctctgtgctgctgtgcctgggcatcacagccctggtgtgcctgtctgtgaccgtcttctccttccagaccaagtttgacttcaccagctgccagggcgtgctgtttgtgctgctgatgaccctcttcttcagcggcctcatcctggccatcctgctgcccttccagtatgtgccctggctgcatgctgtgtatgctgccctgggcgctggggtcttcaccctcttcctggccctggacacccagctgctgatgggcaacagaagacacagcctgagccctgaggagtacatctttggagccctgaacatctacctggacatcatctacatcttcaccttcttcctgcagctgtttggcaccaaccgggagtag

SEQ ID NO: 152077 - DNA, 1173 bp, Artificial Sequence
  Description of Artificial Sequence: Synthetic coding sequence
atggacttctggctgtggcccctgtacttcctgcctgtgtctggggccctgcgcatcctgcctgaggtgaaggtggagggggagctgggcggctctgtgaccatcaagtgccccctgcctgagatgcacgtgcgcatctacctgtgccgggagatggccggcagcggcacctgtggcaccgtggtgtccaccaccaacttcatcaaggccgagtacaagggccgggtgaccctgaagcagtaccccaggaagaacctcttcctggtggaggtgacccagctgacagaaagtgacagcggcgtgtatgcctgtggggccggcatgaacacagaccggggcaagacccagaaggtgaccctgaatgtgcacagtgaatatgagcccagctgggaggagcagcccatgcctgagacccccaagtggttccacctgccctacctgttccagatgcctgcctatgccagcagcagcaagtttgtgaccagggtgaccaccccagcccagaggggcaaggtgccccctgtgcaccacagcagccccaccacccagatcacccaccggccccgggtgtcccgggccagctctgtggccggggacaagcccaggaccttcctgcccagcaccacagccagcaagatcagcgccctggagggcctgctgaagccccagacccccagctacaaccaccacacccggctgcaccggcagagggccctggactatggcagccagagcggccgggagggccagggcttccacatcctgatccccaccatcctgggcctcttcctgctggccctgctgggcctggtggtgaagagagctgtggagaggaggaaggccctgagccggcgggcccggcggctggccgtgaggatgagggccctggagagcagccagaggccccggggcagcccccggcccaggagccagaacaacatctacagcgcctgcccccggcgggcccggggagcagatgctgctggcaccggggaggcccctgtgcccggccctggggcccccctgcccccagcccccctgcaggtgtctgagagcccctggctgcacgcccccagcctgaagaccagctgtgaatatgtgtccctgtaccaccagcctgctgccatgatggaggacagcgacagtgatgactacatcaacgtgcctgcctag

SEQ ID NO: 152078 - DNA, 921 bp, Artificial Sequence
  Description of Artificial Sequence: Synthetic coding sequence
atggacttctggctgtggcccctgtacttcctgcctgtgtctggggccctgcgcatcctgcctgaggtgaaggtggagggggagctgggcggctctgtgaccatcaagtgccccctgcctgagatgcacgtgcgcatctacctgtgccgggagatggccggcagcggcacctgtggcaccgtggtgtccaccaccaacttcatcaaggccgagtacaagggccgggtgaccctgaagcagtaccccaggaagaacctcttcctggtggaggtgacccagctgacagaaagtgacagcggcgtgtatgcctgtggggccggcatgaacacagaccggggcaagacccagaaggtgaccctgaatgtgcacagtgaatatgagcccagctgggaggagcagcccatgcctgagacccccaagtggttccacctgccctacctgttccagatgcctgcctatgccagcagcagcaagtttgtgaccagggtgaccaccccagcccagaggggcaaggtgccccctgtgcaccacagcagccccaccacccagatcacccaccggccccgggtgtcccgggccagctctgtggccggggacaagcccaggaccttcctgcccagcaccacagccagcaagatcagcgccctggagggcctgctgaagccccagacccccagctacaaccaccacacccggctgcaccggcagagccccctgcaggccggccccccaacaggccgggaggatgcccggcctggagagctgcctgaggccccccgggtggccgccacagccctgcccaagcagcacctgcagaggctgcctgctgcccgctcctggagcggccgctgccgccaccggggcggccccaggagccggcccaggtctgctgtggcccccaggcctgctgctggggtgtag

SEQ ID NO: 152079 - DNA, 837 bp, Artificial Sequence
  Description of Artificial Sequence: Synthetic coding sequence
atggacttctggctgtggcccctgtacttcctgcctgaatatgagcccagctgggaggagcagcccatgcctgagacccccaagtggttccacctgccctacctgttccagatgcctgcctatgccagcagcagcaagtttgtgaccagggtgaccaccccagcccagaggggcaaggtgccccctgtgcaccacagcagccccaccacccagatcacccaccggccccgggtgtcccgggccagctctgtggccggggacaagcccaggaccttcctgcccagcaccacagccagcaagatcagcgccctggagggcctgctgaagccccagacccccagctacaaccaccacacccggctgcaccggcagagggccctggactatggcagccagagcggccgggagggccagggcttccacatcctgatccccaccatcctgggcctcttcctgctggccctgctgggcctggtggtgaagagagctgtggagaggaggaaggccctgagccggcgggcccggcggctggccgtgaggatgagggccctggagagcagccagaggccccggggcagcccccggcccaggagccagaacaacatctacagcgcctgcccccggcgggcccggggagcagatgctgctggcaccggggaggcccctgtgcccggccctggggcccccctgcccccagcccccctgcaggtgtctgagagcccctggctgcacgcccccagcctgaagaccagctgtgaatatgtgtccctgtaccaccagcctgctgccatgatggaggacagcgacagtgatgactacatcaacgtgcctgcctag

SEQ ID NO: 152080 - DNA, 456 bp, Artificial Sequence
  Description of Artificial Sequence: Synthetic coding sequence
atggacttctggctgtggcccctgtacttcctgcctgtgtctggggccctgcgcatcctgcctgaggtgaaggtggagggggagctgggcggctctgtgaccatcaagtgccccctgcctgagatgcacgtgcgcatctacctgtgccgggagatggccggcagcggcacctgtggcaccgtggtgtccaccaccaacttcatcaaggccgagtacaagggccgggtgaccctgaagcagtaccccaggaagaacctcttcctggtggaggtgacccagctgacagaaagtgacagcggcgtgtatgcctgtggggccggcatgaacacagaccggggcaagacccagaaggtgaccctgaatgtgcacagtgaatatgagcccagctgggaggagcagcccatgcctgagacccccaagtggttccacctgccctacctgttccagatgccctag

SEQ ID NO: 152081 - DNA, 444 bp, Artificial Sequence
  Description of Artificial Sequence: Synthetic coding sequence
atggacttctggctgtggcccctgtacttcctgcctgtgtctggggccctgcgcatcctgcctgaggtgaaggtggagggggagctgggcggctctgtgaccatcaagtgccccctgcctgagatgcacgtgcgcatctacctgtgccgggagatggccggcagcggcacctgtggcaccgtggtgtccaccaccaacttcatcaaggccgagtacaagggccgggtgaccctgaagcagtaccccaggaagaacctcttcctggtggaggtgacccagctgacagaaagtgacagcggcgtgtatgcctgtggggccggcatgaacacagaccggggcaagacccagaaggtgaccctgaatgtgcacagtgaatatgagcccagctgggaggagcagcccatgcctgagacccccaagtggttccacctgccctacctgtag

SEQ ID NO: 152082 - DNA, 426 bp, Artificial Sequence
  Description of Artificial Sequence: Synthetic coding sequence
atggacttctggctgtggcccctgtacttcctgcctgagatggagagctgctgcgtggcccaggacggcctggagctggtggccctgagtgaccccccaggcagcgccagccagagcgctggcatcaccgtgtctggggccctgcgcatcctgcctgaggtgaaggtggagggggagctgggcggctctgtgaccatcaagtgccccctgcctgagatgcacgtgcgcatctacctgtgccgggagatggccggcagcggcacctgtggcaccgtggtgtccaccaccaacttcatcaaggccgagtacaagggccgggtgaccctgaagcagtaccccaggaagaacctcttcctggtggaggtgacccagctgacagaaagtgacagcggcgtgtatgcctgtggggccggcatgaacacctag

SEQ ID NO: 152083 - DNA, 1398 bp, Artificial Sequence
  Description of Artificial Sequence: Synthetic coding sequence
atgaggcggcccagaggagagcccggcccccgggccccccggcccacagagggcgccacctgtgccggccctggagagagctggagccccagccccaacagcatgctgcgggtgctgctgagcgcccagaccagccctgcccggctgagcggcctgctgctgatcccccctgtgcagccctgctgcctgggccccagcaagtggggagacaggcctgtgggcggcggccccagcgctggccctgtgcagggcctgcagaggctgctggagcaggccaagagccctggagagctgctgcgctggctgggccagaaccccagcaaggtgcgggcccaccactacagcgtggccctgcggcggctgggccagctgctgggcagccggcccaggcctcctcctgtggagcaggtgaccctgcaggacctgagccagctgatcatccggaactgccccagctttgacatccacaccatccacgtgtgcctgcacctggccgtgctgctgggcttccccagtgatggccccctggtgtgtgccctggagcaggagcggcggctgcggctgccccccaagcccccaccacccctgcagcccctgctgcggggcggccagggcctggaggccgccctgagctgcccccgcttcctgcgctacccccggcagcacctgatcagcagcctggccgaggcccggcctgaggagctgaccccccacgtgatggtgctgctggcccagcacctggcccggcaccggctgcgggagccccagctgctggaggccatcgcccacttcctggtggtgcaggagacccagctgagcagcaaggtggtgcagaagctggtgctgcccttcggccgcctgaactacctgcccctggagcagcagttcatgccctgcctggagcgcatcctggcccgggaggccggcgtggcccccctggccaccgtgaacatcctgatgagcctgtgccagctgcgctgcctgcccttccgggccctgcactttgtgttcagccctggcttcatcaactacatcagcggcaccccccacgccctgattgtgcggcgctacctgagcctgctggacacagctgtggagctggagctgcccggctaccggggcccccggctgccccggcggcagcaggtgcccatcttcccccagcccctcatcacagaccgggcccgctgcaagtacagccacaaggacatcgtggccgagggcctgcggcagctgctgggggaggagaagtaccggcaggacctgactgtgcccccaggctactgcacagacttcctgctgtgtgccagcagcagtggagctgtgctgcctgtgaggacccaggaccccttcctgccctacccaccccgggcctgccccagcagccgggccacctag

SEQ ID NO: 152084 - DNA, 1650 bp, Artificial Sequence
  Description of Artificial Sequence: Synthetic coding sequence
atgaggcggcccagaggagagcccggcccccgggccccccggcccacagagggcgccacctgtgccggccctggagagagctggagccccagccccaacagcatgctgcgggtgctgctgagcgcccagaccagccctgcccggctgagcggcctgctgctgatcccccctgtgcagccctgctgcctgggccccagcaagtggggagacaggcctgtgggcggcggccccagcgctggccctgtgcagggcctgcagaggctgctggagcaggccaagagccctggagagctgctgcgctggctgggccagaaccccagcaaggtgcgggcccaccactacagcgtggccctgcggcggctgggccagctgctgggcagccggcccaggcctcctcctgtggagcaggtgaccctgcaggacctgagccagctgatcatccggaactgccccagctttgacatccacaccatccacgtgtgcctgcacctggccgtgctgctgggcttccccagtgatggccccctggtgtgtgccctggagcaggagcggcggctgcggctgccccccaagcccccaccacccctgcagcccctgctgcggggcggccagggcctggaggccgccctgagctgcccccgcttcctgcgctacccccggcagcacctgatcagcagcctggccgaggcccggcctgaggagctgaccccccacgtgatggtgctgctggcccagcacctggcccggcaccggctgcgggagccccagctgctggaggccatcgcccacttcctggtggtgcaggagacccagctgagcagcaaggtggtgcagaagctggtgctgcccttcggccgcctgaactacctgcccctggagcagcagttcatgccctgcctggagcgcatcctggcccgggaggccggcgtggcccccctggccaccgtgaacatcctgatgagcctgtgccagctgcgctgcctgcccttccgggccctgcactttgtgttcagccctggcttcatcaactacatcagcggcaccccccacgccctgattgtgcggcgctacctgagcctgctggacacagctgtggagctggagctgcccggctaccggggcccccggctgccccggcggcagcaggtgcccatcttcccccagcccctcatcacagaccgggcccgctgcaagtacagccacaaggacatcgtggccgagggcctgcggcagctgctgggggaggagaagtaccggcaggacctgactgtgcccccaggctactgcacagacttcctgctgtgtgccagcagcagtggagctgtgctgcctgtgaggacccaggaccccttcctgccctacccacccaggagctgcccccagggccaggccgccagcagcgccaccacccgggaccctgcccagagggtggtgctggtgctgcgggagcgctggcacttctgcagagatggccgggtgctgctgggcagccgggccctgcgggagcggcacctgggcctgatgggctaccagctgctgcccctgccctttgaggagctggagagccagaggggcctgccccagctgaagagctacctgcggcagaagctgcaggccctgggcctgcgctggggccctgagggcggctag

SEQ ID NO: 152085 - DNA, 1227 bp, Artificial Sequence
  Description of Artificial Sequence: Synthetic coding sequence
atgaggcggcccagaggagagcccggcccccgggccccccggcccacagagggcgccacctgtgccggccctggagagagctgcttccccagtgatggccccctggtgtgtgccctggagcaggagcggcggctgcggctgccccccaagcccccaccacccctgcagcccctgctgcggggcggccagggcctggaggccgccctgagctgcccccgcttcctgcgctacccccggcagcacctgatcagcagcctggccgaggcccggcctgaggagctgacccctcatgtgatggtgctgctggcccagcacctggcccggcaccggctgcgggagccccagctgctggaggccatcgcccacttcctggtggtgcaggagacccagctgagcagcaaggtggtgcagaagctggtgctgcccttcggccgcctgaactacctgcccctggagcagcagttcatgccctgcctggagcgcatcctggcccgggaggccggcgtggcccccctggccaccgtgaacatcctgatgagcctgtgccagctgcgctgcctgcccttccgggccctgcactttgtgttcagccctggcttcatcaactacatcagcggcacccctcatgccctgattgtgcggcgctacctgagcctgctggacacagctgtggagctggagctgcccggctaccggggcccccggctgccccggcggcagcaggtgcccatcttcccccagcccctcatcacagaccgggcccgctgcaagtacagccacaaggacatcgtggccgagggcctgcggcagctgctgggggaggagaagtaccggcaggacctgactgtgcccccaggctactgcacagacttcctgctgtgtgccagcagcagcggggctgtgctgcctgtgaggacccaggaccccttcctgccctacccacccaggagctgcccccagggccaggccgccagcagcgccaccacccgggaccctgcccagagggtggtgctggtgctgcgggagcgctggcacttctgcagagatggccgggtgctgctgggcagccgggccctgcgggagcggcacctgggcctgatgggctaccagctgctgcccctgccctttgaggagctggagagccagaggggcctgccccagctgaagagctacctgcggcagaagctgcaggccctgggcctgcgctggggccctgagggcggctag

SEQ ID NO: 152086 - DNA, 480 bp, Artificial Sequence
  Description of Artificial Sequence: Synthetic coding sequence
atgctgcgggtgctgctgagcgcccagaccagccctgcccggctgagcggcctgctgctgatcccccctgtgcagccctgctgcctgggccccagcaagtggggagacaggcctgtgggcggcggccccagcgctggccctgtgcagggcctgcagaggctgctggagcaggccaagagccctggagagctgctgcgctggctgggccagaaccccagcaaggtgcgggcccaccactacagcgtggccctgcggcggctgggccagctgctgggcagccggcccaggcctcctcctgtggagcaggtgaccctgcaggacctgagccagctgatcatccggaactgccccagctttgacatccacaccatccacgtgtgcctgcacctggccgtgctgctgggcggcacagaggtgggccctgccctgtgggccacagagctgcctgcccctggaacagctgtgtatgccctgccctag

SEQ ID NO: 152087 - DNA, 1569 bp, Artificial Sequence
  Description of Artificial Sequence: Synthetic coding sequence
atgaggcggcccagaggagagcccggcccccgggccccccggcccacagagggcgccacctgtgccggccctggagagagctggagccccagccccaacagcatgctgcgggtgctgctgagcgcccagaccagccctgcccggctgagcggcctgctgctgatcccccctgtgcagccctgctgcctgggccccagcaagtggggagacaggcctgtgggcggcggccccagcgctggccctgtgcagggcctgcagaggctgctggagcaggccaagagccctggagagctgctgcgctggctgggccagaaccccagcaaggtgcgggcccaccactacagcgtggccctgcggcggctgggccagctgctgggcagccggcccaggcctcctcctgtggagcaggtgaccctgcaggacctgagccagctgatcatccggaactgccccagctttgacatccacaccatccacgtgtgcctgcacctggccgtgctgctgggcttccccagtgatggccccctggtgtgtgccctggagcaggagcggcggctgcggctgccccccaagcccccaccacccctgcagcccctgctgcgggaggcccggcctgaggagctgacccctcatgtgatggtgctgctggcccagcacctggcccggcaccggctgcgggagccccagctgctggaggccatcgcccacttcctggtggtgcaggagacccagctgagcagcaaggtggtgcagaagctggtgctgcccttcggccgcctgaactacctgcccctggagcagcagttcatgccctgcctggagcgcatcctggcccgggaggccggcgtggcccccctggccaccgtgaacatcctgatgagcctgtgccagctgcgctgcctgcccttccgggccctgcactttgtgttcagccctggcttcatcaactacatcagcggcacccctcatgccctgattgtgcggcgctacctgagcctgctggacacagctgtggagctggagctgcccggctaccggggcccccggctgccccggcggcagcaggtgcccatcttcccccagcccctcatcacagaccgggcccgctgcaagtacagccacaaggacatcgtggccgagggcctgcggcagctgctgggggaggagaagtaccggcaggacctgactgtgcccccaggctactgcacagacttcctgctgtgtgccagcagcagcggggctgtgctgcctgtgaggacccaggaccccttcctgccctacccacccaggagctgcccccagggccaggccgccagcagcgccaccacccgggaccctgcccagagggtggtgctggtgctgcgggagcgctggcacttctgcagagatggccgggtgctgctgggcagccgggccctgcgggagcggcacctgggcctgatgggctaccagctgctgcccctgccctttgaggagctggagagccagaggggcctgccccagctgaagagctacctgcggcagaagctgcaggccctgggcctgcgctggggccctgagggcggctag

SEQ ID NO: 152088 - DNA, 1179 bp, Artificial Sequence
  Description of Artificial Sequence: Synthetic coding sequence
atggaggcccccctggtgtccctggatgaggagtttgaggacctgcggcccagctgcagtgaagatcctgaggagaagccccagtgcttctacggcagcagcccccaccacctggaggaccccagcctgtctgagctggagaacttcagcagcgagatcatctccttcaagtccatggaggacctggtgaatgaatttgatgagaagctgaatgtgtgcttcaggaactacaatgccaagacagagaacctggcccctgtgaagaaccagctgcagatccaggaggaggaggagaccctgcaggatgaggaggtgtgggatgccctgacagacaactacatccccagcctgtctgaggactggagggaccccaacatcgaggccctgaatggaaactgcagcgacacagagatccacgagaaggaggaggaggagttcaatgagaagtcagaaaatgacagcggcatcaatgaggagcccctgctgacagctgaccaggtgattgaggagattgaggagatgatgcagaacagcccagaccctgaggaggaggaggaggtgctggaggaggaggatggaggagagaccagcagccaggccgacagcgtgctgctgcaggagatgcaggccctgacccagaccttcaacaacaactggagctatgagggcctgcggcacatgagcggcagcgagctgacagagctgctggaccaggtggagggcgccatccgggacttcagcgaggagctggtgcagcagctggccaggagagatgagctggagtttgagaaggaggtgaagaacagcttcatcaccgtgctgattgaggtgcagaacaagcagaaggagcagcgggagctgatgaagaagaggaggaaggagaagggcctgagcctgcagagcagccgcatcgagaagggcaaccagatgcccctgaagcgcttctccatggagggcatcagcaacatcctgcagagcggcatccggcagaccttcggcagcagcggcacagacaagcagtacctgaacacagtcatcccctatgagaagaaggccagcccccccagcgtggaggacctgcagatgctgaccaacatcctgtttgccatgaaggaggacaatgagaaggtgcccaccctgctgacagactacatcctgaaggtgctgtgccccacctag

SEQ ID NO: 152089 - DNA, 315 bp, Artificial Sequence
  Description of Artificial Sequence: Synthetic coding sequence
atggaggcccccctggtgtccctggatgaggagtttgaggacctgcggcccagctgcagtgaagatcctgaggagaagccccagtgcttctacggcagcagcccccaccacctggaggaccccagcctgtctgagctggagaacttcagcagcgagatcatctccttcaagtccatggaggacctggtgaatgaatttgatgagaagctgaatgtgtgcttcaggaactacaatgccaagacagagaacctggcccctgtgaagaaccagctgcagatccaggaggaggaggagaccctgcaggatgaggagtag

SEQ ID NO: 152090 - DNA, 315 bp, Artificial Sequence; identical to SEQ ID NO: 152089
  Description of Artificial Sequence: Synthetic coding sequence

SEQ ID NO: 152091 - DNA, 1419 bp, Artificial Sequence
  Description of Artificial Sequence: Synthetic coding sequence
atgacagccaacggcacagctgaggccgtgcagatccagtttggcctcatcaactgtggcaacaagtacctgacagctgaggccttcggcttcaaggtgaatgccagcgccagcagcctgaagaagaaccacctgggccgctacctggccgctgacaaggatggaaatgtgacctgtgagcgggaggtgcccggccctgactgccgcttcctgattgtggcccatgatgatggccgctggagcctgcagagcgaggcccaccggcgctactttggaggaacagaagatcggctgagctgctttgcccagacagtgtccccagctgagaagtggagcgtgcacatcgccatgcacccccaggtgaacatctacagcgtgaccaggaagagatatgcccacctgagcgcccggccagcagatgaaattgctgtggacagagatgtgccctggggcgtggacagcctcatcaccctggccttccaggaccagcgctacagcgtgcagacagctgaccaccgcttcctgcggcatgatggccgcctggtggcccggcctgagcccgccaccggctacaccctggagttccgcagcggcaaggtggccttccgggactgtgagggccgctacctggcccccagcggccccagcggcaccctgaaggccggcaaggccaccaaggtgggcaaggatgagctgtttgccctggagcagagctgtgcccaggtggtgctgcaggccgccaatgaaagaaatgtgtccacccggcagggcatggacctgagcgccaaccaggatgaggagacagaccaggagaccttccagctggagattgaccgggacaccaagaagtgtgccttccgcacccacacaggcaagtactggaccctgacagccactggaggagtgcagagcacagccagcagcaagaatgccagctgctactttgatattgagtggagggaccggcgcatcaccctgcgggccagcaatggcaagtttgtgaccagcaagaagaatggccagctggccgcctctgtggagacagctggggacagcgagctgttcctgatgaagctgatcaaccggcccatcatcgtgttccggggggagcacggcttcatcggctgcaggaaggtgacaggcaccctggatgccaacagaagcagctatgatgtgttccagctggagttcaatgatggagcctacaacatcaaggacagcacaggcaagtactggacagtgggcagtgacagcgctgtgaccagcagcggggacacccctgtggacttcttctttgagttctgtgactacaacaaggtggccatcaaggtgggcggccgctacctgaagggggaccacgccggcgtgctgaaggccagcgctgagaccgtggaccctgccagcctgtgggagtactag

SEQ ID NO: 152092 - DNA, 1482 bp, Artificial Sequence
  Description of Artificial Sequence: Synthetic coding sequence
atgacagccaacggcacagctgaggccgtgcagatccagtttggcctcatcaactgtggcaacaagtacctgacagctgaggccttcggcttcaaggtgaatgccagcgccagcagcctgaagaagaagcagatctggaccctggagcagcccccagatgaagctggcagcgctgctgtgtgcctgcggagccacctgggccgctacctggccgctgacaaggatggaaatgtgacctgtgagcgggaggtgcccggccctgactgccgcttcctgattgtggcccatgatgatggccgctggagcctgcagagcgaggcccaccggcgctactttggaggaacagaggaccggctgagctgctttgcccagacagtgtccccagctgagaagtggagcgtgcacatcgccatgcacccccaggtgaacatctacagcgtgaccaggaagagatatgcccacctgagcgcccggccagcagatgaaattgctgtggacagagatgtgccctggggcgtggacagcctcatcaccctggccttccaggaccagcgctacagcgtgcagacagctgaccaccgcttcctgcggcatgatggccgcctggtggcccggcctgagcccgccaccggctacaccctggagttccgcagcggcaaggtggccttccgggactgtgagggccgctacctggcccccagcggccccagcggcaccctgaaggccggcaaggccaccaaggtgggcaaggatgagctgtttgccctggagcagagctgtgcccaggtggtgctgcaggccgccaatgaaagaaatgtgtccacccggcagggcatggacctgagcgccaaccaggatgaggagacagaccaggagaccttccagctggagattgaccgggacaccaagaagtgtgccttccgcacccacacaggcaagtactggaccctgacagccaccggcggcgtgcagagcacagccagcagcaagaatgccagctgctactttgacatcgagtggagggaccggcgcatcaccctgcgggccagcaatggcaagtttgtgaccagcaagaagaatggccagctggccgcctctgtggagacagctggggacagcgagctgttcctgatgaagctgatcaaccggcccatcatcgtgttccggggggagcacggcttcatcggctgcaggaaggtgacaggcaccctggatgccaacagaagcagctatgatgtgttccagctggagttcaatgatggagcctacaacatcaaggacagcacaggcaagtactggacagtgggcagtgacagcgctgtgaccagcagcggggacacccctgtggacttcttctttgagttctgtgactacaacaaggtggccatcaaggtgggcggccgctacctgaagggggaccatgctggggtgctgaaggccagcgctgagaccgtggaccctgccagcctgtgggagtactag

SEQ ID NO: 152093 - DNA, 648 bp, Artificial Sequence
  Description of Artificial Sequence: Synthetic coding sequence
atggacctgagcgccaaccaggatgaggagacagaccaggagaccttccagctggagattgaccgggacaccaagaagtgtgccttccgcacccacacaggcaagtactggaccctgacagccaccggcggcgtgcagagcacagccagcagcaagaatgccagctgctactttgacatcgagtggagggaccggcgcatcaccctgcgggccagcaatggcaagtttgtgaccagcaagaagaatggccagctggccgcctctgtggagacagctggggacagcgagctgttcctgatgaagctgatcaaccggcccatcatcgtgttccggggggagcacggcttcatcggctgcaggaaggtgacaggcaccctggatgccaacagaagcagctatgatgtgttccagctggagttcaatgatggagcctacaacatcaaggacagcacaggcaagtactggacagtgggcagtgacagcgctgtgaccagcagcggggacacccctgtggacttcttctttgagttctgtgactacaacaaggtggccatcaaggtgggcggccgctacctgaagggggaccatgctggggtgctgaaggccagcgctgagaccgtggaccctgccagcctgtgggagtactag

SEQ ID NO: 152094 - DNA, 1551 bp, Artificial Sequence
  Description of Artificial Sequence: Synthetic coding sequence
atgcccaccaacggcctgcaccaggtgctgaagatccagtttggcctggtgaatgacacagaccgctacctgacagctgagagctttggcttcaaggtgaatgccagcgcccccagcctgaagaggaagcagacctgggtgctggagccagaccccggccagggcacagctgtgctgctgcggagcagccacctgggccgctacctgtctgcagaagaagatggccgggtggcctgtgaggccgagcagcccggccgggactgccgcttcctggtgctgccccagccagatggccgctgggtgctgcggtctgagccccacggccgcttctttggaggaacagaggaccagctgagctgctttgccacagctgtgtccccagctgagctgtggacagtgcacctggccatccacccccaggcccacctgctgtctgtgtccagaagaagatatgtgcacctgtgcccccgggaggatgagatggctgctgatggagacaagccctggggcgtggatgccctgctgaccctcatcttccgcagccgccgctactgcctgaagagctgtgacagccgctacctgcggagtgatggccgcctggtgtgggagcctgagccccgggcctgctacaccctggagttcaaggccggcaagctggccttcaaggactgtgatggccactacctggcccctgtgggccctgctggcaccctgaaggccggcaggaacaccaggcctgggaaggatgagctgtttgacctggaggagagccacccccaggtggtgctggtggccgccaaccaccgctacgtgtctgtgcggcagggcgtgaatgtgtctgccaaccaggatgatgagctggaccacgagaccttcctgatgcagattgaccaggagaccaagaagtgcaccttctacagcagcactggaggctactggaccctggtgacccacggcggcatccacgccacagccacccaggtgtctgccaacaccatgtttgagatggagtggagaggaagaagagtggccctgaaggccagcaatggccgctacgtgtgcatgaagaagaatggccagctggccgccatcagtgactttgtgggccccccacccaggcctgcctggacaggcaaggtggccggcggggccgcccagcagaccctgagccccccaggcaaggatgaggagttcaccctgaagctgatcaaccggcccatcctggtgctgcggggcctggatggctttgtgtgccaccaccggggcagcaaccagctggacaccaacagatctgtgtatgatgtgttccacctgtccttcagtgatggagcctaccgcatccggggcagagatggcggcttctggtacacaggcagccacggctctgtgtgcagtgatggagagcgggcagaagattttgtgtttgagttccgggagcggggccgcctggccatccgggcccggagcggcaagtacctgcggggcggggccagcggcctgctgcgggcagatgctgatgccccagctggaacagccctgtgggagtactag

SEQ ID NO: 152095 - DNA, 1479 bp, Artificial Sequence
  Description of Artificial Sequence: Synthetic coding sequence
atgcccaccaacggcctgcaccaggtgctgaagatccagtttggcctggtgaatgacacagaccgctacctgacagctgagagctttggcttcaaggtgaatgccagcgcccccagcctgaagaggaagcagacctgggtgctggagccagaccccggccagggcacagctgtgctgctgcggagcagccacctgggccgctacctgtctgcagaagaagatggccgggtggcctgtgaggccgagcagcccggccgggactgccgcttcctggtgctgccccagccagatggccgctgggtgctgcggtctgagccccacggccgcttctttggaggaacagaggaccagctgagctgctttgccacagctgtgtccccagctgagctgtggacagtgcacctggccatccacccccaggcccacctgctgtctgtgtccagaagaagatatgtgcacctgtgcccccgggaggatgagatggctgctgatggagacaagccctggggcgtggatgccctgctgaccctcatcttccgcagccgccgctactgcctgaagagctgtgacagccgctacctgcggagtgatggccgcctggtgtgggagcctgagccccgggcctgctacaccctggagttcaaggccggcaagctggccttcaaggactgtgatggccactacctggcccctgtgggccctgctggcaccctgaaggccggcaggaacaccaggcctgggaaggatgagctgtttgacctggaggagagccacccccaggtggtgctggtggccgccaaccaccgctacgtgtctgtgcggcagggcgtgaatgtgtctgccaaccaggatgatgagctggaccacgagaccttcctgatgcagattgaccaggagaccaagaagtgcaccttctacagcagcactggaggctactggaccctggtgacccacggcggcatccacgccacagccacccaggtgtctgccaacaccatgtttgagatggagtggagaggaagaagagtggccctgaaggccagcaatggccgctacgtgtgcatgaagaagaatggccagctggccgccatcagtgactttgtgggcaaggatgaggagttcaccctgaagctgatcaaccggcccatcctggtgctgcggggcctggatggctttgtgtgccaccaccggggcagcaaccagctggacaccaacagatctgtgtatgatgtgttccacctgtccttcagtgatggagcctaccgcatccggggcagagatggcggcttctggtacacaggcagccacggctctgtgtgcagtgatggagagcgggcagaagattttgtgtttgagttccgggagcggggccgcctggccatccgggcccggagcggcaagtacctgcggggcggggccagcggcctgctgcgggcagatgctgatgccccagctggaacagccctgtgggagtactag

SEQ ID NO: 152096 - DNA, 2133 bp, Artificial Sequence
  Description of Artificial Sequence: Synthetic coding sequence
atgctgaccaccctgaagcccttcggctctgtgtctgtggagagcaagatgaacaacaaggccggcagcttcttctggaacctgcggcagttcagcaccctggtgtccaccagcaggaccatgaggctgtgctgcctgggcctgtgcaagcccaagatcgtgcacagcaactggaacatcctgaacaacttccacaacaggatgcagagcacagacatcatccgctacctgttccaggatgccttcatcttcaagagtgatgtgggcttccagaccaagggcatcagcaccctgacagccctgagaattgagcggctgctgtatgccaagaggctcttctttgacagcaagcagagcctggtgcctgtggacaagagtgatgatgagctgaagaaggtgaacctgaaccacgaggtgtccaatgaagatgtgctgaccaaggagaccaagcccaaccgcatcagcagcaggaagctgtctgaggagtgcaacagcctgagtgatgtgctggatgccttcagcaaggcccccaccttccccagcagcaactacttcaccgccatgtggaccatcgccaagaggctgagtgatgaccagaagagatttgagaagaggctgatgttcagccacccagccttcaaccagctgtgtgagcacatgatgagggaggccaagatcatgcagtacaagtacctgctcttcagcctgcacgccatcgtgaagctgggcatcccccagaacaccatcctggtgcagaccctgctgcgggtgacccaggagcgcatcaatgaatgtgatgagatctgcctgtctgtgctgagcacagtgctggaggccatggagccctgcaagaatgtgcacgtgctgaggacaggcttccgcatcctggtggaccagcaggtgtggaagattgaagatgtgttcaccctgcaggtggtgatgaagtgcatcggcaaggatgcccccatcgccctgaagaggaagctggagatgaaggccctgcgggagctggaccgcttctctgtgctgaacagccagcacatgtttgaggtgctggccgccatgaaccacaggagcctcatcctgctggatgaatgttccaaggtggtgctggacaacatccacggctgccccctgcgcatcatgatcaacatcctgcagagctgcaaggacctgcagtaccacaacctggacctcttcaagggcctggccgactatgtggccgccacctttgacatctggaagttcaggaaggtgctcttcatcctgatcctgtttgagaacctgggcttccggcctgtgggcctgatggacctcttcatgaagagaattgtggaggaccctgagagcctgaacatgaagaacatcctgagcatcctgcacacctacagcagcctgaaccacgtgtacaagtgccagaacaaggagcagtttgtggaggtgatggccagcgccctgaccggctacctgcacaccatcagcagcgagaacctgctggatgctgtgtacagcttctgcctgatgaactacttccccctggcccccttcaaccagctgctgcagaaggacatcatcagcgagctgctgaccagtgatgacatgaagaatgcctacaagctgcacaccctggacacctgcctgaagctggatgacacagtgtacctgcgggacatcgccctgagcctgccccagctgccccgggagctgcccagcagccacaccaatgccaaggtggccgaggtgctgagcagcctgctgggcggggagggccacttcagcaaggatgtgcacctgccccacaactaccacatcgactttgagatccgcatggacaccaacagaaaccaggtgctgcccctgagtgatgtggacaccaccagcgccacagacatccagagggtggccgtgctgtgtgtgagccgcagcgcctactgcctgggcagcagccacccccggggcttcctggccatgaagatgaggcacctgaatgccatgggcttccacgtgatcctggtgaacaactgggagatggacaagctggagatggaggatgctgtgaccttcctgaagaccaagatctacagcgtggaggccctgcctgtggccgctgtgaatgtgcagagcacccagtag

SEQ ID NO: 152097 - DNA, 2133 bp, Artificial Sequence; identical to SEQ ID NO: 152096
  Description of Artificial Sequence: Synthetic coding sequence

SEQ ID NO: 152098 - DNA, 2133 bp, Artificial Sequence; identical to SEQ ID NO: 152096
  Description of Artificial Sequence: Synthetic coding sequence

SEQ ID NO: 152099 - DNA, 375 bp, Artificial Sequence
  Description of Artificial Sequence: Synthetic coding sequence
atgctgaccaccctgaagcccttcggctctgtgtctgtggagagcaagatgaacaacaaggccggcagcttcttctggaacctgcggcagttcagcaccctggtgtccaccagcaggaccatgaggctgtgctgcctgggcctgtgcaagcccaagatcgtgcacagcaactggaacatcctgaacaacttccacaacaggatgcagagcacagacatcatccgctacctgttccaggatgccttcatcttcaagagtgatgtgggcttccagaccaagggcatcagcaccctgacagccctgagaattgagcggctgctgtatgccaagaggctcttctttgacagcaagcagagcctggtgcctgtggactag

SEQ ID NO: 152100 - DNA, 2295 bp, Artificial Sequence
  Description of Artificial Sequence: Synthetic coding sequence
atggccgccaccctgaagagcctgaagctggtgcgctaccgggccttctgcagccccagcgccttcggggctgtgcgctctgtgtcctactggaatgtgagcagcacccagcacggcggccaggaccccccagagcacatcagcctgtgccacagcgccaagaaggtgaagaacatctgcagcaccttcagcagccgccgcatcctgaccaccagcagcgcccaccctggcctggagttcagcaagaccagcagcagcaaggccagcaccctgcagctgggcagcccccgggccactggagtggatgaggaggatgtggaggtgtttgacagctttgagaacatgagggtcttcctgcagctgcggcctgagtacagagtgcacagctacaatgccagcgagaccagccagctgctgtctgtgtctgagggggagctgatcctgcacaaggtgcgggtgaaccagaacaacctgcaggcccaggtgattgtggactacctgtgcaagctgagcagcctgcctgctgagcagcaccctgtgctgctgggcagcaccagctttgccctgctgtgccagctgtctgtgaagaagatccagctgtttgacacccaggacctgatcaacgtgctgaaggcctttgtgatcctgggcatcccccacagccacagcatgctggatgtgtatgagaccaagtgctgccaccaggtgtgggagatgaacatggaccagctgctgctggtggccgacctgtggagatacctgggcaggaaggtgccccgcttcctgaacatcttcagcagctacctgaacctgcactggaaggacctgagcctgagccagctggtgcacctgatctacgtgattggagagaaccggcaggtgtcccaggacctgatgcagaagctggagagcctcatcctgaagtacatcgacctgatcaacctggaggaggtgggcaccatctgcctgggcttcttcaagagcagcaccaacctgtctgaatttgtgatgaggaagatcggggacctggcctgtgccaacatccagcacctgagcagccgcagcctggtgaacatcgtgaagatgttccgcttcacccacgtggaccacatcaacttcatgaagcagattggagagatcgccccccagaggatccccagcctgggcgtgcagggcgtgatgcacctgaccctgtactgcagcgccctgcgcttcctgaatgaaggagtgatgaatgctgtggccgccagcctgcccccccgggtggcccactgccgcagcaaggatgtggccaagatcctgtggagctttggcaccctgaactacaagcccccaaatgctgaggagttctacagcagcctcatcagcgagatccacaggaagatgcctgagttcaaccagtacccagagcacctgcccacctgcctgctgggcctggccttcctggagtacttccctgtggagctgattgactttgccctgagccctggctttgtgcggctggcccaggagaggaccaagtttgacctgctgaaggagctgtacaccctggatggcaccgtgggcatcgagtgcccagactaccggggcaaccggctgagcacccacctgcagcaggagggcagcgagctgctgtggtacctggccgagaaggacatgaacagcaagccagagttcctggagaccgtcttcctgctggagaccatgctgggcggcccccagtatgtgaagcaccacatgatcctgccccacaccaggagcagtgacctggaggtgcagctggatgtgaacctgaagcccctgcccttcaaccgggaggccaccccagcagaaaatgtggccaagctgcggctggagcacgtgggcgtgtccctgacagatgacctgatgaacaagctgctgaagggcaaggcccggggccacttccagggcaagacagagagcgagcccggccagcagcccatggagctggagaacaaggctgctgtgcccctgggcggcttcctgtgcaatgtggccgacaagagcggggccatggagatggccggcctgtgcccagctgcctgcatgcagacccccaggatgaagctggccgtgcagttcaccaacagaaaccagtactgctacggcagccgggacctgctgggcctgcacaacatgaagaggcggcagctggcccggctgggctacagagtggtggagctgagctactgggagtggctgcccctgctgaagaggacccggctggagaagctggccttcctgcacgagaaggtgttcaccagcgccctgtag

SEQ ID NO: 152101 - DNA, 183 bp, Artificial Sequence
  Description of Artificial Sequence: Synthetic coding sequence
atggcctgccagggccgggaggagtgctggtgccagagcagaattgcccggaccctgcctgctgaccagaagccagagtgccggccctactgggagaaggatgatgcctccatgcccctgccctttgacctgacagacatcgtgtctgagctgcggggccagctgctggaggccaagccctag

SEQ ID NO: 152102 - DNA, 630 bp, Artificial Sequence
  Description of Artificial Sequence: Synthetic coding sequence
atgctggatgacctgaatgccacccaccagcactgtgtgctggccggcagccagccccgcttcagcagcacccaccgggtggctgaatgttccacaggcaccctggactacatcctgcagcgctgccagctggccctgcagaatgtgtgtgatgatgtggacaatgatgatgtgtccctgaagagctttgagcctgctgtgctgaagcagggcgaggagatccacaatgaggtggagtttgagtggctgcggcagttctggttccagggcaaccgctacagaaaatgtacagactggtggtgccagcccatggcccagctggaggccctgtggaagaagatggagggcgtgaccaatgctgtgctgcacgaggtgaagcgggagggcctgcctgtggagcagagaaatgagatcctgacagccatcctggccagcctgacagcccggcagaacctgcggcgggagtggcacgcccgctgccagagccgcatcgcccggaccctgcctgctgaccagaagccagaatgtcggccctactgggagaaggatgatgcctccatgcccctgccctttgacctgacagacatcgtgtctgagctgcggggccagctgctggaggccaagccctag

SEQ ID NO: 152103 - DNA, 321 bp, Artificial Sequence
  Description of Artificial Sequence: Synthetic coding sequence
atggcccagctggaggccctgtggaagaagatggagggcgtgaccaatgctgtgctgcacgaggtgaagcgggagggcctgcctgtggagcagagaaatgagatcctgacagccatcctggccagcctgacagcccggcagaacctgcggcgggagtggcacgcccgctgccagagcagaattgcccggaccctgcctgctgaccagaagccagagtgccggccctactgggagaaggatgatgcctccatgcccctgccctttgacctgacagacatcgtgtctgagctgcggggccagctgctggaggccaagccctag

SEQ ID NO: 152104 - DNA, 321 bp, Artificial Sequence; identical to SEQ ID NO: 152103
  Description of Artificial Sequence: Synthetic coding sequence

SEQ ID NO: 152105 - DNA, 384 bp, Artificial Sequence
  Description of Artificial Sequence: Synthetic coding sequence
atggagtggaggaaggtgtctgagtgcaacagcgtggagccctgccgggaggtgaagaagtggccctaccgctgcatccaccacggcaagaacttcagcaggatgaccaatgctgtgctgcacgaggtgaagcgggagggcctgcctgtggagcagagaaatgagatcctgacagccatcctggccagcctgacagcccggcagaacctgcggcgggagtggcacgcccgctgccagagccgcatcgcccggaccctgcctgctgaccagaagccagaatgtcggccctactgggagaaggatgatgcctccatgcccctgccctttgacctgacagacatcgtgtctgagctgcggggccagctgctggaggccaagccctag

SEQ ID NO: 152106 - DNA, 1518 bp, Artificial Sequence
  Description of Artificial Sequence: Synthetic coding sequence
atgaagaggacccccacagctgaggagcgggagcgggaggccaagaagctgcggctgctggaggagctggaggacacctggctgccctacctgacccccaaggatgatgagttctaccagcagtggcagctgaagtaccccaagctgatcctgcgggaggccagctctgtgtctgaggagctgcacaaggaggtgcaggaggccttcctgaccctgcacaagcacggctgcctcttccgggacctggtgcgcatccagggcaaggacctgctgacccctgtgagccgcatcctgattggcaaccctggctgcacctacaagtacctgaacaccaggctcttcaccgtgccctggcctgtgaagggcagcaacatcaagcacacagaggccgagattgctgctgcctgtgagaccttcctgaagctgaatgactacctgcagatcgagaccatccaggccctggaggagctggccgccaaggagaaggccaatgaagatgctgtgcccctgtgcatgtctgctgacttcccccgggtgggcatgggcagcagctacaacggccaggatgaggtggacatcaagagcagagctgcctacaacgtgaccctgctgaacttcatggacccccagaagatgccctacctgaaggaggagccctacttcggcatgggcaagatggctgtgtcctggcaccatgatgagaacctggtggacagatctgctgtggccgtgtacagctacagctgtgagggccctgaggaggagagtgaagatgacagccacctggagggccgggaccctgacatctggcacgtgggcttcaagatctcctgggacatcgagaccccaggcctggccatccccctgcaccagggcgactgctacttcatgctggatgacctgaatgccacccaccagcactgtgtgctggccggcagccagccccgcttcagcagcacccaccgggtggctgaatgttccacaggcaccctggactacatcctgcagcgctgccagctggccctgcagaatgtgtgtgatgatgtggacaatgatgatgtgtccctgaagagctttgagcctgctgtgctgaagcagggcgaggagatccacaatgaggtggagtttgagtggctgcggcagttctggttccagggcaaccgctacagaaaatgtacagactggtggtgccagcccatggcccagctggaggccctgtggaagaagatggagggcgtgaccaatgctgtgctgcacgaggtgaagcgggagggcctgcctgtggagcagagaaatgagatcctgacagccatcctggccagcctgacagcccggcagaacctgcggcgggagtggcacgcccgctgccagagccgcatcgcccggaccctgcctgctgaccagaagccagaatgtcggccctactgggagaaggatgatgcctccatgcccctgccctttgacctgacagacatcgtgtctgagctgcggggccagctgctggaggccaagccctag

SEQ ID NO: 152107 - DNA, 321 bp, Artificial Sequence; identical to SEQ ID NO: 152103
  Description of Artificial Sequence: Synthetic coding sequence

SEQ ID NO: 152108 - DNA, 13050 bp, Artificial Sequence
  Description of Artificial Sequence: Synthetic coding sequence
atgaccatcgccctgctgggctttgccatcttcctgctgcactgtgccacctgtgagaagcccctggagggcatcctgagcagcagcgcctggcacttcacccacagccactacaatgccaccatctatgagaacagcagccccaagacctacgtggagagctttgagaagatgggcatctacctggccgagccccagtgggccgtgcgctaccgcatcatctctggagatgtggccaacgtgttcaagacagaggagtatgtggtgggcaacttctgcttcctgcgcatccgcaccaagagcagcaacacagccctgctgaaccgggaggtgcgggacagctacaccctcatcatccaggccacagagaagaccctggagctggaggccctgaccagggtggtggtgcacatcctggaccagaatgacctgaagcccctcttcagcccccccagctacagagtgaccatcagcgaggacatgcccctgaagagccccatctgcaaggtgacagccacagatgctgacctgggccagaatgctgagttctactatgccttcaacaccaggtctgagatgtttgccatccaccccaccagcggcgtggtgacagtggccggcaagctgaatgtgacctggaggggcaagcatgagctgcaggtgctggccgtggacaggatgaggaagatcagcgagggcaatggcttcggcagcctggccgccctggtggtgcacgtggagcccgccctgaggaagcccccagccatcgcctctgtggtggtgaccccaccagacagcaatgatggcaccacctacgccaccgtgctggtggatgccaacagcagcggggctgaggtggagagcgtggaggtggtgggcggggaccccgggaagcacttcaaggccatcaagagctatgcccggagcaatgagttcagcctggtgtctgtgaaggacatcaactggatggagtacctgcacggcttcaacctgagcctgcaggcccggagcggcagcggcccctacttctacagccagatccggggcttccacctgccccccagcaagctgagcagcctgaagtttgagaaggctgtgtacagagtgcagctgtctgagttcagccccccaggcagccgggtggtgatggtgcgggtgaccccagccttccccaacctgcagtatgtgctgaagcccagcagtgaaaatgtgggcttcaagctgaatgccaggacaggcctcatcaccaccaccaagctgatggacttccatgaccgggcccactaccagctgcacatccgcaccagccctggccaggccagcacagtggtggtgattgacatcgtggactgcaacaaccacgcccccctcttcaacagaagcagctatgatggcaccctggatgagaacatccccccaggcacctctgtgctggccgtgacagccacagaccgggaccatggagaaaatggctacgtgacctacagcattgctggccccaaggccctgcccttcagcattgacccctacctgggcatcatcagcaccagcaagcccatggactatgagctgatgaagaggatctacaccttccgggtgcgggccagtgactggggcagccccttcagaagagagaaggaggtgtccatcttcctgcagctgaggaacctgaatgacaaccagcccatgtttgaggaggtgaactgcaccggcagcatccggcaggactggcctgtgggcaagagcatcatgaccatgtctgccattgatgtggatgagctgcagaacctgaagtatgaaattgtgtctggaaatgagctggagtactttgacctgaaccacttcagcggggtcatcagcctgaagaggcccttcatcaacctgacagctggccagcccaccagctacagcctgaagatcacagccagtgatggcaagaactatgccagccccaccaccctgaacatcaccgtggtgaaggacccccactttgaggtgcctgtgacctgtgacaagacaggagtgctgacccagttcaccaagaccatcctgcacttcatcggcctgcagaaccaggagagcagtgatgaggagttcaccagcctgagcacctaccagatcaaccactacaccccccagtttgaggaccacttcccccagagcattgatgtgctggagagcgtgcccatcaacacccccctggcccggctggccgccacagatcctgatgctggcttcaacgggaagctggtgtatgtgattgctgatggaaatgaggagggctgctttgatattgagctggagaccggcctgctgactgtggccgcccccctggactatgaggccaccaacttctacatcctgaatgtgacagtgtatgacctgggcaccccccagaagagctcctggaagctgctgactgtgaatgtgaaggactggaatgacaatgccccccgcttccccccaggcggctaccagctgaccatcagcgaggacacagaggtgggcaccaccatcgccgagctgaccaccaaggatgctgacagcgaggacaatggccgggtgcgctacaccctgctgagccccacagagaagttcagcctgcaccccctgaccggggagctggtggtgacaggccacctggaccgggagagcgagccccgctacatcctgaaggtggaggcccgggaccagcccagcaagggccaccagctgttctctgtgacagacctgatcatcaccctggaggatgtgaatgacaacagcccccagtgcatcacagagcacaaccggctgaaggtgcctgaggacctgcccccaggcaccgtgctgaccttcctggatgccagtgaccctgacctgggccctgctggggaggtgcgctacgtgctgatggatggagcccacggcaccttccgggtggacctgatgaccggggccctgatcctggagcgggagctggactttgaaagaagagctggctacaacctgagcctgtgggccagtgatggcggccggcccctggcccggaggaccctgtgccacgtggaggtgattgtgctggatgtgaatgaaaacctgcaccccccccactttgccagctttgtgcaccagggccaggtgcaggagaacagccccagcggcacccaggtgattgtggtggccgcccaggatgatgattctggcctggatggagagctgcagtacttcctgcgggccggcaccggcctggccgccttcagcatcaaccaggacaccggcatgatccagaccctggcccccctggaccgggagtttgccagctactactggctgactgtgctggccgtggaccggggctctgtgcccctgagctctgtgacagaggtgtacatcgaggtgacagatgccaatgacaaccccccccagatgagccaggccgtgttctaccccagcatccaggaggatgcccctgtgggcacctctgtgctgcagctggatgcctgggaccctgacagcagcagcaagggcaagctgaccttcaacatcaccagcggcaactacatgggcttcttcatgatccaccctgtgacaggcctgctgagcacagcccagcagctggaccgggagaacaaggatgagcacatcctggaggtgacagtgctggacaatggagagcccagcctgaagagcaccagccgggtggtggtgggcatcctggatgtgaatgacaacccccccatcttcagccacaagctgttcaacgtgcggctgcctgagcggctgagccctgtgtccccaggccctgtgtaccgcctggtggccagtgacctggatgagggcctgaatggccgggtgacctacagcattgaggacagtgatgaggaggccttcagcattgacctggtgactggagtggtgagcagcagcagcaccttcaccgctggggagtacaacatcctgaccatcaaggccacagattctggccagccccccctgagcgcctctgtgcggctgcacatcgagtggatcccctggccccggcccagcagcatccccctggcctttgatgagacctactacagcttcaccgtgatggagacagatcctgtgaaccacatggtgggcgtcatctctgtggagggccggcccggcctcttctggttcaacatctctggaggagacaaggacatggactttgatattgagaagaccaccggcagcatcgtcatcgcccggcccctggacacccggcggcgcagcaactacaacctgactgtggaggtgacagatggcagcaggaccatcgccacccaggtgcacatcttcatgattgccaacatcaaccaccaccggccccagttcctggagaccaggtatgaggtgcgggtgccccaggacacagtgcctggggtggagctgctgcgggtgcaggccatcgaccaggacaagggcaagagcctcatctacaccatccacggcagccaggaccccggcagcgccagcctcttccagctggaccccagcagtggagtgctggtgacagtgggcaagctggacctgggcagcggccccagccagcacaccctgactgtgatggtgcgggaccaggagatccccatcaagaggaactttgtgtgggtgaccatccacgtggaggatggcaacctgcaccccccacgcttcacccagctgcactatgaggcctctgtgcctgacaccatcgcccctggaacagagctgctgcaggtgcgggccatggatgctgacagaggagtgaatgctgaggtgcactacagcctgctgaagggcaacagcgagggcttcttcaacatcaatgccctgctgggcatcatcaccctggcccagaagctggaccaggccaaccacgccccccacaccctgactgtgaaggccgaggaccagggcagcccccagtggcatgacctggccaccgtcatcatccacgtgtaccccagcgacagaagtgcccccatcttcagcaagtctgagtactttgtggagatccctgagagcatccctgtgggcagccccatcctgctggtgtctgccatgagccccagcgaggtgacctatgagctgcgggagggcaacaaggatggagtcttctccatgaacagctacagcggcctcatcagcacccagaagaagctggaccacgagaagatcagcagctaccagctgaagatccggggcagcaacatggccggggccttcacagatgtgatggtggtggtggacatcattgatgaaaatgacaatgcccccatgttcctgaagagcacctttgtgggccagatcagcgaggccgcccccctgtacagcatgatcatggacaagaacaacaacccctttgtgatccacgccagtgacagcgacaaggaggccaacagcctgctggtgtacaagatcctggagcctgaggccctgaagttcttcaagattgaccccagcatgggcaccctgaccatcgtgtctgagatggactatgagagcatgcccagcttccagttctgtgtgtatgtgcatgaccagggcagccctgtgctgtttgcccccaggcctgcccaggtgatcatccacgtgagagatgtgaatgacagccccccacgcttcagcgagcagatctatgaggtggccatcgtgggccccatccaccctggcatggagctgctgatggtgcgggccagtgatgaagattctgaggtgaactacagcatcaagacaggaaatgctgatgaagctgtgaccatccaccctgtgacaggcagcatctctgtgctgaacccagccttcctgggcctgagcaggaagctgaccatccgggccagtgatggcctgtaccaggacacagccctggtgaagatcagcctgacccaggtgctggacaagagcctgcagtttgaccaggatgtgtactgggccgctgtgaaggagaacctgcaggacaggaaggccctggtgatcctgggcgcccagggcaaccacctgaatgacaccctgagctacttcctgctgaatggaacagacatgttccacatggtgcagagcgctggggtgctgcagacccggggcgtggcctttgaccgggagcagcaggacacccatgagctggccgtggaggtgcgggacaacagaacaccccagagggtggcccagggcctggtgcgggtgtccattgaagatgtgaatgacaacccccccaagttcaagcacctgccctactacaccatcatccaggatggaacagagcctggagatgtgctcttccaggtgtctgccacagatgaggacctgggcaccaacggggctgtgacctatgaatttgctgaggactacacctacttcagaattgacccctacctgggggacatcagcctgaagaagccctttgactaccaggccctgaacaagtaccacctgaaggtgattgccagagatggcggcacccccagcctgcagagcgaggaggaggtgctggtgacagtgaggaacaagagcaaccccctcttccagagcccctactacaaggtgcgggtgcctgagaacatcaccctgtacacccccatcctgcacacccaggcccggagccctgagggcctgcggctcatctacaacatcgtggaggaggagcccctgatgctgttcaccacagacttcaagacaggagtgctgactgtgacaggccccctggactatgagagcaagaccaagcacgtgttcaccgtgcgggccacagacacagccctgggcagcttcagcgaggccaccgtggaggtgctggtggaggatgtgaatgacaacccccccaccttcagccagctggtgtacaccaccagcatcagcgagggcctgcctgcccagacccctgtgatccagctgctggccagtgaccaggacagcggcaggaacagagatgtgtcctaccagatcgtggaggatggcagtgatgtgtccaagttcttccagatcaatggcagcactggagagatgagcacagtgcaggagctggactatgaggcccagcagcacttccacgtgaaggtgcgggccatggacaagggggacccccccctgaccggggagaccctggtggtggtgaatgtgtctgacatcaatgacaaccccccagagttccggcagccccagtatgaggccaacgtgtctgagctggccacctgtggccacctggtgctgaaggtgcaggccatcgaccctgacagccgggacaccagccggctggagtacctgatcctgagcggcaaccaggacagacacttcttcatcaacagcagcagcggcatcatctccatgttcaacctgtgcaagaagcacctggacagcagctacaacctgcgggtgggcgccagtgatggagtcttccgggccaccgtgcctgtgtacatcaacaccaccaatgccaacaagtacagccctgagttccagcagcacctgtatgaggccgagctggccgagaatgccatggtgggcaccaaggtgattgacctgctggccatcgacaaggacagcggcccctacggcaccatcgactacaccatcatcaacaagctggccagcgagaagttcagcatcaaccccaacggccagatcgccaccctgcagaagctggaccgggagaacagcacagagcgggtgattgccatcaaggtgatggccagagatggcggcggccgggtggccttctgcaccgtgaagatcatcctgacagatgaaaatgacaaccccccccagttcaaggccagcgagtacacagtgtccatccagagcaatgtgtccaaggacagccctgtgatccaggtgctggcctatgatgctgatgagggccagaatgctgatgtgacctacagcgtgaaccctgaggacctggtgaaggatgtgattgagatcaaccctgtgactggagtggtgaaggtgaaggacagcctggtgggcctggagaaccagaccctggacttcttcatcaaggcccaggacggcggccccccccactggaacagcctggtgcctgtgcggctgcaggtggtgcccaagaaggtgtccctgcccaagttcagcgagcccctgtacaccttcagcgcccctgaggacctgcctgagggcagcgagatcggcatcgtgaaggctgtggccgcccaggaccctgtgatctacagcctggtgcggggcaccaccccagagagcaacaaggatggagtcttcagcctggaccctgacaccggggtcatcaaggtgaggaagcccatggaccacgagagcaccaagctgtaccagattgatgtgatggcccactgcctgcagaacacagatgtggtgtccctggtgtctgtgaacatccaggtgggagatgtgaatgacaacagacctgtgtttgaagctgacccctacaaggctgtgctgacagagaacatgcctgtgggcaccagcgtcatccaggtgacagccatcgacaaggacaccggcagagatggccaggtgtcctaccgcctgtctgctgaccccggcagcaatgtgcatgagctgtttgccatcgacagcgagagcggctggatcaccaccctgcaggagctggactgtgagacctgccagacctaccacttccacgtggtggcctatgaccacggccagaccatccagctgagcagccaggccctggtgcaggtgtccatcacagatgaaaatgacaatgcccccaggtttgccagcgaggagtaccggggctctgtggtggagaacagcgagcctggagagctggtggccaccctgaagaccctggatgctgacatcagcgagcagaaccggcaggtgacctgctacatcacagaaggagaccccctgggccagtttggcatcagccaggtgggagatgagtggaggatcagcagcaggaagaccctggaccgggagcacacagccaagtacctgctgcgggtgacagccagtgatggcaagttccaggcctctgtgacagtggagatctttgtgctggatgtgaatgacaacagcccccagtgcagccagctgctgtacacaggcaaggtgcatgaagatgtgtttcctggccacttcatcctgaaggtgtctgccacagacctggacacagacaccaatgcccagatcacctacagcctgcacggccctggggcccacgagttcaagctggacccccacactggagagctgaccaccctgacagccctggaccgggagaggaaggatgtgttcaacctggtggccaaggccacagatggcggcggccgcagctgccaggccgacatcaccctgcacgtggaggatgtgaatgacaatgccccccgcttcttccccagccactgtgctgtggccgtgtttgacaacaccaccgtgaagacccctgtggccgtggtgtttgcccgggaccctgaccagggcgccaatgcccaggtggtgtacagcctgcctgattctgctgagggccacttcagcattgatgccaccaccggggtcatccggctggagaagcccctgcaggtgcggccccaggcccccctggagctgactgtgcgggccagtgacctgggcacccccatccccctgagcaccctgggcaccgtgacagtgtctgtggtgggcctggaggactacctgcccgtcttcctgaacacagagcacagcgtgcaggtgcctgaagatgcccctcctggaacagaggtgctgcagctggccaccctgaccaggcctggagctgagaagacaggctacagagtggtgtctggaaatgagcagggccgcttccggctggatgccaggacaggcatcctgtatgtgaatgccagcctggactttgagaccagccccaagtacttcctgagcattgagtgcagcaggaagagcagcagcagcctgagtgatgtgaccaccgtgatggtgaacatcacagatgtgaatgagcaccggccccagttcccccaggacccctacagcaccagggtgctggagaatgccctggtgggagatgtgatcctgactgtgtctgccacagatgaagatggccccctgaacagcgacatcacctacagcctgattggaggcaaccagctgggccacttcaccatccaccccaagaagggggagctgcaggtggccaaggccctggaccgggagcaggccagcagctacagcctgaagctgcgggccacagattctggccagccccccctgcacgaggacacagacatcgccatccaggtggctgatgtgaatgacaaccccccacgcttcttccagctgaactacagcaccaccgtgcaggagaacagccccatcggcagcaaggtgctgcagctgatcctgagtgaccctgacagcccagaaaatggccccccctacagcttccgcatcaccaagggcaacaatggaagtgccttccgggtgaccccagatggctggctggtgacagctgagggcctgagcagaagagcccaggagtggtaccagctgcagatccaggccagtgacagcggcatcccccccctgagcagcctgacctctgtgcgggtgcacgtgacagagcagagccactacgcccccagcgccctgcccctggagatcttcatcaccgtgggggaggatgagttccagggcggcatggtgggcaagatccacgccacagaccgggacccccaggacaccctgacctacagcctggccgaggaggagaccctgggccgccacttctctgtgggcgccccagatggcaagatcatcgccgcccagggcctgccccggggccactacagcttcaacgtgacagtgtctgatggcaccttcaccaccacagctggggtgcacgtgtatgtgtggcacgtgggccaggaggccctgcagcaggccatgtggatgggcttctaccagctgaccccagaggagctggtgtctgaccactggaggaacctgcagcgcttcctgagccacaagctggacatcaagagggccaacatccacctggccagcctgcagcctgctgaggccgtggccggcgtggatgtgctgctggtgtttgagggccacagcggcaccttctatgagttccaggagctggccagcatcatcacccacagcgccaaggagatggagcacagcgtgggcgtgcagatgaggtctgccatgcccatggtgccctgccagggccccacctgccagggccagatctgccacaacacagtgcacctggaccccaaggtgggccccacctacagcacagcccggctgagcatcctgacccccaggcaccacctgcagaggagctgcagctgcaatggaacagccacccgcttcagcggccagagctatgtgcgctaccgggccccagctgccaggaactggcacatccacttctacctgaagaccctgcagccccaggccatcctgctcttcaccaatgaaacagcctctgtgtccctgaagctggccagcggcgtgccccagctggagtaccactgcctgggcggcttctacggcaacctgagcagccagagacatgtgaatgaccacgagtggcacagcatcctggtggaggagatggatgccagcatccggctgatggtggacagcatgggcaacaccagcctggtggtgcctgagaactgccggggcctgcggcctgagcggcacctgctgctgggcggcctcatcctgctgcacagcagcagcaatgtgtcccagggctttgagggctgcctggatgctgtggtggtgaatgaggaggccctggacctgctggcccctgggaagacagtggccggcctgctggagacccaggccctgacccagtgctgcctgcacagcgactactgcagccagaacacctgcctgaatggaggaaaatgttcctggacccacggggccggctacgtgtgcaagtgccccccccagttcagcggcaagcactgtgagcagggccgggagaactgcacctttgccccctgcctggagggcggcacctgcatcctgagccccaagggggccagctgcaactgcccccacccctacacaggagacagatgtgagatggaggcccggggctgcagcgagggccactgcctggtgaccccagagatccagagaggagactggggccagcaggagctgctgatcatcaccgtggccgtggccttcatcatcatcagcacagtgggcctgctcttctactgccgccgctgcaagagccacaagcctgtggccatggaggaccctgacctgctggcccggtctgtgggcgtggacacccaggccatgcctgccatcgagctgaaccccctgagcgccagcagctgcaacaacctgaaccagcctgagcccagcaaggcctctgtgcccaatgagctggtgaccttcggccccaacagcaagcagaggcctgtggtgtgcagcgtgcccccccggctgcccccagctgctgtgcccagccacagcgacaatgaacctgtgatcaagaggacctggagcagcgaggagatggtgtacccaggaggagccatggtgtggccacccacctacagcagaaatgaacgctgggagtacccccacagcgaggtgacccagggccccctgccccccagcgcccaccgccacagcacccctgtggtgatgcctgagcccaacggcctgtatggaggcttccccttccccctggagatggagaacaagagggcccccctgcccccacgctacagcaaccagaacctggaggacctgatgcccagccggccccccagcccccgggagcggctggtggccccctgcctgaatgagtacacagccatctcctactaccacagccagttccggcagggcggcggcggcccctgcctggctgatggcggctacaagggcgtgggcatgaggctgagcagagctggccccagctatgctgtgtgtgaggtggagggcgcccccctggccggccagggccagccccgggtgccccccaactatgagggcagtgacatggtggagagtgactatggcagctgtgaggaggtgatgttttag

SEQ ID NO: 152109 - DNA, 13770 bp, Artificial Sequence
  Description of Artificial Sequence: Synthetic coding sequence
atggacatcatcatgggccactgtgtgggcacccggcccccagcctgctgcctgatcctgctgctcttcaagctgctggccaccgtgtcccagggcctgcccggcaccggccccctgggcttccacttcacccacagcatctacaatgccaccgtgtatgagaacagcgctgcccggacctacgtgaacagccagagcaggatgggcatcaccctgattgacctgtcctgggacatcaagtacagaattgtgtctggagatgaggagggcttcttcaaggccgaggaggtgatcatcgctgacttctgcttcctgcgcatccgcaccaagggcggcaacagcgccatcctgaaccgggagatccaggacaactacctgctgattgtgaagggctctgtgcggggggaggacctggaggcctggaccaaggtgaacatccaggtgctggacatgaatgacctgcggcccctcttcagccccaccacctacagcgtgaccatcgccgagagcacccccctgcggacctctgtggcccaggtgacagccacagatgctgacatcggcagcaatggagagttctactactacttcaagaacaaggtggacctcttctctgtgcaccccaccagcggggtcatcagcctgagcggccgcctgaactatgatgagaagaacagatatgacctggagatcctggccgtggaccggggcatgaagctgtatggcaacaacggggtgagcagcacagccaagctgtatgtgcacatcgagcgcatcaatgagcacgcccccaccatccacgtggtgacccacgtgcccttcagcctggagaaggagcccacctatgctgtggtgacagtggatgacctggatgatggagccaatggagaaattgagagcgtgtccatcgtggccggggaccccctggaccagttcttcctggccaaggagggcaagtggctgaatgagtacaagatcaaggagaggaagcagattgactgggagagcttcccctacggctacaacctgaccctgcaggccaaggacaagggcagcccccagaagtgcagcgccctgaaggctgtgtacatcggcaaccccacccgggacacagtgcccatccgctttgagaaggaggtgtatgatgtgtccatcagcgagttcagccccccaggagtggtggtggccatcgtgaagctgagccctgagcccattgatgtggagtacaagctgagccctggagaagatgctgtgtacttcaagatcaaccccaggagcggcctgattgtgacagcccggcccctgaacacagtgaagaaggaggtgtacaagctggaggtgaccaacaaggagggggacctgaaggcccaggtgaccatcagcattgaagatgccaatgaccacaccccagagttccagcagcccctgtatgatgcctacgtgaatgaatctgtgcctgtgggcacctctgtgctgactgtgtctgccagtgacaaggacaagggagaaaatggctacatcacctacagcatcgccagcctgaacctgctgccctttgtgatcaaccagttcaccggggtcatcagcaccacagaggagctggactttgagagcagccctgagatctaccgcttcatcgtgcgggccagtgactggggcagcccctacagacatgagagcgaggtgaatgtgaccatcagaattggaaatgtgaatgacaacagccccctgtttgagaaggtggcctgccagggcgtcatctcctatgacttccctgtgggcggccacatcacagctgtgtctgccattgatattgatgagctggagctggtgaagtacaagatcatctctggaaatgagctgggcttcttctacctgaacccagacagcggcgtgctgcagctgaagaagagcctgaccaacagcggcatcaagaatggaaactttgccctgcgcatcacagccacagatggagagaacctggccgaccccatgagcatcaacatctctgtgctgcacggcaaggtgagcagcaagagcttcagctgccgggagaccagggtggcccagaagctggccgagaagctgctgatcaaggccaaggccaacgggaagctgaacctggaggatggcttcctggacttctacagcatcaaccggcagggcccctactttgacaagagcttccccagtgatgtggccgtgaaggaggacctgcctgtgggcgccaacatcctgaagatcaaggcctatgatgctgacagcggcttcaacgggaaggtgctcttcaccatcagtgatggcaacacagacagctgcttcaacatcgacatggagaccggccagctgaaggtgctgatgcccatggaccgggagcacacagacctgtacctgctgaacatcaccatctatgacctgggcaacccccagaagagctcctggaggctgctgaccatcaacgtggaggatgccaatgacaacagccctgtgttcatccaggacagctacagcgtgaacatcctggagagcagcggcatcggcacagagatcatccaggtggaggcccgggacaaggacctgggcagcaatggagaggtgacctacagcgtgctgacagacacccagcagtttgccatcaacagcagcactggaattgtgtatgtggccgaccagctggaccgggagagcaaggccaactacagcctgaagattgaggcccgggacaaggccgagagcggccagcagctgttctctgtggtgaccctgaaggtgttcctggatgatgtgaatgactgcagccctgccttcatccccagcagctacagcgtgaaggtgctggaggacctgcctgtgggcaccgtgattgcctggctggagacccatgaccctgacctgggcctgggcggccaggtgcgctacagcctggtgaatgactacaacggccgctttgaaattgacaaggccagcggggccatccggctgagcaaggagctggactatgagaagcagcagttctacaacctgactgtgcgggccaaggacaagggccggcctgtgtccctgagctctgtgtcctttgtggaggtggaggtggtggatgtgaatgaaaacctgcacaccccctacttcccagactttgctgtggtgggctctgtgaaggagaacagccgcatcggcacctctgtgctgcaggtgacagccagagatgaggacagcggcagagatggagagatccagtacagcatcagagatggcagcggcctgggccgcttcagcattgatgatgaaagtggagtcatcacagctgctgacatcctggaccgggagaccatgggcagctactggctgactgtgtatgccacagaccggggcgtggtgcccctgtacagcaccatcgaggtgtacatcgaggtggaggatgtgaatgacaatgcccccctgaccagcgagcccatctactaccctgtggtgatggagaacagccccaaggatgtgtctgtcatccagatccaggctgaagatcctgacagcagcagcaatgagaagctgacctaccgcatcaccagcggcaacccccagaacttctttgccatcaacatcaagacaggcctcatcaccaccaccagcaggaagctggaccgggagcagcaggccgagcacttcctggaggtgacagtgacagatggcggccccagccccaagcagagcaccatctgggtggtggtgcaggtgctggatgaaaatgacaacaagccccagtttcctgagaaggtgtaccagatcaagctgcctgagcgggacaggaagaagagaggagagcccatctaccgggcctttgcctttgacagagatgagggccccaatgctgagatctcctacagcatcgtggatggaaatgatgatggcaagttcttcatcgaccccaagacaggcatggtgagcagcaggaagcagttcaccgctggcagctatgacatcctgaccatcaaggctgtggacaatggccggccccagaagagcagcacagcccggctgcacatcgagtggatcaagaagcccccacccagccccatccccctgacctttgatgagcccttctacaacttcaccgtgatggagagtgacagagtgacagagatcgtgggcgtggtgtctgtgcagcctgccaacacccccctgtggtttgatattgtgggcggcaactttgacagcgcctttgatgctgagaagggcgtgggcaccatcgtgattgccaagcccctggatgctgagcagaggagcatctacaacatgtctgtggaggtgacagatggcaccaacgtggccgtgacccaggtgttcatcaaggtgctggacaacaatgacaatggacctgagttcagccagcccaactatgatgtgaccatcagtgaagatgtgctgcctgacacagagatcctgcagatcgaggccacagacagagatgagaagcacaagctgagctacacagtgcacagcagcattgacagcatctccatgaggaagttcagaattgaccccagcactggagtgctgtacacagctgagcggctggaccacgaggcccaggacaagcacatcctgaacatcatggtgcgggaccaggagttcccctacagaagaaacctggcccgggtgattgtgaatgtggaggatgccaatgaccacagcccctacttcaccaaccccctgtatgaggcctctgtgtttgagagcgctgccctgggcagcgctgtgctgcaggtgacagccctggacaaggacaagggagaaaatgctgagctgatctacaccattgaagctggcaacacaggcaacatgttcaagattgagcctgtgctgggcatcatcaccatctgcaaggagccagacatgaccaccatgggccagtttgtgctgagcatcaaggtgacagaccagggcagcccccccatgtctgccacagccatcgtgcgcatctctgtgaccatgtctgacaacagccaccccaagttcatccacaaggactaccaggccgaggtgaatgaaaatgtggacatcggcaccagcgtcatcctgatcagcgccatcagccagagcaccctcatctatgaggtgaaggatggagacatcaatggcatcttcaccatcaacccctacagcggggtcatcaccacccagaaggccctggactatgaaagaaccagcagctaccagctgatcatccaggccaccaacatggccggcatggccagcaatgccaccgtgaacatccagatcgtggatgaaaatgacaatgcccctgtgttcctgttcagccagtacagcggcagcctgtctgaggccgcccccatcaacagcatcgtgcgcagcctggacaacagccccctggtgatccgggccacagatgctgacagcaacagaaatgccctgctggtgtaccagatcgtggagagcacagccaagaagttcttcaccgtggacagcagcactggagccatccgcaccatcgccaacctggaccacgagaccatcgcccacttccacttccacgtgcacgtgcgggacagcggcagcccccagctgacagctgagagccctgtggaggtgaacatcgaggtgacagatgtgaatgacaacccccctgtgttcacccaggccgtgtttgagaccatcctgctgctgcccacctacgtgggcgtggaggtgctgaaggtgtctgccacagatcctgacagcgaggtgcccccagagctgacctacagcctgatggagggcagcctggaccacttcctgattgacagcaacagcggcgtgctgaccatcaagaacaacaacctgagcaaggaccactacatgctgattgtgaaggtgtctgatggcaagttctacagcacctccatggtgaccatcatggtgaaggaggccatggacagcggcctgcacttcacccagagcttctacagcaccagcatcagcgagaacaacaccaacatcaccaaggtggccatcgtgaatgctgtgggcaaccggctgaatgagcccctgaagtacagcatcctgaaccctggcaacaagttcaagatcaagagcaccagcggggtcatccagaccaccggggtgccctttgaccgggaggagcaggagctgtatgagctggtggtggaggccagccgggagctggaccacctgcgggtggcccgggtggtggtgcgggtgaacatcgaggacatcaatgacaacagccctgtgtttgtgggcctgccctactatgctgctgtgcaggtggatgctgagcccggcaccctcatctaccaggtgacagccatcgacaaggacaagggccccaacggggaggtgacctacgtgctgcaggatgattatggccactttgagatcaaccccaacagcggaaatgtcatcctgaaggaggccttcaacagcgacctgagcaacatcgagtatggagtgaccatcctggccaaggatggcggcaagcccagcctgagcacctctgtggagctgcccatcaccatcgtgaacaaggccatgcctgtgtttgacaagcccttctacacagcctctgtgaatgaagacatccgcatgaacacccccatcctgagcatcaatgccaccagccctgagggccagggcatcatctacatcatcattgatggagaccccttcaagcagttcaacatcgactttgacacaggagtgctgaaggtggtgagccccctggactatgaggtgaccagcgcctacaagctgaccatccgggccagtgatgccctgactggagcccgggcagaggtgacagtggacctgctggtgaatgatgtgaatgacaacccccccatctttgaccagcccacctacaacaccaccctgtctgaggccagcctcatcggcacccctgtgctgcaggtggtgtccattgatgctgacagcgagaacaacaagatggtgcactaccagatcgtgcaggacacctacaacagcacagactacttccacatcgacagcagcagcggcctcatcctgacagccaggatgctggaccacgagctggtgcagcactgcaccctgaaggtgcgcagcattgattctggcttccccagcctgagcagcgaggtgctggtgcacatctacatcagtgatgtgaatgacaacccccctgtgttcaaccagctgatctatgagagctatgtgtctgagctggccccccggggccactttgtgacctgtgtgcaggccagtgatgctgacagcagtgactttgaccggctggagtacagcatcctgtctggaaatgacaggaccagcttcctgatggacagcaagagcggggtcatcaccctgagcaaccacaggaagcagaggatggagcccctgtacagcctgaatgtgtctgtgtctgatggcctcttcaccagcacagcccaggtgcacatccgggtgctgggcgccaacctgtacagccctgccttcagccagagcacctacgtggccgaggtgagagaaaatgtggccgccggcaccaaggtgattcatgtgcgggccacagatggagaccccggcacctacggccagatctcctatgccatcatcaatgactttgccaaggaccgcttcctgattgacagcaatggccaggtgatcaccacagagcggctggaccgggagaaccccctggagggagatgtgtccatctttgtgcgggccctggatggcggcggccgcaccaccttctgcaccgtgcgggtgattgtggtggatgaaaatgacaatgccccccagttcatgacagtggagtaccgggcctctgtgcgggcagatgtgggccggggccacctggtgacccaggtgcaggccattgatcctgatgatggagccaacagccgcatcacctacagcctgtacagcgaggcctctgtgtctgtggccgacctgctggagattgatcctgacaatggctggatggtgaccaagggcaacttcaaccagctgaagaacacagtgctgtccttctttgtgaaggctgtggatggcggcatccctgtgaagcacagcctcatccctgtgtacatccacgtgctgcccccagagaccttcctgcccagcttcacccagagccagtacagcttcaccatcgccgaggacacagccatcggcagcacagtggacaccctgcgcatcctgcccagccagaatgtgtggttcagcacagtgaatggagagaggcctgagaacaacaagggcggcatcttcgtcatcgagcaggagaccggcaccatcaagctggacaagaggctggaccgggagaccagccctgccttccacttcaaggtggccgccaccatccccctggacaaggtggacatcgtgttcaccgtggatgtggacatcaaggtgctggacctgaatgacaacaagcctgtgtttgagaccagcagctatgacaccatcatcatggagggcatgcctgtgggcaccaagctgacccaggtgcgggccatcgacatggactggggcgccaacggccaggtgacctacagcctgcacagcgacagccagcctgagaaggtgatggaggccttcaacatcgacagcaacacaggctggatcagcaccctgaaggacctggaccatgaaacagaccccaccttcaccttctctgtggtggccagtgacctgggggaggccttcagcctgagcagcacagccctggtgtctgtgcgggtgacagacatcaatgacaatgcccctgtgtttgcccaggaggtgtacagaggaaatgtgaaggagagtgaccccccaggagaggtggtggccgtgctgagcacctgggaccgggacaccagtgatgtgaaccggcaggtgtcctaccacatcactggaggcaacccccggggccgctttgccctgggcctggtgcagagcgagtggaaggtgtatgtgaagaggcccctggaccgggaggagcaggacatctacttcctgaacatcacagccacagatggcctgtttgtgacccaggccatggtggaggtgtctgtgtctgatgtgaatgacaacagccctgtgtgtgaccaggtggcctacacagccctgctgcctgaggacatccccagcaacaagatcatcctgaaggtgtctgccaaggatgctgacatcggcagcaatggctacatccgctacagcctgtatggcagcggcaacagcgagttcttcctggaccctgagagcggggagctgaagaccctggccctgctggaccgggagcgcatccctgtgtacagcctgatggccaaggccacagatggcggcggccgcttctgccagagcaacatccacctgatcctggaggatgtgaatgacaacccccctgtgttcagcagtgaccactacaacacctgtgtgtatgagaacacagccaccaaggccctgctgaccagggtgcaggccgtggaccctgacatcggcatcaacaggaaggtggtgtacagcctggccgacagcgctgggggcgtcttcagcattgacagcagcagcggcatcatcatcctggagcagcccctggaccgggagcagcagagcagctacaacatctctgtgcgggccacagaccagagccctggccagagcctgagcagcctgaccaccgtgaccatcaccgtgctggacatcaatgacaacccccctgtgtttgagcggcgggactacctggtgacagtgcctgaggacaccagccctggcacccaggtgctggccgtgtttgccaccagcaaggacatcggcaccaatgctgagatcacctacctgatccgctctggaaatgagcagggcaagttcaagatcaaccccaagacaggaggcatctctgtgtctgaggtgctggactatgagctgtgcaagcgcttctacctggtggtggaggccaaggatggcggcaccccagccctgtctgctgtggccaccgtgaacatcaacctgacagatgtgaatgacaacccccccaagttcagccaggatgtgtacagcgctgtgatcagtgaagatgccctggtgggggacagcgtcatcctgctgattgctgaagatgtggacagccagcccaacggccagatccacttcagcatcgtgaatggagaccgggacaatgagttcaccgtggaccctgtgctgggcctggtgaaggtgaagaagaagctggaccgggagcgggtgtctggctacagcctgctggtgcaggccgtggacagcggcatcccagccatgagcagcacagccaccgtgaacatcgacatcagtgatgtgaatgacaacagccctgtgttcaccccagccaactacacagctgtgatccaggagaacaagcctgtgggcaccagcatcctgcagctggtggtgacagaccgggacagcttccacaacggcccccccttctccttcagcatcctgtctggaaatgaggaggaggagtttgtgctggacccccacggcatcctgcggtctgctgtggtgttccagcacacagagagcctggagtatgtgctgtgtgtgcaggccaaggacagcggcaagccccagcaggtgagccacacctacatccgggtgcgggtcatcgaggagagcacccacaagcccacagccatccccctggagatcttcatcgtgaccatggaggatgacttccctgggggcgtcatcggcaagatccacgccacagaccaggacatgtatgatgtgctgacctttgccctgaagtctgagcagaagagcctcttcaaggtgaacagccatgatggcaagatcatcgccctgggcggcctggacagcggcaagtatgtgctgaatgtgtctgtgtctgatggccgcttccaggtgcccattgatgtggtggtgcacgtggagcagctggtgcatgagatgctgcagaacacagtgaccatccgctttgaaaatgtgtccccagaagattttgtgggcctgcacatgcacggcttccggaggaccctgagaaatgctgtgctgacccagaagcaggacagcctgcgcatcatcagcatccagcctgtggccggcaccaaccagctggacatgctgtttgctgtggagatgcacagcagcgagttctacaagccagcctacctgatccagaagctgagcaatgcccggcggcacctggagaacatcatgaggatcagcgccatcctggagaagaactgcagcggcctggactgccaggagcagcactgtgagcagggcctgagcctggacagccacgccctgatgacctacagcacagcccgcatcagctttgtgtgcccccgcttctacagaaatgtgcgctgcacctgcaatggaggcctgtgccccggcagcaatgacccctgtgtggagaagccctgccctggggacatgcagtgtgtgtcctatgaggccagcagaagacccttcctgtgccagtgccccccaggcaagctgggagaatgttctggccacaccagcctgagctttgctggcaacagctacatcaagtaccgcctgtctgagaacagcaaggaggaggacttcaagctggccctgcggctgcggaccctgcagagcaatggcatcatcatgtacacccgggccaacccctgcatcatcctgaagatcgtggatggcaagctgtggttccagctggactgtggcagcggccctggcatcctgggcatcagcggccgggctgtgaatgatggctcctggcacagcgtcttcctggagctgaacagaaacttcaccagcctgagcctggatgacagctatgtggagaggagaagagcccccctgtacttccagaccctgagcacagagagcagcatctactttggagccctggtgcaggccgacaacatccgcagcctgacagacaccagggtgacccaggtgctgagcggcttccagggctgcctggacagcgtcatcctgaacaacaatgagctgcccctgcagaacaagaggagcagctttgctgaggtggtgggcctgacagagctgaagctgggctgtgtgctgtacccagatgcctgcaagaggagcccctgccagcacggcggcagctgcaccggcctgcccagcggcggctaccagtgcacctgcctgagccagttcaccggcaggaactgtgagagcgagatcacagcctgcttccccaacccctgcagaaatggaggcagctgtgaccccatcggcaacaccttcatctgcaactgcaaggccggcctgactggagtgacctgtgaggaggacatcaatgaatgtgagcgggaggagtgtgaaaatggaggcagctgtgtgaatgtgtttggcagcttcctgtgcaactgcaccccaggctacgtgggccagtactgcggcctgcggcctgtggtggtgcccaacatccaggccggccacagctatgtgggcaaggaggagctgattggaattgctgtggtgctgtttgtgatcttcatcctggtggtgctcttcatcgtgttcaggaagaaggtgttcaggaagaactacagcaggaacaacatcaccctggtgcaggaccctgccacagctgccctgctgaacaagagcaatggcatccccttcaggaacctgcggggcagcggagatggaagaaatgtgtaccaggaggtgggccccccccaggtgcctgtgcggcccatggcctacaccccctgcttccagagcgacagccgcagcaacctggacaagatcgtggatggcctgggcggggagcaccaggagatgaccaccttccaccctgagagcccccgcatcctgacagccaggagaggagtggtggtgtgcagcgtggcccccaacctgcctgctgtgagcccctgccgcagtgactgtgacagcatcaggaagaatggctgggatgctggaacagagaacaagggcgtggatgatcctggagaggtgacctgctttgctggcagcaacaagggcagcaacagcgaggtgcagagcctgagcagcttccagagcgacagcggagatgacaatgccagcatcgtgaccgtcatccagctggtgaacaacgtggtggacaccattgaaaatgaggtgtctgtgatggaccagggccagaactacaacagagcctaccactgggacaccagtgactggatgcctggggcccggctgagtgacatcgaggaggtgcccaactatgagaaccaggacggcggcagcgcccaccagggcagcacccgggagctggagagtgactactacctgggcggctatgacattgattctgagtacccacctcctcatgaggaggagttcctgagccaggaccagctgcccccacccctgcctgaggacttcccagaccagtatgaggccctgccccccagccagcctgtgtccctggccagcaccctgagcccagactgcagaagaagaccccagttccaccccagccagtacctgcccccccaccccttccccaatgaaacagacctggtgggccccccagccagctgtgagttcagcacctttgctgtgtccatgaaccagggcacagagcccaccggccctgctgacagcgtgtccctgagcctgcacaacagccggggcaccagcagcagtgatgtgtctgccaactgtggctttgatgacagcgaggtggccatgtctgactatgaatctgtgggggagctgagcctggccagcctgcacatcccctttgtggagacccagcaccagacccaggtgtag

SEQ ID NO: 152110 - DNA, 13674 bp, Artificial Sequence
  Description of Artificial Sequence: Synthetic coding sequence
atggacatcatcatgggccactgtgtgggcacccggcccccagcctgctgcctgatcctgctgctcttcaagctgctggccaccgtgtcccagggcctgcccggcaccggccccctgggcttccacttcacccacagcatctacaatgccaccgtgtatgagaacagcgctgcccggacctacgtgaacagccagagcaggatgggcatcaccctgattgacctgtcctgggacatcaagtacagaattgtgtctggagatgaggagggcttcttcaaggccgaggaggtgatcatcgctgacttctgcttcctgcgcatccgcaccaagggcggcaacagcgccatcctgaaccgggagatccaggacaactacctgctgattgtgaagggctctgtgcggggggaggacctggaggcctggaccaaggtgaacatccaggtgctggacatgaatgacctgcggcccctcttcagccccaccacctacagcgtgaccatcgccgagagcacccccctgcggacctctgtggcccaggtgacagccacagatgctgacatcggcagcaatggagagttctactactacttcaagaacaaggtggacctcttctctgtgcaccccaccagcggggtcatcagcctgagcggccgcctgaactatgatgagaagaacagatatgacctggagatcctggccgtggaccggggcatgaagctgtatggcaacaacggggtgagcagcacagccaagctgtatgtgcacatcgagcgcatcaatgagcacgcccccaccatccacgtggtgacccacgtgcccttcagcctggagaaggagcccacctatgctgtggtgacagtggatgacctggatgatggagccaatggagaaattgagagcgtgtccatcgtggccggggaccccctggaccagttcttcctggccaaggagggcaagtggctgaatgagtacaagatcaaggagaggaagcagattgactgggagagcttcccctacggctacaacctgaccctgcaggccaaggacaagggcagcccccagaagtgcagcgccctgaaggctgtgtacatcggcaaccccacccgggacacagtgcccatccgctttgagaaggaggtgtatgatgtgtccatcagcgagttcagccccccaggagtggtggtggccatcgtgaagctgagccctgagcccattgatgtggagtacaagctgagccctggagaagatgctgtgtacttcaagatcaaccccaggagcggcctgattgtgacagcccggcccctgaacacagtgaagaaggaggtgtacaagctggaggtgaccaacaaggagggggacctgaaggcccaggtgaccatcagcattgaagatgccaatgaccacaccccagagttccagcagcccctgtatgatgcctacgtgaatgaatctgtgcctgtgggcacctctgtgctgactgtgtctgccagtgacaaggacaagggagaaaatggctacatcacctacagcatcgccagcctgaacctgctgccctttgtgatcaaccagttcaccggggtcatcagcaccacagaggagctggactttgagagcagccctgagatctaccgcttcatcgtgcgggccagtgactggggcagcccctacagacatgagagcgaggtgaatgtgaccatcagaattggaaatgtgaatgacaacagccccctgtttgagaaggtggcctgccagggcgtcatctcctatgacttccctgtgggcggccacatcacagctgtgtctgccattgatattgatgagctggagctggtgaagtacaagatcatctctggaaatgagctgggcttcttctacctgaacccagacagcggcgtgctgcagctgaagaagagcctgaccaacagcggcatcaagaatggaaactttgccctgcgcatcacagccacagatggagagaacctggccgaccccatgagcatcaacatctctgtgctgcacggcaaggtgagcagcaagagcttcagctgccgggagaccagggtggcccagaagctggccgagaagctgctgatcaaggccaaggccaacgggaagctgaacctggaggatggcttcctggacttctacagcatcaaccggcagggcccctactttgacaagagcttccccagtgatgtggccgtgaaggaggacctgcctgtgggcgccaacatcctgaagatcaaggcctatgatgctgacagcggcttcaacgggaaggtgctcttcaccatcagtgatggcaacacagacagctgcttcaacatcgacatggagaccggccagctgaaggtgctgatgcccatggaccgggagcacacagacctgtacctgctgaacatcaccatctatgacctgggcaacccccagaagagctcctggaggctgctgaccatcaacgtggaggatgccaatgacaacagccctgtgttcatccaggacagctacagcgtgaacatcctggagagcagcggcatcggcacagagatcatccaggtggaggcccgggacaaggacctgggcagcaatggagaggtgacctacagcgtgctgacagacacccagcagtttgccatcaacagcagcactggaattgtgtatgtggccgaccagctggaccgggagagcaaggccaactacagcctgaagattgaggcccgggacaaggccgagagcggccagcagctgttctctgtggtgaccctgaaggtgttcctggatgatgtgaatgactgcagccctgccttcatccccagcagctacagcgtgaaggtgctggaggacctgcctgtgggcaccgtgattgcctggctggagacccatgaccctgacctgggcctgggcggccaggtgcgctacagcctggtgaatgactacaacggccgctttgaaattgacaaggccagcggggccatccggctgagcaaggagctggactatgagaagcagcagttctacaacctgactgtgcgggccaaggacaagggccggcctgtgtccctgagctctgtgtcctttgtggaggtggaggtggtggatgtgaatgaaaacctgcacaccccctacttcccagactttgctgtggtgggctctgtgaaggagaacagccgcatcggcacctctgtgctgcaggtgacagccagagatgaggacagcggcagagatggagagatccagtacagcatcagagatggcagcggcctgggccgcttcagcattgatgatgaaagtggagtcatcacagctgctgacatcctggaccgggagaccatgggcagctactggctgactgtgtatgccacagaccggggcgtggtgcccctgtacagcaccatcgaggtgtacatcgaggtggaggatgtgaatgacaatgcccccctgaccagcgagcccatctactaccctgtggtgatggagaacagccccaaggatgtgtctgtcatccagatccaggctgaagatcctgacagcagcagcaatgagaagctgacctaccgcatcaccagcggcaacccccagaacttctttgccatcaacatcaagacaggcctcatcaccaccaccagcaggaagctggaccgggagcagcaggccgagcacttcctggaggtgacagtgacagatggcggccccagccccaagcagagcaccatctgggtggtggtgcaggtgctggatgaaaatgacaacaagccccagtttcctgagaaggtgtaccagatcaagctgcctgagcgggacaggaagaagagaggagagcccatctaccgggcctttgcctttgacagagatgagggccccaatgctgagatctcctacagcatcgtggatggaaatgatgatggcaagttcttcatcgaccccaagacaggcatggtgagcagcaggaagcagttcaccgctggcagctatgacatcctgaccatcaaggctgtggacaatggccggccccagaagagcagcacagcccggctgcacatcgagtggatcaagaagcccccacccagccccatccccctgacctttgatgagcccttctacaacttcaccgtgatggagagtgacagagtgacagagatcgtgggcgtggtgtctgtgcagcctgccaacacccccctgtggtttgatattgtgggcggcaactttgacagcgcctttgatgctgagaagggcgtgggcaccatcgtgattgccaagcccctggatgctgagcagaggagcatctacaacatgtctgtggaggtgacagatggcaccaacgtggccgtgacccaggtgttcatcaaggtgctggacaacaatgacaatggacctgagttcagccagcccaactatgatgtgaccatcagtgaagatgtgctgcctgacacagagatcctgcagatcgaggccacagacagagatgagaagcacaagctgagctacacagtgcacagcagcattgacagcatctccatgaggaagttcagaattgaccccagcactggagtgctgtacacagctgagcggctggaccacgaggcccaggacaagcacatcctgaacatcatggtgcgggaccaggagttcccctacagaagaaacctggcccgggtgattgtgaatgtggaggatgccaatgaccacagcccctacttcaccaaccccctgtatgaggcctctgtgtttgagagcgctgccctgggcagcgctgtgctgcaggtgacagccctggacaaggacaagggagaaaatgctgagctgatctacaccattgaagctggcaacacaggcaacatgttcaagattgagcctgtgctgggcatcatcaccatctgcaaggagccagacatgaccaccatgggccagtttgtgctgagcatcaaggtgacagaccagggcagcccccccatgtctgccacagccatcgtgcgcatctctgtgaccatgtctgacaacagccaccccaagttcatccacaaggactaccaggccgaggtgaatgaaaatgtggacatcggcaccagcgtcatcctgatcagcgccatcagccagagcaccctcatctatgaggtgaaggatggagacatcaatggcatcttcaccatcaacccctacagcggggtcatcaccacccagaaggccctggactatgaaagaaccagcagctaccagctgatcatccaggccaccaacatggccggcatggccagcaatgccaccgtgaacatccagatcgtggatgaaaatgacaatgcccctgtgttcctgttcagccagtacagcggcagcctgtctgaggccgcccccatcaacagcatcgtgcgcagcctggacaacagccccctggtgatccgggccacagatgctgacagcaacagaaatgccctgctggtgtaccagatcgtggagagcacagccaagaagttcttcaccgtggacagcagcactggagccatccgcaccatcgccaacctggaccacgagaccatcgcccacttccacttccacgtgcacgtgcgggacagcggcagcccccagctgacagctgagagccctgtggaggtgaacatcgaggtgacagatgtgaatgacaacccccctgtgttcacccaggccgtgtttgagaccatcctgctgctgcccacctacgtgggcgtggaggtgctgaaggtgtctgccacagatcctgacagcgaggtgcccccagagctgacctacagcctgatggagggcagcctggaccacttcctgattgacagcaacagcggcgtgctgaccatcaagaacaacaacctgagcaaggaccactacatgctgattgtgaaggtgtctgatggcaagttctacagcacctccatggtgaccatcatggtgaaggaggccatggacagcggcctgcacttcacccagagcttctacagcaccagcatcagcgagaacaacaccaacatcaccaaggtggccatcgtgaatgctgtgggcaaccggctgaatgagcccctgaagtacagcatcctgaaccctggcaacaagttcaagatcaagagcaccagcggggtcatccagaccaccggggtgccctttgaccgggaggagcaggagctgtatgagctggtggtggaggccagccgggagctggaccacctgcgggtggcccgggtggtggtgcgggtgaacatcgaggacatcaatgacaacagccctgtgtttgtgggcctgccctactatgctgctgtgcaggtggatgctgagcccggcaccctcatctaccaggtgacagccatcgacaaggacaagggccccaacggggaggtgacctacgtgctgcaggatgattatggccactttgagatcaaccccaacagcggaaatgtcatcctgaaggaggccttcaacagcgacctgagcaacatcgagtatggagtgaccatcctggccaaggatggcggcaagcccagcctgagcacctctgtggagctgcccatcaccatcgtgaacaaggccatgcctgtgtttgacaagcccttctacacagcctctgtgaatgaagacatccgcatgaacacccccatcctgagcatcaatgccaccagccctgagggccagggcatcatctacatcatcattgatggagaccccttcaagcagttcaacatcgactttgacacaggagtgctgaaggtggtgagccccctggactatgaggtgaccagcgcctacaagctgaccatccgggccagtgatgccctgactggagcccgggcagaggtgacagtggacctgctggtgaatgatgtgaatgacaacccccccatctttgaccagcccacctacaacaccaccctgtctgaggccagcctcatcggcacccctgtgctgcaggtggtgtccattgatgctgacagcgagaacaacaagatggtgcactaccagatcgtgcaggacacctacaacagcacagactacttccacatcgacagcagcagcggcctcatcctgacagccaggatgctggaccacgagctggtgcagcactgcaccctgaaggtgcgcagcattgattctggcttccccagcctgagcagcgaggtgctggtgcacatctacatcagtgatgtgaatgacaacccccctgtgttcaaccagctgatctatgagagctatgtgtctgagctggccccccggggccactttgtgacctgtgtgcaggccagtgatgctgacagcagtgactttgaccggctggagtacagcatcctgtctggaaatgacaggaccagcttcctgatggacagcaagagcggggtcatcaccctgagcaaccacaggaagcagaggatggagcccctgtacagcctgaatgtgtctgtgtctgatggcctcttcaccagcacagcccaggtgcacatccgggtgctgggcgccaacctgtacagccctgccttcagccagagcacctacgtggccgaggtgagagaaaatgtggccgccggcaccaaggtgattcatgtgcgggccacagatggagaccccggcacctacggccagatctcctatgccatcatcaatgactttgccaaggaccgcttcctgattgacagcaatggccaggtgatcaccacagagcggctggaccgggagaaccccctggagggagatgtgtccatctttgtgcgggccctggatggcggcggccgcaccaccttctgcaccgtgcgggtgattgtggtggatgaaaatgacaatgccccccagttcatgacagtggagtaccgggcctctgtgcgggcagatgtgggccggggccacctggtgacccaggtgcaggccattgatcctgatgatggagccaacagccgcatcacctacagcctgtacagcgaggcctctgtgtctgtggccgacctgctggagattgatcctgacaatggctggatggtgaccaagggcaacttcaaccagctgaagaacacagtgctgtccttctttgtgaaggctgtggatggcggcatccctgtgaagcacagcctcatccctgtgtacatccacgtgctgcccccagagaccttcctgcccagcttcacccagagccagtacagcttcaccatcgccgaggacacagccatcggcagcacagtggacaccctgcgcatcctgcccagccagaatgtgtggttcagcacagtgaatggagagaggcctgagaacaacaagggcggcatcttcgtcatcgagcaggagaccggcaccatcaagctggacaagaggctggaccgggagaccagccctgccttccacttcaaggtggccgccaccatccccctggacaaggtggacatcgtgttcaccgtggatgtggacatcaaggtgctggacctgaatgacaacaagcctgtgtttgagaccagcagctatgacaccatcatcatggagggcatgcctgtgggcaccaagctgacccaggtgcgggccatcgacatggactggggcgccaacggccaggtgacctacagcctgcacagcgacagccagcctgagaaggtgatggaggccttcaacatcgacagcaacacaggctggatcagcaccctgaaggacctggaccatgaaacagaccccaccttcaccttctctgtggtggccagtgacctgggggaggccttcagcctgagcagcacagccctggtgtctgtgcgggtgacagacatcaatgacaatgcccctgtgtttgcccaggaggtgtacagaggaaatgtgaaggagagtgaccccccaggagaggtggtggccgtgctgagcacctgggaccgggacaccagtgatgtgaaccggcaggtgtcctaccacatcactggaggcaacccccggggccgctttgccctgggcctggtgcagagcgagtggaaggtgtatgtgaagaggcccctggaccgggaggagcaggacatctacttcctgaacatcacagccacagatggcctgtttgtgacccaggccatggtggaggtgtctgtgtctgatgtgaatgacaacagccctgtgtgtgaccaggtggcctacacagccctgctgcctgaggacatccccagcaacaagatcatcctgaaggtgtctgccaaggatgctgacatcggcagcaatggctacatccgctacagcctgtatggcagcggcaacagcgagttcttcctggaccctgagagcggggagctgaagaccctggccctgctggaccgggagcgcatccctgtgtacagcctgatggccaaggccacagatggcggcggccgcttctgccagagcaacatccacctgatcctggaggatgtgaatgacaacccccctgtgttcagcagtgaccactacaacacctgtgtgtatgagaacacagccaccaaggccctgctgaccagggtgcaggccgtggaccctgacatcggcatcaacaggaaggtggtgtacagcctggccgacagcgctgggggcgtcttcagcattgacagcagcagcggcatcatcatcctggagcagcccctggaccgggagcagcagagcagctacaacatctctgtgcgggccacagaccagagccctggccagagcctgagcagcctgaccaccgtgaccatcaccgtgctggacatcaatgacaacccccctgtgtttgagcggcgggactacctggtgacagtgcctgaggacaccagccctggcacccaggtgctggccgtgtttgccaccagcaaggacatcggcaccaatgctgagatcacctacctgatccgctctggaaatgagcagggcaagttcaagatcaaccccaagacaggaggcatctctgtgtctgaggtgctggactatgagctgtgcaagcgcttctacctggtggtggaggccaaggatggcggcaccccagccctgtctgctgtggccaccgtgaacatcaacctgacagatgtgaatgacaacccccccaagttcagccaggatgtgtacagcgctgtgatcagtgaagatgccctggtgggggacagcgtcatcctgctgattgctgaagatgtggacagccagcccaacggccagatccacttcagcatcgtgaatggagaccgggacaatgagttcaccgtggaccctgtgctgggcctggtgaaggtgaagaagaagctggaccgggagcgggtgtctggctacagcctgctggtgcaggccgtggacagcggcatcccagccatgagcagcacagccaccgtgaacatcgacatcagtgatgtgaatgacaacagccctgtgttcaccccagccaactacacagctgtgatccaggagaacaagcctgtgggcaccagcatcctgcagctggtggtgacagaccgggacagcttccacaacggcccccccttctccttcagcatcctgtctggaaatgaggaggaggagtttgtgctggacccccacggcatcctgcggtctgctgtggtgttccagcacacagagagcctggagtatgtgctgtgtgtgcaggccaaggacagcggcaagccccagcaggtgagccacacctacatccgggtgcgggtcatcgaggagagcacccacaagcccacagccatccccctggagatcttcatcgtgaccatggaggatgacttccctgggggcgtcatcggcaagatccacgccacagaccaggacatgtatgatgtgctgacctttgccctgaagtctgagcagaagagcctcttcaaggtgaacagccatgatggcaagatcatcgccctgggcggcctggacagcggcaagtatgtgctgaatgtgtctgtgtctgatggccgcttccaggtgcccattgatgtggtggtgcacgtggagcagctggtgcatgagatgctgcagaacacagtgaccatccgctttgaaaatgtgtccccagaagattttgtgggcctgcacatgcacggcttccggaggaccctgagaaatgctgtgctgacccagaagcaggacagcctgcgcatcatcagcatccagcctgtggccggcaccaaccagctggacatgctgtttgctgtggagatgcacagcagcgagttctacaagccagcctacctgatccagaagctgagcaatgcccggcggcacctggagaacatcatgaggatcagcgccatcctggagaagaactgcagcggcctggactgccaggagcagcactgtgagcagggcctgagcctggacagccacgccctgatgacctacagcacagcccgcatcagctttgtgtgcccccgcttctacagaaatgtgcgctgcacctgcaatggaggcctgtgccccggcagcaatgacccctgtgtggagaagccctgccctggggacatgcagtgtgtgtcctatgaggccagcagaagacccttcctgtgccagtgccccccaggcaagctgggagaatgttctggccacaccagcctgagctttgctggcaacagctacatcaagtaccgcctgtctgagaacagcaaggaggaggacttcaagctggccctgcggctgcggaccctgcagagcaatggcatcatcatgtacacccgggccaacccctgcatcatcctgaagatcgtggatggcaagctgtggttccagctggactgtggcagcggccctggcatcctgggcatcagcggccgggctgtgaatgatggctcctggcacagcgtcttcctggagctgaacagaaacttcaccagcctgagcctggatgacagctatgtggagaggagaagagcccccctgtacttccagaccctgagcacagagagcagcatctactttggagccctggtgcaggccgacaacatccgcagcctgacagacaccagggtgacccaggtgctgagcggcttccagggctgcctggacagcgtcatcctgaacaacaatgagctgcccctgcagaacaagaggagcagctttgctgaggtggtgggcctgacagagctgaagctgggctgtgtgctgtacccagatgcctgcaagaggagcccctgccagcacggcggcagctgcaccggcctgcccagcggcggctaccagtgcacctgcctgagccagttcaccggcaggaactgtgagagcgagatcacagcctgcttccccaacccctgcagaaatggaggcagctgtgaccccatcggcaacaccttcatctgcaactgcaaggccggcctgactggagtgacctgtgaggaggacatcaatgaatgtgagcgggaggagtgtgaaaatggaggcagctgtgtgaatgtgtttggcagcttcctgtgcaactgcaccccaggctacgtgggccagtactgcggcctgcggcctgtggtggtgcccaacatccaggccggccacagctatgtgggcaaggaggagctgattggaattgctgtggtgctgtttgtgatcttcatcctggtggtgctcttcatcgtgttcaggaagaaggtgttcaggaagaactacagcaggaacaacatcaccctggtgcaggaccctgccacagctgccctgctgaacaagagcaatggcatccccttcaggaacctgcggggcagcggagatggaagaaatgtgtaccaggaggtgggccccccccaggtgcctgtgcggcccatggcctacaccccctgcttccagagcgacagccgcagcaacctggacaagatcgtggatggcctgggcggggagcaccaggagatgaccaccttccaccctgagagcccccgcatcctgacagccaggagaggagtggtggtgtgcagcgtggcccccaacctgcctgctgtgagcccctgccgcagtgactgtgacagcatcaggaagaatggctgggatgctggaacagagaacaagggcgtggatgatcctggagaggtgacctgctttgctggcagcaacaagggcagcaacagcgaggtgcagagcctgagcagcttccagagcgacagcggagatgacaatgcctaccactgggacaccagtgactggatgcctggggcccggctgagtgacatcgaggaggtgcccaactatgagaaccaggacggcggcagcgcccaccagggcagcacccgggagctggagagtgactactacctgggcggctatgacattgattctgagtacccacctcctcatgaggaggagttcctgagccaggaccagctgcccccacccctgcctgaggacttcccagaccagtatgaggccctgccccccagccagcctgtgtccctggccagcaccctgagcccagactgcagaagaagaccccagttccaccccagccagtacctgcccccccaccccttccccaatgaaacagacctggtgggccccccagccagctgtgagttcagcacctttgctgtgtccatgaaccagggcacagagcccaccggccctgctgacagcgtgtccctgagcctgcacaacagccggggcaccagcagcagtgatgtgtctgccaactgtggctttgatgacagcgaggtggccatgtctgactatgaatctgtgggggagctgagcctggccagcctgcacatcccctttgtggagacccagcaccagacccaggtgtag

SEQ ID NO: 152111 - DNA, 3765 bp, Artificial Sequence
  Description of Artificial Sequence: Synthetic coding sequence
atggacatcatcatgggccactgtgtgggcacccggcccccagcctgctgcctgatcctgctgctcttcaagctgctggccaccgtgtcccagggcctgcccggcaccggccccctgggcttccacttcacccacagcatctacaatgccaccgtgtatgagaacagcgctgcccggacctacgtgaacagccagagcaggatgggcatcaccctgattgacctgtcctgggacatcaagtacagaattgtgtctggagatgaggagggcttcttcaaggccgaggaggtgatcatcgctgacttctgcttcctgcgcatccgcaccaagggcggcaacagcgccatcctgaaccgggagatccaggacaactacctgctgattgtgaagggctctgtgcggggggaggacctggaggcctggaccaaggtgaacatccaggtgctggacatgaatgacctgcggcccctcttcagccccaccacctacagcgtgaccatcgccgagagcacccccctgcggacctctgtggcccaggtgacagccacagatgctgacatcggcagcaatggagagttctactactacttcaagaacaaggtggacctcttctctgtgcaccccaccagcggggtcatcagcctgagcggccgcctgaactatgatgagaagaacagatatgacctggagatcctggccgtggaccggggcatgaagctgtatggcaacaacggggtgagcagcacagccaagctgtatgtgcacatcgagcgcatcaatgagcacgcccccaccatccacgtggtgacccacgtgcccttcagcctggagaaggagcccacctatgctgtggtgacagtggatgacctggatgatggagccaatggagaaattgagagcgtgtccatcgtggccggggaccccctggaccagttcttcctggccaaggagggcaagtggctgaatgagtacaagatcaaggagaggaagcagattgactgggagagcttcccctacggctacaacctgaccctgcaggccaaggacaagggcagcccccagaagtgcagcgccctgaaggctgtgtacatcggcaaccccacccgggacacagtgcccatccgctttgagaaggaggtgtatgatgtgtccatcagcgagttcagccccccaggagtggtggtggccatcgtgaagctgagccctgagcccattgatgtggagtacaagctgagccctggagaagatgctgtgtacttcaagatcaaccccaggagcggcctgattgtgacagcccggcccctgaacacagtgaagaaggaggtgtacaagctggaggtgaccaacaaggagggggacctgaaggcccaggtgaccatcagcattgaagatgccaatgaccacaccccagagttccagcagcccctgtatgatgcctacgtgaatgaatctgtgcctgtgggcacctctgtgctgactgtgtctgccagtgacaaggacaagggagaaaatggctacatcacctacagcatcgccagcctgaacctgctgccctttgtgatcaaccagttcaccggggtcatcagcaccacagaggagctggactttgagagcagccctgagatctaccgcttcatcgtgcgggccagtgactggggcagcccctacagacatgagagcgaggtgaatgtgaccatcagaattggaaatgtgaatgacaacagccccctgtttgagaaggtggcctgccagggcgtcatctcctatgacttccctgtgggcggccacatcacagctgtgtctgccattgatattgatgagctggagctggtgaagtacaagatcatctctggaaatgagctgggcttcttctacctgaacccagacagcggcgtgctgcagctgaagaagagcctgaccaacagcggcatcaagaatggaaactttgccctgcgcatcacagccacagatggagagaacctggccgaccccatgagcatcaacatctctgtgctgcacggcaaggtgagcagcaagagcttcagctgccgggagaccagggtggcccagaagctggccgagaagctgctgatcaaggccaaggccaacgggaagctgaacctggaggatggcttcctggacttctacagcatcaaccggcagggcccctactttgacaagagcttccccagtgatgtggccgtgaaggaggacctgcctgtgggcgccaacatcctgaagatcaaggcctatgatgctgacagcggcttcaacgggaaggtgctcttcaccatcagtgatggcaacacagacagctgcttcaacatcgacatggagaccggccagctgaaggtgctgatgcccatggaccgggagcacacagacctgtacctgctgaacatcaccatctatgacctgggcaacccccagaagagctcctggaggctgctgaccatcaacgtggaggatgccaatgacaacagccctgtgttcatccaggacagctacagcgtgaacatcctggagagcagcggcatcggcacagagatcatccaggtggaggcccgggacaaggacctgggcagcaatggagaggtgacctacagcgtgctgacagacacccagcagtttgccatcaacagcagcactggaattgtgtatgtggccgaccagctggaccgggagagcaaggccaactacagcctgaagattgaggcccgggacaaggccgagagcggccagcagctgttctctgtggtgaccctgaaggtgttcctggatgatgtgaatgactgcagccctgccttcatccccagcagctacagcgtgaaggtgctggaggacctgcctgtgggcaccgtgattgcctggctggagacccatgaccctgacctgggcctgggcggccaggtgcgctacagcctggtgaatgactacaacggccgctttgaaattgacaaggccagcggggccatccggctgagcaaggagctggactatgagaagcagcagttctacaacctgactgtgcgggccaaggacaagggccggcctgtgtccctgagctctgtgtcctttgtggaggtggaggtggtggatgtgaatgaaaacctgcacaccccctacttcccagactttgctgtggtgggctctgtgaaggagaacagccgcatcggcacctctgtgctgcaggtgacagccagagatgaggacagcggcagagatggagagatccagtacagcatcagagatggcagcggcctgggccgcttcagcattgatgatgaaagtggagtcatcacagctgctgacatcctggaccgggagaccatgggcagctactggctgactgtgtatgccacagaccggggcgtggtgcccctgtacagcaccatcgaggtgtacatcgaggtggaggatgtgaatgacaatgcccccctgaccagcgagcccatctactaccctgtggtgatggagaacagccccaaggatgtgtctgtcatccagatccaggctgaagatcctgacagcagcagcaatgagaagctgacctaccgcatcaccagcggcaacccccagaacttctttgccatcaacatcaagacaggcagctgcagcgtggcccaggccggcatgcagtggcatgaccacagcagcctgcagagcaggaccccaggcttcaagggctacccctgcctgagcctgctgagctcctgggactacagacatgccccaccctgcccagccaccttcctgaacagctag

SEQ ID NO: 152112 - DNA, 9669 bp, Artificial Sequence
  Description of Artificial Sequence: Synthetic coding sequence
atggtgaccaccgtggtggccgtgggggacaccctggcccagcccctggccgctgctgaggtgttcatcgtggagatcaccctgcaggacatcaatgacaacccccctgtgttccccacagacatgctggacctgactgtggaggagaacattggagatggcagcaagatcatgcagctgacagccatggatgctgatgagggcgccaatgccctggtgacctacaccatcatctctggagcagatgacagcttcagaattgatcctgagagcggggacctgattgccacccggcggctggaccgggagcggcgcagcaagtacagcctgctggtgcgggcagatgatggcctgcagagcagtgacatgaggatcaacatcaccgtgtctgatgtgaatgaccacacccccaagttcagcaggcctgtgtacagctttgacatccctgaggacaccatccctggcagcctggtggccgccatcctggccacagatgatgacagcggcgtgaatggagagatcacctacatcgtgaatgaagatgatgaagatggcatcttcttcctgaaccccatcactggagtcttcaacctgacccggctgctggactatgaggtgcagcagtactacatcctgactgtgcgggcagaagatggcggcggccagttcaccaccatccgggtgtacttcaacatcctggatgtgaatgacaacccccccatcttcagcctgaacagctacagcaccagcctgatggagaacctgcctgtgggcagcacagtgctggtgttcaacgtgacagatgctgatgatggcatcaacagccagctgacctacagcatcgccagcggggacagcctgggccagttcaccgtggacaagaatggagtgctgaaggtgctgaaggccctggaccgggagagccagagcttctacaacctggtggtgcaggtgcatgacctgccccagatcccagccagccgcttcaccagcacagcccaggtgtccatcatcctgctggatgtgaatgacaacccccccaccttcctgagccccaagctgacctacatccctgagaacacccccatcgacacagtggtgttcaaggcccaggccacagatcctgattctggccccaacagctacatcgagtacaccctgctgaaccccctgggcaacaagttcagcatcggcaccattgatggagaggtgcggctgactggagagctggaccgggaggaggtgagcaactacaccctgactgtggtggccacagacaagggccagcccagcctgagcagcagcacagaggtggtggtgatggtgctggacatcaatgacaacaaccccatctttgcccaggccctgtacaaggtggagatcaatgaaaacaccctgactggaacagacatcatccaggtgtttgctgctgatggagatgagggcaccaacggccaggtgcgctatggaattgtgaatggaaacaccaaccaggagttcagaattgacagcgtgactggagccatcaccgtggccaagcccctggaccgggagaagacccccacctaccacctgactgtgcaggccacagaccggggcagcacccccaggacagacaccagcacagtgtccatcgtgctgctggacatcaatgactttgtgcctgtgtttgagctgagcccctacagcgtgaatgtgcctgagaacctgggcaccctgcccaggaccatcctgcaggtggtggccagagatgatgaccggggcagcaacagcaagctgtcctatgtgctgtttggaggaaatgaagataatgccttcaccctgagcgccagcggggagctgggcgtgacccagagcctggaccgggagaccaaggagagatttgtgctgatgatcacagccacagattctggcagccctgccctgactggaacaggcaccatcaacgtgattgtggatgatgtgaatgacaacgtgcccacctttgccagcaaggcctacttcaccaccatcccagaagatgcccccactggaacagatgtgctgctggtgaatgccagtgatgctgatgccagcaagaatgctgtgatccgcatcatcggcggcaacagccagttcaccatcaaccccagcacaggccagatcatcaccagcgccctgctggaccgggagaccaaggacaactacaccctggtggtggtgtgcagtgatgctggcagccctgagcccctgagcagcagcacctctgtgctggtgacagtgacagatgtgaatgacaaccccccacgcttccagcaccacccctacgtgacccacatccccagccccaccctgcccggcagctttgtgtttgctgtgacagtgacagatgctgacatcggccccaacagcgagctgcactacagcctgagcggcaggaacagcgagaagttccacatcgaccccctgcggggggccatcatggctgctggccccctgaatggagccagcgaggtgaccttctctgtgcacgtgaaggatggcggcagcttccccaagacagacagcaccaccgtgacagtgcgctttgtgaacaaggctgacttccccaaggtgcgggccaaggagcagaccttcatgtttcctgagaaccagcctgtgagcagcctggtgaccaccatcaccggcagcagcctgcggggggagcccatgagctactacatcgccagcggcaacctgggcaacaccttccagattgaccagctgaccggccaggtgtccatcagccagcccctggactttgagaagatccagaagtatgtggtgtggattgaggccagagatggcggcttcccccccttcagcagctatgagaagctggacatcaccgtgctggatgtgaatgacaatgcccccatcttcaaggaggaccccttcatcagcgagatcctggagaacctgagccccaggaagatcctgactgtgtctgccatggacaaggacagcggccccaacggccagctggactatgaaattgtgaatggaaacatggagaacagcttcagcatcaaccacgccaccggggagatccgctctgtgcggcccctggaccgggagaaggtgagccactacgtgctgaccatcaagagcagtgacaagggcagccccagccagagcacctctgtgaaggtgatgatcaacatcctggatgaaaatgacaatgccccccgcttcagccagatcttcagcgcccacgtgcctgagaacagccccctgggctacacagtgaccagggtgaccaccagtgatgaagatattggcatcaatgccatcagccgctacagcatcatggatgccagcctgcccttcaccatcaaccccagcactggagacatcgtcatcagccggcccctgaaccgggaggacacagaccgctaccgcatccgggtgtctgcccatgacagcggctggacagtgtccacagatgtgaccatctttgtgacagacatcaatgacaatgccccccgcttcagcaggaccagctactacctggactgcccagagctgacagaaattggcagcaaggtgacccaggtgtttgccacagatcctgatgagggcagcaatggccaggtgttctacttcatcaagagccagagcgagtacttccgcatcaatgccaccaccggggagatcttcaacaagcagatcctgaagtaccagaatgtgacaggcttcagcaatgtgaacatcaacagacacagcttcatcgtgaccagcagtgaccggggcaagcccagcctcatcagcgagaccaccgtgaccatcaacatcgtggacagcaatgacaatgccccccagttcctgaagagcaagtacttcacccctgtgaccaagaatgtgaaggtgggcaccaagctgatccgggtgacagccattgatgacaaggactttggcctgaacagcgaggtggagtacttcatcagcaatgacaaccacctgggcaagttcaagctggacaatgacaccggctggatctctgtggccagcagcctcatcagtgacctgaaccagaacttcttcatcaccgtgacagccaaggacaagggcaacccccccctgagcagccaggccaccgtgcacatcaccgtgacagaggagaactaccacaccccagagttcagccagagccacatgtctgccaccatccctgagagccacagcatcggcagcatcgtgaggacagtgtctgcccgggacagagatgctgccatgaatggcctcatcaagtacagcatcagcagtggaaatgaggagggcatctttgccatcaacagcagcacaggcatcctgaccctggccaaggccctggactatgagctgtgccagaagcatgagatgaccatcagcgccattgatggcggctgggtggccaggacaggctactgcagcgtgacagtgaatgtgattgatgtgaatgacaacagccctgtgttcctgagtgatgactacttccccaccgtgctggagaatgcccccagcggcaccaccgtcatccacctgaatgccacagatgctgacagcggcaccaatgctgtgattgcctacacagtgcagagcagtgacagcgacctgtttgtgattgaccccaacacaggagtcatcaccacccagggcttcctggactttgagaccaagcagagctaccacctgactgtgaaggccttcaacgtgcctgatgaggagcgctgcagctttgccaccgtgaacatccagctgaagggcaccaatgaatatgtgcccaggtttgtgtccaagctgtactactttgagatcagcgaggccgcccccaagggcaccatcgtgggggaggtgtttgccagtgaccgggacctgggcacagatggagaggtgcactacctgatcttcggcaacagcaggaagaagggcttccagatcaacaagaagacaggccagatctacgtgtctggcatcctggaccgggagaaggaggagcgggtgtccctgaaggtgctggccaagaactttggcagcatcagaggagctgacattgatgaggtgacagtgaatgtgacagtgctggatgccaatgacccccccatcttcaccctgaacatctacagcgtgcagatcagcgagggcgtgcccatcggcacccacgtgacctttgtgtctgcctttgacagcgacagcatccccagctggagccgcttctcctacttcatcggcagcggaaatgaaaatggagccttcagcatcaacccccagacaggccagatcaccgtgacagctgagctggaccgggagaccctgcccatctacaacctgtctgtgctggccgtggacagcggcaccccatctgccactggaagtgccagcctgctggtgaccctggaggacatcaatgacaatggccccatgctgactgtgtctgagggggaggtgatggagaacaagaggcctggcaccctggtgatgaccctgcagagcacagatcctgacctgccccccaaccagggccccttcacctactacctgctgagcactggacctgccaccagctacttcagcctgagcacagctggggtgctgagcaccacccgggagattgaccgggagcagattgctgacttctacctgtctgtggtgaccaaggacagcggcgtgccccagatgagcagcactggaacagtgcacatcaccgtgattgaccagaatgacaaccccagccagagcaggacagtggagatctttgtgaactactacggcaacctcttccctgggggcatcctgggctctgtgaagccccaggaccctgatgtgctggacagcttccactgcagcctgaccagcggcgtgaccagcctcttcagcatccctgggggcacctgtgacctgaacagccagcccaggagcacagatggcacctttgacctgactgtgctgagcaatgatggagtgcacagcacagtgaccagcaacatccgggtcttctttgctggcttcagcaatgccaccgtggacaacagcatcctgctgcggctgggcgtgcccaccgtgaaggacttcctgaccaaccactacctgcacttcctgcgcatcgccagcagccagctgaccggcctgggcacagctgtgcagctgtacagcgcctatgaggagaacaacagaaccttcctgctggccgctgtgaagaggaaccacaaccagtatgtgaaccccagcggcgtggccaccttctttgagagcatcaaggagatcctgctgcggcagagcggcgtgaaggtggagagcgtggaccatgacagctgtgtgcacggcccctgccagaatggaggcagctgcctgcggcggctggccgtgtcctctgtgctgaagagccgggagagcctgcccgtcatcatcgtggccaatgagcccctgcagcccttcctgtgcaagtgcctgcccggctacgccggctcctggtgtgaaattgatattgatgaatgtctgcccagcccctgccacagcggcggcacctgccacaacctggtgggcggcttcagctgcagctgcccagatggcttcaccggccgggcctgtgagcgggacatcaatgaatgtctgcagagcccctgcaagaatggagccatctgccagaacttccctggcagcttcaactgtgtgtgcaagacaggctacacaggagtgtttgggaagcactgtgagctgaacagctatggctttgaggagctgagctacatggagttccccagcctggaccccaacaacaactacatctacgtgaagtttgccaccatcaagagccacgccctgctgctgtacaactatgacaaccagacaggagacagagctgagttcctggccctggagattgctgaggagcggctgcgcttctcctacaacctgggcagcggcacctacaagctgaccaccatgaagaaggtgtctgatggccacttccacacagtcatcgcccggcgggccggcatggccgccagcctgactgtggacagctgcagcgagaaccaggagcccggctactgcaccgtgtccaatgtggccgtgtctgatgactggaccctggatgtgcagcccaacagagtgacagtgggcggcatccgcagcctggagcccatcctgcagaggcggggccacgtggagagccatgactttgtgggctgcatcatggagtttgctgtgaatggccggcccctggagcccagccaggccctggccgcccagggcatcctggaccagtacggggacttcatctcctactgcttcaaggagaagaagtgcaagaaggtgtgcttcaccgtgaccccagacacagccctgagcctggagggcaagggccgcctggactaccacatgagccagaatgagaagcgggagtacctgctgcggcagagcctgcggggggccatgctggagcccttcggcgtgaacagcctggaggtgaagttccgcaccaggagtgaaaatggagtgctgatccacatccaggagagcagcaactacaccaccgtgaagatcaagaatggcaaggtgtacttcaccagtgatgctggcattgctgggaaggtggagaggaacatccctgaggtgtatgtggctgatggccactggcacaccttcctgattggcaagaatggaacagccaccgtgctgtctgtggaccgcatctacaacagagacatcatccaccccacccaggactttggaggcctggatgtgctgaccatcagcctgggcggcatcccccccaaccaggcccacagagatgcccagacagctggctttgatggctgcatcgcctccatgtggtacggcggggagagcctgcccttcagcggcaagcacagcctggccagcatcagcaagacagaccccagcgtgaagattggctgccggggccccaacatctgtgccagcaacccctgctggggagacctgctgtgcatcaaccagtggtacgcctaccgctgtgtgcccccaggggactgtgccagccacccctgccagaatggaggcagctgtgagcccggcctgcacagcggcttcacctgcagctgcccagacagccacactggaagaacctgtgagatggtggtggcctgcctgggcgtgctgtgcccccagggcaaggtgtgcaaggccggcagccctgctggccacgtgtgtgtgctgagccagggccctgaggagatcagcctgcccctgtgggccgtgcctgccatcgtgggcagctgtgccaccgtgctggccctgctggtgctgagcctcatcctgtgcaaccagtgccggggcaagaaggccaagaaccccaaggaggagaagaagcccaaggagaagaagaagaagggctctgaaaatgtggcctttgatgatcctgacaacatccccccctatggagatgacatgacagtgaggaagcagcctgagggcaaccccaagccagacatcatcgagcgggagaacccctacctgatctatgatgaaacagacatcccccacaacagcgagaccatccccagcgcccccctggccagccctgagcaggagattgagcactatgacatcgacaatgccagcagcatcgcccccagtgatgctgacatcatccagcactacaagcagttccgcagccacacccccaagttcagcatccagaggcacagccccctgggctttgcccggcagagccccatgcccctgggcgccagcagcctgacctaccagcccagctatggccagggcctgcggaccagcagcctgagccacagcgcctgccccacccccaaccccctgagccgccacagccctgcccccttcagcaagagcagcaccttctacagaaacagccctgcccgggagctgcacctgcccatcagagatggcaacaccctggagatgcatggagacacctgccagcccggcatcttcaactatgccacccggctgggccgccgcagcaagagcccccaggccatggccagccacggcagcaggcctggcagccggctgaagcagcccatcggccagatccccctggagagcagcccccctgtgggcctgagcattgaggaggtggagcggctgaacaccccccggcccaggaaccccagcatctgcagcgctgaccacggccgcagcagcagcgaggaggactgcagaagacccctgagcaggaccaggaacccagcagatggcatcccagcccctgagagcagcagtgacagcgacagccatgagagcttcacctgcagcgagatggagtatgaccgggagaagcccatggtgtacaccagcaggatgcccaagctgagccaggtgaatgaaagtgatgctgatgatgaggacaactatggagcccggctgaagccccggcgctaccatggaagaagagctgagggcggccctgtgggcacccaggccgccgcccctggaacagctgacaacaccctgcccatgaagctgggccagcaggccggcaccttcaactgggacaacctgctgaactggggccctggcttcggccactacgtggatgtgttcaaggacctggccagcctgcctgagaaggctgctgccaatgaggagggcaaggccggcaccaccaagcctgtgcccaaggatggagaggccgagcagtatgtgtag

SEQ ID NO: 152113 - DNA, 14946 bp, Artificial Sequence
  Description of Artificial Sequence: Synthetic coding sequence
atggacctggccccagaccgggccaccggccggccctggctgcccctgcacaccctgtctgtgtcccagctgctgcgggtcttctggctgctgagcctgctgcccggccaggcctgggtgcatggagctgagccccggcaggtgttccaggtgctggaggagcagcccccaggcaccctggtgggcaccatccagacccggcccggcttcacctaccgcctgtctgagagccacgccctgtttgccatcaacagcagcactggagccctgtacaccaccagcaccatcgaccgggagagcctgcccagtgatgtgatcaacctggtggtgctgagcagcgcccccacctaccccacagaggtgcgggtgctggtgcgggacctgaatgacaatgcccctgtgtttcctgaccccagcatcgtggtgaccttcaaggaggacagcagcagcggccggcaggtgatcctggacacagccacagacagcgacatcggcagcaatggagtggaccacaggagctaccgcatcatcagaggaaatgaggccggccgcttccggctggacatcaccctgaaccccagcggggagggcgccttcctgcacctggtgtccaaaggaggcctggaccgggaggtgaccccccagtaccagctgctggtggaggtggaggacaagggggagcccaagaggcggggctacctgcaggtgaatgtgacagtgcaggacatcaatgacaacccccctgtgtttggcagcagccactaccaggccggcgtgcctgaagatgctgtggtgggcagctctgtgctgcaggtggccgctgctgatgctgatgagggcaccaatgctgacatccgctaccgcctgcaggatgagggcacccccttccagatggaccctgagaccggcctcatcaccgtgcgggagcccctggactttgaggcccggcggcagtacagcctgactgtgcaggccatggacagaggagtgcccagcctgaccggccgggcagaggccctgatccagctgctggatgtgaatgacaatgaccctgtggtgaagttccgctacttccctgccaccagccgctatgcctctgtggatgaaaatgcccaggtgggcaccgtggtggccctgctgactgtgacagatgctgacagccctgctgccaatggaaacatctctgtgcagatcctgggcggcaatgagcagaggcactttgaggtgcagagcagcaaggtgcccaacctgagcctcatcaaggtggccagcgccctggaccgggagcgcatccccagctacaacctgactgtgtctgtgtctgacaactacggggcccctcctggagctgctgtgcaggcccggagctctgtggccagcctggtgatctttgtgaatgacatcaatgaccacccccctgtgttcagccagcaggtgtacagagtgaacctgtctgaggaggcccctcctggcagctatgtgtctggcatcagcgccacagatggagacagcggcctgaatgccaacctgcgctacagcatcgtgtctggaaatggcctgggctggttccacatcagcgagcacagcggcctggtgaccaccggcagcagcggcggcctggaccgggagctggccagccagatcgtgctgaacatcagcgcccgggaccagggcgtgcaccccaaggtgtcctatgcccagctggtggtgaccctgctggatgtgaatgatgagaagcctgtgttcagccagcctgagggctatgatgtgtctgtggtggagaatgcccccaccggcacagagctgctgatgctgcgggccacagatggagacctgggggacaatggaacagtgcgcttcagcctgcaggaggccgagacagacagaagaagcttccggctggaccctgtgtctggccgcctgagcaccatcagcagcctggaccgggaggagcaggccttctacagcctgctggtgctggccacagacctgggcagccccccccagagctccatggcccgcatcaacgtgtccctgctggacatcaatgacaacagccctgtgttctaccctgtgcagtactttgcccacatcaaggaaaatgaacctgggggcagctacatcaccaccgtgtctgccacagatcctgacctgggcaccaatggaacagtgaagtacagcatctctgctggggacaggagccgcttccaggtgaatgcccagagcggggtcatcagcaccaggatggccctggaccgggaggagaagacagcctaccagctgcagatcgtggccacagatggcggcaacctgcagagccccaaccaggccatcgtgaccatcaccgtgctggacacccaggacaacccccctgtgttcagccaggtggcctacagctttgtggtgtttgaaaatgtggccctgggctaccacgtgggctctgtgtctgccagcaccatggacctgaacagcaacatctcctacctgatcaccaccggggaccagaagggcatgtttgccatcaaccaggtgacaggccagctgaccacagccaacgtcatcgaccgggaggagcagagcttctaccagctgaaggtggtggccagcggcggcaccgtgactggagacaccatggtgaacatcaccgtgaaggacctgaatgacaacagcccccacttcctgcaggccattgaatctgtgaatgtggtggagaactggcaggccggccacagcatcttccaggccaaggctgtggaccctgatgaaggagtgaatggcatggtgctgtacagcctgaagcagaaccccaagaacctgtttgccatcaatgagaagaatggcaccatcagcctgctgggccccctggatgtgcatgctggcagctaccagatcgagatcctggccagtgacatgggcgtgccccagctgagcagcagcgtcatcctgactgtgtatgtgcatgatgtgaatgacaacagccctgtgtttgaccagctgtcctatgaggtgaccctgtctgagagcgagcctgtgaacagccgcttcttcaaggtgcaggccagtgacaaggacagcggggccaacggggagatcgcctacaccatcgccgagggcaacacaggagatgccttcggcatcttcccagatggccagctgtacatcaagtctgagctggaccgggagctgcaggaccgctacgtgctgatggtggtggccagtgacagagctgtggagcccctgagcgccaccgtgaatgtgaccgtcatcctggaggatgtgaatgacaaccggcccctcttcaacagcaccaactacaccttctactttgaggaggagcagagagctggcagctttgtgggcaaggtgtctgctgtggacaaggactttggccccaacggggaggtgcgctacagctttgagatggtgcagcctgactttgagctgcacgccatcagcggggagatcaccaacacccaccagtttgaccgggagagcctgatgagaagaagaggaacagctgtgttctccttcaccgtcatcgccacagaccagggcatcccccagcccctgaaggaccaggccaccgtgcacgtgtacatgaaggacatcaatgacaatgcccccaagttcctgaaggacttctaccaggccaccatcagcgagagcgctgccaacctgacccaggtgctgcgggtgtctgccagtgatgtggatgagggcaacaacggcctcatccactacagcatcatcaagggaaatgaggagcggcagtttgccatcgacagcaccagcggccaggtgaccctcatcggcaagctggactatgaggccaccccagcctacagcctggtgatccaggccgtggacagcggcaccatccccctgaacagcacctgcaccctgaacatcgacatcctggatgaaaatgacaacacccccagcttccccaagagcaccctgtttgtggatgtgctggagaacatgagaattggagagctggtgtcctctgtgacagccacagacagcgacagcggggacaatgctgacctgtactacagcatcaccggcaccaacaaccacggcaccttcagcatcagccccaacacaggcagcatcttcctggccaagaagctggactttgagacccagagcctgtacaagctgaacatcacagccaaggaccagggccggccccccaggagcagcaccatgtctgtggtgattcatgtgcgggacttcaatgacaaccccccatccttccccccaggggacatcttcaagagcatcgtggagaacatccccatcggcaccagcgtcatctctgtgacagcccatgaccctgatgctgacatcaatggccagctgagctacaccatcatccagcagatgccccggggcaaccacttcaccattgatgaggtgaagggcaccatctacaccaatgctgagattgaccgggagtttgccaacctgtttgagctgactgtgaaggccaatgaccaggccgtgcccatcgagacccggcgctatgccctgaagaatgtgaccatcctggtgacagacctgaatgacaacgtgcccatgttcatcagccagaatgccctggccgctgaccccagcgctgtgattggctctgtgctgaccaccatcatggctgctgaccctgatgagggcgccaacggggagattgaatatgagatcatcaatggagacacagacaccttcatcgtggaccgctacagcggggacctgcgggtggccagcgccctggtgcccagccagctgatctacaacctgattgtgtctgccacagacctgggccctgagaggaggaagagcaccacagagctgaccatcatcctgcagggcctggatggccctgtgttcacccagcccaagtacatcaccatcctgaaggagggggagcccatcggcaccaacgtcatcagcattgaagctgccagcccccggggcagcgaggcccctgtggagtactacatcgtgtctgtgcgctgtgaggagaagacagtgggccgcctcttcaccatcggccgccacacaggcatcatccagacagctgccatcctggaccgggagcagggcgcctgcctgtacctggtggatgtgtatgccatcgagaagagcacagccttccccaggacccagagagctgaggtggagatcaccctgcaggacatcaatgacaacccccctgtgttccccacagacatgctggacctgactgtggaggagaacattggagatggcagcaagatcatgcagctgacagccatggatgctgatgagggcgccaatgccctggtgacctacaccatcatctctggagcagatgacagcttcagaattgatcctgagagcggggacctgattgccacccggcggctggaccgggagcggcgcagcaagtacagcctgctggtgcgggcagatgatggcctgcagagcagtgacatgaggatcaacatcaccgtgtctgatgtgaatgaccacacccccaagttcagcaggcctgtgtacagctttgacatccctgaggacaccatccctggcagcctggtggccgccatcctggccacagatgatgacagcggcgtgaatggagagatcacctacatcgtgaatgaagatgatgaagatggcatcttcttcctgaaccccatcactggagtcttcaacctgacccggctgctggactatgaggtgcagcagtactacatcctgactgtgcgggcagaagatggcggcggccagttcaccaccatccgggtgtacttcaacatcctggatgtgaatgacaacccccccatcttcagcctgaacagctacagcaccagcctgatggagaacctgcctgtgggcagcacagtgctggtgttcaacgtgacagatgctgatgatggcatcaacagccagctgacctacagcatcgccagcggggacagcctgggccagttcaccgtggacaagaatggagtgctgaaggtgctgaaggccctggaccgggagagccagagcttctacaacctggtggtgcaggtgcatgacctgccccagatcccagccagccgcttcaccagcacagcccaggtgtccatcatcctgctggatgtgaatgacaacccccccaccttcctgagccccaagctgacctacatccctgagaacacccccatcgacacagtggtgttcaaggcccaggccacagatcctgattctggccccaacagctacatcgagtacaccctgctgaaccccctgggcaacaagttcagcatcggcaccattgatggagaggtgcggctgactggagagctggaccgggaggaggtgagcaactacaccctgactgtggtggccacagacaagggccagcccagcctgagcagcagcacagaggtggtggtgatggtgctggacatcaatgacaacaaccccatctttgcccaggccctgtacaaggtggagatcaatgaaaacaccctgactggaacagacatcatccaggtgtttgctgctgatggagatgagggcaccaacggccaggtgcgctatggaattgtgaatggaaacaccaaccaggagttcagaattgacagcgtgactggagccatcaccgtggccaagcccctggaccgggagaagacccccacctaccacctgactgtgcaggccacagaccggggcagcacccccaggacagacaccagcacagtgtccatcgtgctgctggacatcaatgactttgtgcctgtgtttgagctgagcccctacagcgtgaatgtgcctgagaacctgggcaccctgcccaggaccatcctgcaggtggtggccagagatgatgaccggggcagcaacagcaagctgtcctatgtgctgtttggaggaaatgaagataatgccttcaccctgagcgccagcggggagctgggcgtgacccagagcctggaccgggagaccaaggagagatttgtgctgatgatcacagccacagattctggcagccctgccctgactggaacaggcaccatcaacgtgattgtggatgatgtgaatgacaacgtgcccacctttgccagcaaggcctacttcaccaccatcccagaagatgcccccactggaacagatgtgctgctggtgaatgccagtgatgctgatgccagcaagaatgctgtgatccgcatcatcggcggcaacagccagttcaccatcaaccccagcacaggccagatcatcaccagcgccctgctggaccgggagaccaaggacaactacaccctggtggtggtgtgcagtgatgctggcagccctgagcccctgagcagcagcacctctgtgctggtgacagtgacagatgtgaatgacaaccccccacgcttccagcaccacccctacgtgacccacatccccagccccaccctgcccggcagctttgtgtttgctgtgacagtgacagatgctgacatcggccccaacagcgagctgcactacagcctgagcggcaggaacagcgagaagttccacatcgaccccctgcggggggccatcatggctgctggccccctgaatggagccagcgaggtgaccttctctgtgcacgtgaaggatggcggcagcttccccaagacagacagcaccaccgtgacagtgcgctttgtgaacaaggctgacttccccaaggtgcgggccaaggagcagaccttcatgtttcctgagaaccagcctgtgagcagcctggtgaccaccatcaccggcagcagcctgcggggggagcccatgagctactacatcgccagcggcaacctgggcaacaccttccagattgaccagctgaccggccaggtgtccatcagccagcccctggactttgagaagatccagaagtatgtggtgtggattgaggccagagatggcggcttcccccccttcagcagctatgagaagctggacatcaccgtgctggatgtgaatgacaatgcccccatcttcaaggaggaccccttcatcagcgagatcctggagaacctgagccccaggaagatcctgactgtgtctgccatggacaaggacagcggccccaacggccagctggactatgaaattgtgaatggaaacatggagaacagcttcagcatcaaccacgccaccggggagatccgctctgtgcggcccctggaccgggagaaggtgagccactacgtgctgaccatcaagagcagtgacaagggcagccccagccagagcacctctgtgaaggtgatgatcaacatcctggatgaaaatgacaatgccccccgcttcagccagatcttcagcgcccacgtgcctgagaacagccccctgggctacacagtgaccagggtgaccaccagtgatgaagatattggcatcaatgccatcagccgctacagcatcatggatgccagcctgcccttcaccatcaaccccagcactggagacatcgtcatcagccggcccctgaaccgggaggacacagaccgctaccgcatccgggtgtctgcccatgacagcggctggacagtgtccacagatgtgaccatctttgtgacagacatcaatgacaatgccccccgcttcagcaggaccagctactacctggactgcccagagctgacagaaattggcagcaaggtgacccaggtgtttgccacagatcctgatgagggcagcaatggccaggtgttctacttcatcaagagccagagcgagtacttccgcatcaatgccaccaccggggagatcttcaacaagcagatcctgaagtaccagaatgtgacaggcttcagcaatgtgaacatcaacagacacagcttcatcgtgaccagcagtgaccggggcaagcccagcctcatcagcgagaccaccgtgaccatcaacatcgtggacagcaatgacaatgccccccagttcctgaagagcaagtacttcacccctgtgaccaagaatgtgaaggtgggcaccaagctgatccgggtgacagccattgatgacaaggactttggcctgaacagcgaggtggagtacttcatcagcaatgacaaccacctgggcaagttcaagctggacaatgacaccggctggatctctgtggccagcagcctcatcagtgacctgaaccagaacttcttcatcaccgtgacagccaaggacaagggcaacccccccctgagcagccaggccaccgtgcacatcaccgtgacagaggagaactaccacaccccagagttcagccagagccacatgtctgccaccatccctgagagccacagcatcggcagcatcgtgaggacagtgtctgcccgggacagagatgctgccatgaatggcctcatcaagtacagcatcagcagtggaaatgaggagggcatctttgccatcaacagcagcacaggcatcctgaccctggccaaggccctggactatgagctgtgccagaagcatgagatgaccatcagcgccattgatggcggctgggtggccaggacaggctactgcagcgtgacagtgaatgtgattgatgtgaatgacaacagccctgtgttcctgagtgatgactacttccccaccgtgctggagaatgcccccagcggcaccaccgtcatccacctgaatgccacagatgctgacagcggcaccaatgctgtgattgcctacacagtgcagagcagtgacagcgacctgtttgtgattgaccccaacacaggagtcatcaccacccagggcttcctggactttgagaccaagcagagctaccacctgactgtgaaggccttcaacgtgcctgatgaggagcgctgcagctttgccaccgtgaacatccagctgaagggcaccaatgaatatgtgcccaggtttgtgtccaagctgtactactttgagatcagcgaggccgcccccaagggcaccatcgtgggggaggtgtttgccagtgaccgggacctgggcacagatggagaggtgcactacctgatcttcggcaacagcaggaagaagggcttccagatcaacaagaagacaggccagatctacgtgtctggcatcctggaccgggagaaggaggagcgggtgtccctgaaggtgctggccaagaactttggcagcatcagaggagctgacattgatgaggtgacagtgaatgtgacagtgctggatgccaatgacccccccatcttcaccctgaacatctacagcgtgcagatcagcgagggcgtgcccatcggcacccacgtgacctttgtgtctgcctttgacagcgacagcatccccagctggagccgcttctcctacttcatcggcagcggaaatgaaaatggagccttcagcatcaacccccagacaggccagatcaccgtgacagctgagctggaccgggagaccctgcccatctacaacctgtctgtgctggccgtggacagcggcaccccatctgccactggaagtgccagcctgctggtgaccctggaggacatcaatgacaatggccccatgctgactgtgtctgagggggaggtgatggagaacaagaggcctggcaccctggtgatgaccctgcagagcacagatcctgacctgccccccaaccagggccccttcacctactacctgctgagcactggacctgccaccagctacttcagcctgagcacagctggggtgctgagcaccacccgggagattgaccgggagcagattgctgacttctacctgtctgtggtgaccaaggacagcggcgtgccccagatgagcagcactggaacagtgcacatcaccgtgattgaccagaatgacaaccccagccagagcaggacagtggagatctttgtgaactactacggcaacctcttccctgggggcatcctgggctctgtgaagccccaggaccctgatgtgctggacagcttccactgcagcctgaccagcggcgtgaccagcctcttcagcatccctgggggcacctgtgacctgaacagccagcccaggagcacagatggcacctttgacctgactgtgctgagcaatgatggagtgcacagcacagtgaccagcaacatccgggtcttctttgctggcttcagcaatgccaccgtggacaacagcatcctgctgcggctgggcgtgcccaccgtgaaggacttcctgaccaaccactacctgcacttcctgcgcatcgccagcagccagctgaccggcctgggcacagctgtgcagctgtacagcgcctatgaggagaacaacagaaccttcctgctggccgctgtgaagaggaaccacaaccagtatgtgaaccccagcggcgtggccaccttctttgagagcatcaaggagatcctgctgcggcagagcggcgtgaaggtggagagcgtggaccatgacagctgtgtgcacggcccctgccagaatggaggcagctgcctgcggcggctggccgtgtcctctgtgctgaagagccgggagagcctgcccgtcatcatcgtggccaatgagcccctgcagcccttcctgtgcaagtgcctgcccggctacgccggctcctggtgtgaaattgatattgatgaatgtctgcccagcccctgccacagcggcggcacctgccacaacctggtgggcggcttcagctgcagctgcccagatggcttcaccggccgggcctgtgagcgggacatcaatgaatgtctgcagagcccctgcaagaatggagccatctgccagaacttccctggcagcttcaactgtgtgtgcaagacaggctacacaggcaagatgtgtgagagctctgtgaactactgtgagtgcaacccctgcttcaatggaggcagctgccagagcggcgtggacagctactactgccactgccccttcggcgtgtttgggaagcactgtgagctgaacagctatggctttgaggagctgagctacatggagttccccagcctggaccccaacaacaactacatctacgtgaagtttgccaccatcaagagccacgccctgctgctgtacaactatgacaaccagacaggagacagagctgagttcctggccctggagattgctgaggagcggctgcgcttctcctacaacctgggcagcggcacctacaagctgaccaccatgaagaaggtgtctgatggccacttccacacagtgattgccaggagagctggcatggccgccagcctgactgtggacagctgcagcgagaaccaggagcccggctactgcaccgtgtccaatgtggccgtgtctgatgactggaccctggatgtgcagcccaacagagtgacagtgggcggcatccgcagcctggagcccatcctgcagaggcggggccacgtggagagccatgactttgtgggctgcatcatggagtttgctgtgaatggccggcccctggagcccagccaggccctggccgcccagggcatcctggaccagtgcccccggctggagggcgcctgcaccaggagcccctgccagcacggcggcacctgcatggactactggagctggcagcagtgccactgcaaggagggcctgaccgggaagtactgtgagaagtctgtgaccccagacacagccctgagcctggagggcaagggccgcctggactaccacatgagccagaatgagaagcgggagtacctgctgcggcagagcctgcggggggccatgctggagccctttggagtgaacagcctggaggtgaagttccgcaccaggagtgaaaatggagtgctgatccacatccaggagagcagcaactacaccaccgtgaagatcaagaatggcaaggtgtacttcaccagtgatgctggcattgctgggaaggtggagaggaacatccctgaggtgtatgtggctgatggccactggcacaccttcctgattggcaagaatggaacagccaccgtgctgtctgtggaccgcatctacaacagagacatcatccaccccacccaggactttggaggcctggatgtgctgaccatcagcctgggcggcatcccccccaaccaggcccacagagatgcccagacagctggctttgatggctgcatcgcctccatgtggtatggaggagagagcctgcccttcagcggcaagcacagcctggccagcatcagcaagacagaccccagcgtgaagattggctgccggggccccaacatctgtgccagcaacccctgctggggagacctgctgtgcatcaaccagtggtacgcctaccgctgtgtgcccccaggggactgtgccagccacccctgccagaatggaggcagctgtgagcccggcctgcacagcggcttcacctgcagctgcccagacagccacacaggccgcacctgtgagatggtggtggcctgcctgggcgtgctgtgcccccagggcaaggtgtgcaaggccggcagccctgctggccacgtgtgtgtgctgagccagggccctgaggagatcagcctgcccctgtgggccgtgcctgccatcgtgggcagctgtgccaccgtgctggccctgctggtgctgagcctcatcctgtgcaaccagtgccggggcaagaaggccaagaaccccaaggaggagaagaagcccaaggagaagaagaagaagggctctgaaaatgtggcctttgatgatcctgacaacatccccccctatggagatgacatgacagtgaggaagcagcctgagggcaaccccaagccagacatcatcgagcgggagaacccctacctgatctatgatgaaacagacatcccccacaacagcgagaccatccccagcgcccccctggccagccctgagcaggagattgagcactatgacatcgacaatgccagcagcatcgcccccagtgatgctgacatcatccagcactacaagcagttccgcagccacacccccaagttcagcatccagaggcacagccccctgggctttgcccggcagagccccatgcccctgggcgccagcagcctgacctaccagcccagctatggccagggcctgcggaccagcagcctgagccacagcgcctgccccacccccaaccccctgagccgccacagccctgcccccttcagcaagagcagcaccttctacagaaacagccctgcccgggagctgcacctgcccatcagagatggcaacaccctggagatgcacggggacacctgccagcccggcatcttcaactatgccacccggctgggcagaagaagcaagagcccccaggccatggccagccacggcagccggcccggcagccggctgaagcagcccatcggccagatccccctggagagcagcccccctgtgggcctgagcattgaggaggtggagcggctgaacaccccccggcccaggaaccccagcatctgcagcgctgaccacggccgcagcagcagcgaggaggactgccggcggcccctgagcaggaccagaaatccagcagatggcatcccagcccctgagagcagcagtgacagcgacagccatgagagcttcacctgcagcgagatggagtatgaccgggagaagcccatggtgtacaccagcaggatgcccaagctgagccaggtgaatgaaagtgatgctgatgatgaggacaactacggggcccggctgaagccccggcgctaccacggccggcgggcagagggcggccctgtgggcacccaggccgccgcccctggaacagctgacaacaccctgcccatgaagctgggccagcaggccggcaccttcaactgggacaacctgctgaactggggccctggcttcggccactacgtggatgtgttcaaggacctggccagcctgcctgagaaggccgccgccaatgaggagggcaaggccggcaccaccaagcctgtgcccaaggatggagaggccgagcagtatgtgtag

SEQ ID NO: 152114 - DNA, 1239 bp, Artificial Sequence
  Description of Artificial Sequence: Synthetic coding sequence
atgggcctgcacctgcggccctacagagtgggcctgctgcctgatggcctgctcttcctgctgctgctgctgatgctgctggccgaccctgccctgcctgctggccgccacccccctgtggtgctggtgcctggggacctgggcaaccagctggaggccaagctggacaagcccaccgtggtgcactacctgtgcagcaagaagacagagagctacttcaccatctggctgaacctggagctgctgctgcccgtcatcatcgactgctggattgacaacatccggctggtgtacaacaagaccagccgggccacccagttcccagatggagtggatgtgcgggtgcccggctttgggaagaccttcagcctggagttcctggaccccagcaagagctctgtgggcagctacttccacaccatggtggagagcctggtgggctggggctacaccagaggagaagatgtgcggggggccccctatgactggaggcgggccccaaatgaaaatggcccctacttcctggccctgcgggagatgattgaggagatgtaccagctgtatggaggccctgtggtgctggtggcccacagcatgggcaacatgtacaccctgtacttcctgcagaggcagccccaggcctggaaggacaagtacatccgggcctttgtgtccctgggcgccccctggggcggcgtggccaagaccctgcgggtgctggccagcggggacaacaaccgcatccctgtgattggccccctgaagatccgggagcagcagaggtctgctgtgtccacctcctggctgctgccctacaactacacctggagccctgagaaggtgtttgtgcagacccccaccatcaactacaccctgcgggactacaggaagttcttccaggacatcggctttgaagatggctggctgatgaggcaggacacagagggcctggtggaggccaccatgcctcctggggtgcagctgcactgcctgtatggcaccggggtgcccaccccagacagcttctactatgagagcttcccagaccgggaccccaagatctgctttggagatggagatggcaccgtgaacctgaagagcgccctgcagtgccaggcctggcagagccggcaggagcaccaggtgctgctgcaggagctgcccggcagcgagcacatcgagatgctggccaatgccaccaccctggcctacctgaagagggtgctgctgggcccctag

SEQ ID NO: 152115 - DNA, 480 bp, Artificial Sequence
  Description of Artificial Sequence: Synthetic coding sequence
atgtttcctggcctcttcatgctgggcaccttcctgtggagcctcatcgagtacctgatccaccgcttcctgttccacatgaagcccccaagtgacagctactacctgatcatgctgcactttgtgatgcacggccagcaccacaaggccccctttgatggcagccggctggtgttcccccctgtgcctgccagcctggtgattggagtcttctacctgtgcatgcagctgatcctgcctgaggccgtgggcggcaccgtgtttgctgggggcctgctgggctacgtgctgtatgacatgacccactactacctgcacttcggcagcccccacaagggcagctacctgtacagcctgaaggcccaccacgtgaagcaccactttgcccaccagaagagcggcttcggcatcagcaccaagctgtgggactactgcttccacaccctgaccccagagaagccccacctgaagacccagtag

SEQ ID NO: 152116 - DNA, 1740 bp, Artificial Sequence
  Description of Artificial Sequence: Synthetic coding sequence
atggtgcagtatgagctgtgggccgccctgcccggggccagcggcgtggccctggcctgctgctttgtggccgctgctgtggccctgcgctggagcggccgcaggacagcccggggagctgtggtgcgggcccggcagaggcagagagctggcctggagaacatggaccgggccgcccagcgcttccggctgcagaacccagacctggacagcgaggccctgctggccctgcccctgccccagctggtgcagaagctgcacagccgggagctggcccctgaggccgtgctcttcacctacgtgggcaaggcctgggaggtgaacaagggcaccaactgtgtgaccagctacctggccgactgtgagacccagctgagccaggccccccggcagggcctgctgtatggagtgcctgtgtccctgaaggagtgcttcacctacaagggccaggacagcaccctgggcctgagcctgaatgaaggagtgcctgcagaatgtgacagcgtggtggtgcacgtgctgaagctgcagggcgctgtgccctttgtgcacaccaacgtgccccagagcatgttctcctatgactgcagcaaccccctgtttggccagacagtgaacccctggaagagcagcaagagccctgggggcagcagcggcggggagggcgccctgattggcagcggcggcagccccctgggcctgggcacagacatcggcggcagcatccgcttccccagcagcttctgtggcatctgtggcctgaagcccactggaaaccggctgagcaagagcggcctgaagggctgtgtgtatggccaggaggccgtgcggctgtctgtgggccccatggccagagatgtggagagcctggccctgtgcctgcgggccctgctgtgtgaggacatgttccggctggaccccaccgtgccccccctgcccttccgggaggaggtgtacaccagcagccagcccctgcgggtgggctactatgaaacagacaactacaccatgcccagccctgccatgagaagagctgtgctggagaccaagcagagcctggaggccgccggccacaccctggtgcccttcctgcccagcaacatcccccacgccctggagaccctgagcactggaggcctcttcagtgatggcggccacaccttcctgcagaacttcaagggggactttgtggacccctgcctgggggacctggtgtccatcctgaagctgccccagtggctgaagggcctgctggccttcctggtgaagcccctgctgccccggctgagcgccttcctgagcaacatgaagagccgctctgctgggaagctgtgggagctgcagcatgaaattgaggtgtacaggaagacagtgattgcccagtggagggccctggacctggatgtggtgctgacccccatgctggccccagccctggacctgaatgcccctggccgggccaccggggctgtgtcctacaccatgctgtacaactgcctggacttccctgctggggtggtgcctgtgaccaccgtgacagcagaagatgaggcccagatggagcactaccggggctactttggagacatctgggacaagatgctgcagaagggcatgaagaagtctgtgggcctgcctgtggccgtgcagtgtgtggccctgccctggcaggaggagctgtgcctgcgcttcatgagggaggtggagcggctgatgaccccagagaagcagagcagctag

SEQ ID NO: 152117 - DNA, 456 bp, Artificial Sequence
  Description of Artificial Sequence: Synthetic coding sequence
agacggcagcaccccctgcccctgctgctgctgcggcacctgcggccccaggcccaccgggagcccccccaggtgtacaccagcagccagcccctgcgggtgggctactatgaaacagacaactacaccatgcccagccctgccatgagaagagctgtgctggagaccaagcagagcctggaggccgccggccacaccctggtgcccttcctgcccagcaacatcccccacgccctggagaccctgagcactggaggcctcttcagtgatggcggccacaccttcctgcagaacttcaagggggactttgtggacccctgcctgggggacctggtgtccatcctgaagctgccccagtggctgaagggcctgctggccttcctggtgaagcccctgctgccccggctgagcgccttcctgagcaacatgaagagccgctgccggcccctgccctag

SEQ ID NO: 152118 - DNA, 1599 bp, Artificial Sequence
  Description of Artificial Sequence: Synthetic coding sequence
atggcccccagcttcaccgcccgcatccagctgttcctgctgcgggccctgggcttcctgattggcctggtgggccgggccgccctggtgctgggcggccccaagtttgccagcaagacccccaggcctgtgacagagcccctgctgctgctgagcggcatgcagctggccaagctgatccggcagaggaaggtgaagtgcattgatgtggtgcaggcctacatcaaccgcatcaaggatgtgaaccccatgatcaatggcatcgtgaagtacagatttgaggaggccatgaaggaggcccatgctgtggaccagaagctggccgagaagcaggaggatgaggccaccctggagaacaagtggcccttcctgggcgtgcccctgactgtgaaggaggccttccagctgcagggcatgcccaacagcagcggcctgatgaacagaagagatgccatcgccaagacagatgccaccgtggtggccctgctgaagggggccggggccatccccctgggcatcaccaactgcagcgagctgtgcatgtggtatgagagcagcaacaagatctacggccgcagcaacaacccctatgacctgcagcacatcgtgggcggcagcagtggaggagagggctgcaccctggccgccgcctgcagcgtgattggagtgggcagtgacattggaggcagcatccgcatgcctgccttcttcaacggcatcttcggccacaagcccagccctggggtggtgcccaacaagggccagttccccctggccgtgggcgcccaggagctgttcctgtgcaccggccccatgtgccgctatgcagaggacctggcccccatgctgaaggtgatggccggccctggcatcaagaggctgaagctggacaccaaggtgcacctgaaggacctgaagttctactggatggagcatgatggcggcagcttcctgatgagcaaggtggaccaggacctgatcatgacccagaagaaggtggtggtgcacctggagaccatcctgggcgcctctgtgcagcacgtgaagctgaagaagatgaagtacagcttccagctgtggatcgccatgatgtctgccaagggccatgatggcaaggagcctgtgaagtttgtggacctgctgggggaccacggcaagcacgtgagccccctgtgggagctgatcaagtggtgcctgggcctgtctgtgtacaccatccccagcatcggcctggccctgctggaggagaagctgcgctacagcaatgagaagtaccagaagttcaaggctgtggaggagagcctgaggaaggagctggtggacatgctgggagatgatggagtcttcctgtaccccagccaccccaccgtggcccccaagcaccacgtgcccctgacccggcccttcaactttgcctacacaggagtcttcagcgccctgggcctgcctgtgacccagtgccccctgggcctgaatgccaagggcctgcccctgggcatccaggtggtggccggccccttcaatgaccacctgaccctggccgtggcccagtacctggagaagacctttggaggctgggtgtgccctgggaagttctag

SEQ ID NO: 152119 - DNA, 384 bp, Artificial Sequence
  Description of Artificial Sequence: Synthetic coding sequence
atgtccttcagcggcaagtaccagctgcagagccaggagaactttgaggccttcatgaaggccatcggcctgcctgaggagctgatccagaagggcaaggacatcaagggcgtgtctgaaattgtgcagaatggcaagcacttcaagttcaccatcacagctggcagcaaggtgatccagaatgagttcaccgtgggggaggagtgtgagctggagaccatgactggagagaaggtgaagacagtggtgcagctggagggggacaacaagctggtgaccaccttcaagaacatcaagtctgtgacagagctgaatggagacatcatcaccaacaccatgaccctgggggacatcgtgttcaagaggatcagcaagaggatctag

SEQ ID NO: 152120 - DNA, 399 bp, Artificial Sequence
  Description of Artificial Sequence: Synthetic coding sequence
atggcctttgacagcacctggaaggtggacagaagtgaaaattatgacaagttcatggagaagatgggcgtgaacatcgtgaagaggaagctggccgcccatgacaacctgaagctgaccatcacccaggagggcaacaagttcaccgtgaaggagagcagcaccttcagaaatattgaggtggtgtttgagctgggcgtgaccttcaactacaacctggctgatggaacagagctgcggggcacctggagcctggagggcaacaagctgattggcaagttcaagaggacagacaatggaaatgagctgaacacagtgcgggagatcattggagatgagctggtgcagacctacgtgtatgagggcgtggaggccaagaggatcttcaagaaggactag

SEQ ID NO: 152121 - DNA, 402 bp, Artificial Sequence
  Description of Artificial Sequence: Synthetic coding sequence
atggtggatgccttcctgggcacctggaagctggtggacagcaagaactttgatgactacatgaagagcctgggcgtgggctttgccacccggcaggtggcctccatgaccaagcccaccaccatcatcgagaagaatggagacatcctgaccctgaagacccacagcaccttcaagaacacagagatctccttcaagctgggcgtggagtttgatgagaccacagcagatgacaggaaggtgaagagcatcgtgaccctggatggcggcaagctggtgcacctgcagaagtgggatggccaggagaccaccctggtgcgggagctgattgatggcaagctgatcctgaccctgacccacggcacagctgtgtgcaccaggacctatgagaaggaggcctag

SEQ ID NO: 152122 - DNA, 408 bp, Artificial Sequence
  Description of Artificial Sequence: Synthetic coding sequence
atggccaccgtgcagcagctggagggccgctggaggctggtggacagcaaaggatttgatgagtacatgaaggagctgggcgtgggcatcgccctgaggaagatgggcgccatggccaagccagactgcatcatcacctgtgatggcaagaacctgaccatcaagacagagagcaccctgaagaccacccagttcagctgcaccctgggggagaagtttgaggagaccacagcagatggcaggaagacccagacagtgtgcaacttcacagatggagccctggtgcagcaccaggagtgggatggcaaggagagcaccatcaccaggaagctgaaggatggcaagctggtggtggagtgtgtgatgaacaacgtgacctgcacccgcatctatgagaaggtggagtag

SEQ ID NO: 152123 - DNA, 534 bp, Artificial Sequence
  Description of Artificial Sequence: Synthetic coding sequence
atgaagacagtgaccatgatgatggtggtggagatgcaggccctgacccaggtgctgcgggctgtgctgagcgcctgcacctgggtgtccaggaagggggacctgcagaggatgaagcagacccacaagggcaagccacccagctccatggccttcaccgggaagtttgagatggagagcgagaagaactatgatgagttcatgaagctgctgggcatcagcagtgatgtgattgagaaggccaggaacttcaagatcgtgacagaggtgcagcaggacggccaggacttcacctggagccagcactacagcggcggccacaccatgaccaacaagttcaccgtgggcaaggagagcaacatccagaccatgggcggcaagaccttcaaggccaccgtgcagatggagggcggcaagctggtggtgaacttccccaactaccaccagaccagcgagatcgtgggggacaagctggtggaggtgtccaccatcggcggcgtgacctatgagcgggtgtccaagaggctggcctag

SEQ ID NO: 152124 - DNA, 534 bp, Artificial Sequence; identical to SEQ ID NO: 152123
  Description of Artificial Sequence: Synthetic coding sequence

SEQ ID NO: 152125 - DNA, 387 bp, Artificial Sequence
  Description of Artificial Sequence: Synthetic coding sequence
atggccttcaccgggaagtttgagatggagagcgagaagaactatgatgagttcatgaagctgctgggcatcagcagtgatgtgattgagaaggccaggaacttcaagatcgtgacagaggtgcagcaggacggccaggacttcacctggagccagcactacagcggcggccacaccatgaccaacaagttcaccgtgggcaaggagagcaacatccagaccatgggcggcaagaccttcaaggccaccgtgcagatggagggcggcaagctggtggtgaacttccccaactaccaccagaccagcgagatcgtgggggacaagctggtggaggtgtccaccatcggcggcgtgacctatgaaagagtgtccaagaggctggcctag

SEQ ID NO: 152126 - DNA, 501 bp, Artificial Sequence
  Description of Artificial Sequence: Synthetic coding sequence
atggtggaggccttctgtgccacctggaagctgaccaacagccagaactttgatgagtacatgaaggccctgggcgtgggctttgccacccggcaggtgggcaatgtgaccaagcccaccgtcatcatcagccaggagggggacaaggtggtgatccgcaccctgagcaccttcaagaacacagagatctccttccagctgggggaggagtttgatgagaccacagcagatgacaggaactgcaagtctgtggtgtccctggatggagacaagctggtgcacatccagaagtgggatggcaaggagaccaactttgtgcgggagatcaaggatggcaagatggtgatggtgtccaatgacaacagccccttcttcctggtgttcttcagcagcccccacaccagccacctgctgcccagcagcagcctgctgctgcccttcttcctgctgcccagcttcttcaacaacaccagcctggcccgcttcttcaactacatgtag

SEQ ID NO: 152127 - DNA, 399 bp, Artificial Sequence
  Description of Artificial Sequence: Synthetic coding sequence
atggtggaggccttctgtgccacctggaagctgaccaacagccagaactttgatgagtacatgaaggccctgggcgtgggctttgccacccggcaggtgggcaatgtgaccaagcccaccgtcatcatcagccaggagggggacaaggtggtgatccgcaccctgagcaccttcaagaacacagagatctccttccagctgggggaggagtttgatgagaccacagcagatgacaggaactgcaagtctgtggtgtccctggatggagacaagctggtgcacatccagaagtgggatggcaaggagaccaactttgtgcgggagatcaaggatggcaagatggtgatgaccctgacctttggagatgtggtggccgtgcgccactatgagaaggcctag

SEQ ID NO: 152128 - DNA, 1506 bp, Artificial Sequence
  Description of Artificial Sequence: Synthetic coding sequence
atgggcaccagggctgcccggcctgctggcctgccctgtggggctgagaacccagcccggcggcggctggccctgggcgcccggcagcagatccacagctggagccccaggacccccagcacccggctgacagccccagctggccctgcccggggcgtggcccggcctgccatggccccagaccctgtggccgctgagacagctgcccagggccccaccccccgctacttcacctgggatgaggtggcccagaggagcggctgtgaggagcgctggctggtgattgacaggaaggtgtacaacatcagcgagttcaccaggaggcaccctgggggcagcagggtcatcagccactacgccggccaggatgccacagacccctttgtggccttccacatcaacaagggcctggtgaagaagtacatgaacagcctgctgattggagagctgagccctgagcagcccagctttgagcccaccaagaacaaggagctgacagatgagttccgggagctgcgggccaccgtggagaggatgggcctgatgaaggccaaccacgtgttcttcctgctgtacctgctgcacatcctgctgctggatggagctgcctggctgaccctgtgggtgtttggcaccagcttcctgcccttcctgctgtgtgctgtgctgctgtctgctgtgcaggcccaggccggctggctgcagcacgactttggccacctgagcgtcttcagcaccagcaagtggaaccacctgctgcaccacttcgtcatcggccacctgaagggggccccagcctcctggtggaaccacatgcacttccagcaccacgccaagcccaactgcttcaggaaggaccctgacatcaacatgcaccccttcttctttgccctgggcaagatcctgtctgtggagctgggcaagcagaagaagaagtacatgccctacaaccaccagcacaagtacttcttcctgattggccccccagccctgctgcccctgtacttccagtggtacatcttctactttgtgatccagaggaagaagtgggtggacctggcctggatgatcaccttctacgtgcgcttcttcctgacctacgtgcccctgctgggcctgaaggccttcctgggcctcttcttcatcgtgcgcttcctggagagcaactggtttgtgtgggtgacccagatgaaccacatccccatgcacatcgaccatgacaggaacatggactgggtgtccacccagctgcaggccacctgcaatgtgcacaagagcgccttcaatgactggttcagcggccacctgaacttccagatcgagcaccacctgttccccaccatgcccaggcacaactaccacaaggtggcccccctggtgcagagcctgtgtgccaagcatggaattgagtaccagagcaagcccctgctgagcgcctttgctgacatcatccacagcctgaaggagagcggccagctgtggctggatgcctacctgcaccagtag

SEQ ID NO: 152129 - DNA, 1083 bp, Artificial Sequence
  Description of Artificial Sequence: Synthetic coding sequence
atgaacagcctgctgattggagagctgagccctgagcagcccagctttgagcccaccaagaacaaggagctgacagatgagttccgggagctgcgggccaccgtggagaggatgggcctgatgaaggccaaccacgtgttcttcctgctgtacctgctgcacatcctgctgctggatggagctgcctggctgaccctgtgggtgtttggcaccagcttcctgcccttcctgctgtgtgctgtgctgctgtctgctgtgcaggcccaggccggctggctgcagcacgactttggccacctgtctgtgttcagcaccagcaagtggaaccacctgctgcaccactttgtgattggccacctgaagggggccccagcctcctggtggaaccacatgcacttccagcaccacgccaagcccaactgcttcaggaaggaccctgacatcaacatgcaccccttcttctttgccctgggcaagatcctgtctgtggagctgggcaagcagaagaagaagtacatgccctacaaccaccagcacaagtacttcttcctgattggccccccagccctgctgcccctgtacttccagtggtacatcttctacttcgtcatccagaggaagaagtgggtggacctggcctggatgatcaccttctacgtgcgcttcttcctgacctacgtgcccctgctgggcctgaaggccttcctgggcctcttcttcatcgtgcgcttcctggagagcaactggtttgtgtgggtgacccagatgaaccacatccccatgcacatcgaccatgacaggaacatggactgggtgtccacccagctgcaggccacctgcaatgtgcacaagagcgccttcaatgactggttcagcggccacctgaacttccagatcgagcaccacctgttccccaccatgcccaggcacaactaccacaaggtggcccccctggtgcagagcctgtgtgccaagcacggcatcgagtaccagagcaagcccctgctgagcgcctttgctgacatcatccacagcctgaaggagagcggccagctgtggctggatgcctacctgcaccagtag

SEQ ID NO: 152130 - DNA, 1083 bp, Artificial Sequence; identical to SEQ ID NO: 152129
  Description of Artificial Sequence: Synthetic coding sequence

SEQ ID NO: 152131 - DNA, 1083 bp, Artificial Sequence; identical to SEQ ID NO: 152129
  Description of Artificial Sequence: Synthetic coding sequence

SEQ ID NO: 152132 - DNA, 1131 bp, Artificial Sequence
  Description of Artificial Sequence: Synthetic coding sequence
caggatgccttccgggccttccaccaggacctgaactttgtgaggaagttcctgcagcccctgctgattggagagctggcccctgaggagcccagccaggacggccccctgaatgcccagctggtggaggacttccgggccctgcaccaggccgctgaggacatgaagctgtttgatgccagccccaccttctttgccttcctgctgggccacatcctggccatggaggtgctggcctggctgctgatctacctgctgggccctggctgggtgcccagcgccctggccgccttcatcctggccatcagccaggcccaggccggctggctgcagcacgactttggccacctgagcgtcttcagcaccagcaagtggaaccacctgctgcaccacttcgtcatcggccacctgaagggggccccagcctcctggtggaaccacatgcacttccagcaccacgccaagcccaactgcttcaggaaggaccctgacatcaacatgcaccccttcttctttgccctgggcaagatcctgtctgtggagctgggcaagcagaagaagaagtacatgccctacaaccaccagcacaagtacttcttcctgattggccccccagccctgctgcccctgtacttccagtggtacatcttctactttgtgatccagaggaagaagtgggtggacctggcctggatgatcaccttctacgtgcgcttcttcctgacctacgtgcccctgctgggcctgaaggccttcctgggcctcttcttcatccgcttcctggagagcaactggtttgtgtgggtgacccagatgaaccacatccccatgcacatcgaccatgacaggaacatggactgggtgtccacccagctgcaggccacctgcaatgtgcacaagagcgccttcaatgactggttcagcggccacctgaacttccagatcgagcaccacctgttccccaccatgcccaggcacaactaccacaaggtggcccccctggtgcagagcctgtgtgccaagcacggcatcgagtaccagagcaagcccctgctgagcgcctttgctgacatcatccacagcctgaaggagagcggccagctgtggctggatgcctacctgcaccagtag

SEQ ID NO: 152133 - DNA, 1269 bp, Artificial Sequence
  Description of Artificial Sequence: Synthetic coding sequence
atgcacggccgggaggccggcccctttgtgtgtgtgtgtgtgctgctggccagcatccccaccccccagacccccctgctgcaggccagcctgccccccttccacccagccagcgctggccaccccatcaccggccagcaggatgccttccgggccttccacccagacctggagtttgtgggcaagttcctgaagcccctgctgattggagagctggcccctgaggagcccagccaggaccacggcaagaacagcaagatcacagaggacttccgggccctgaggaagacagctgaggacatgaacctcttcaagaccaaccacgtgttcttcctgctgctgctggcccacatcatcgccctggagagcatcgcctggttcaccgtcttctactttggaaatggctggatccccaccctcatcacagcctttgtgctggccaccagccaggcccaggccggctggctgcagcacgactatggccacctgtctgtgtacaggaagcccaagtggaaccacctggtgcacaagtttgtgattggccacctgaagggggccagcgccaactggtggaaccaccgccacttccagcaccacgccaagcccaacatcttccacaaggaccctgatgtgaacatgctgcacgtgtttgtgctgggggagtggcagcccattgaatatggcaagaagaagctgaagtacctgccctacaaccaccagcacgagtacttcttcctgattggcccccccctgctgatccccatgtacttccagtaccagatcatcatgaccatgattgtgcacaagaactgggtggacctggcctgggccgtgtcctactacatccgcttcttcatcacctacatccccttctacggcatcctgggcgccctgctcttcctgaacttcatccgcttcctggagagccactggtttgtgtgggtgacccagatgaaccacatcgtgatggagattgaccaggaggcctacagagactggttcagcagccagctgacagccacctgcaatgtggagcagagcttcttcaatgactggttcagcggccacctgaacttccagatcgagcaccacctgttccccaccatgcccaggcacaacctgcacaagatcgcccccctggtgaagagcctgtgtgccaagcacggcatcgagtaccaggagaagcccctgctgcgggccctgctggacatcatccgcagcctgaagaagagcggcaagctgtggctggatgcctacctgcacaagtag

SEQ ID NO: 152134 - DNA, 1335 bp, Artificial Sequence
  Description of Artificial Sequence: Synthetic coding sequence
atgggcaaaggaggcaaccagggcgagggcgctgctgagcgggaggtgtctgtgcccaccttctcctgggaggagatccagaagcacaacctgaggacagaccgctggctggtgattgacaggaaggtgtacaacatcaccaagtggagcatccagcaccctgggggccagagggtcatcggccactacgccggggaggatgccacagatgccttccgggccttccacccagacctggagtttgtgggcaagttcctgaagcccctgctgattggagagctggcccctgaggagcccagccaggaccacggcaagaacagcaagatcacagaggacttccgggccctgaggaagacagctgaggacatgaacctcttcaagaccaaccacgtgttcttcctgctgctgctggcccacatcatcgccctggagagcatcgcctggttcaccgtcttctactttggaaatggctggatccccaccctcatcacagcctttgtgctggccaccagccaggcccaggccggctggctgcagcacgactatggccacctgtctgtgtacaggaagcccaagtggaaccacctggtgcacaagtttgtgattggccacctgaagggggccagcgccaactggtggaaccaccgccacttccagcaccacgccaagcccaacatcttccacaaggaccctgatgtgaacatgctgcacgtgtttgtgctgggggagtggcagcccattgaatatggcaagaagaagctgaagtacctgccctacaaccaccagcacgagtacttcttcctgattggcccccccctgctgatccccatgtacttccagtaccagatcatcatgaccatgattgtgcacaagaactgggtggacctggcctgggccgtgtcctactacatccgcttcttcatcacctacatccccttctacggcatcctgggcgccctgctcttcctgaacttcatccgcttcctggagagccactggtttgtgtgggtgacccagatgaaccacatcgtgatggagattgaccaggaggcctacagagactggttcagcagccagctgacagccacctgcaatgtggagcagagcttcttcaatgactggttcagcggccacctgaacttccagatcgagcaccacctgttccccaccatgcccaggcacaacctgcacaagatcgcccccctggtgaagagcctgtgtgccaagcacggcatcgagtaccaggagaagcccctgctgcgggccctgctggacatcatccgcagcctgaagaagagcggcaagctgtggctggatgcctacctgcacaagtag

SEQ ID NO: 152135 - DNA, 1161 bp, Artificial Sequence
  Description of Artificial Sequence: Synthetic coding sequence
atgggcaaaggaggcaaccagggcgagggcgctgctgagcgggaggtgtctgtgcccaccttctcctgggaggagatccagaagcacaacctgaggacagaccgctggctggtgattgacaggaaggtgtacaacatcaccaagtggagcatccagcaccctgggggccagagggtcatcggccactacgccggggaggatgccacagatgccttccgggccttccacccagacctggagtttgtgggcaagttcctgaagcccctgctgattggagagctggcccctgaggagcccagccaggaccacggcaagaacagcaagatcacagaggacttccgggccctgaggaagacagctgaggacatgaacctcttcaagaccaaccacgtgttcttcctgctgctgctggcccacatcatcgccctggagagcatcgcctggttcaccgtcttctactttggaaatggctggatccccaccctcatcacagcctttgtgctggccaccagccaggcccaggccggctggctgcagcacgactatggccacctgtctgtgtacaggaagcccaagtggaaccacctggtgcacaagtttgtgattggccacctgaagggggccagcgccaactggtggaaccaccgccacttccagcaccacgccaagcccaacatcttccacaaggaccctgatgtgaacatgctgcacgtgtttgtgctgggggagtggcagcccattgaatatggcaagaagaagctgaagtacctgccctacaaccaccagcacgagtacttcttcctgattggcccccccctgctgatccccatgtacttccagtaccagatcatcatgaccatgattgtgcacaagaactgggtggacctggcctgggccgtgtcctactacatccgcttcttcatcacctacatccccttctacggcatcctgggcgccctgctcttcctgaacttcatccgcttcctggagagccactggtttgtgtgggtgacccagatgaaccacatcgtgatggagattgaccaggaggcctacagagactggttcagcagccagctgacagccacctgcaatgtggagcagagcttcttcaatgactggttcagcggccacctgaacttccagatcgagcaccagtag

SEQ ID NO: 152136 - DNA, 1338 bp, Artificial Sequence
  Description of Artificial Sequence: Synthetic coding sequence
atgggcggcgtgggggagcccggcccccgggagggccctgcccagcccggggcccccctgcccaccttctgctgggagcagatccgggcccatgaccagcccggggacaagtggctggtgattgaaagaagagtgtatgacatcagccgctgggcccagaggcaccctgggggcagccgcctcatcggccaccacggggctgaagatgccacagatgccttccgggccttccaccaggacctgaactttgtgaggaagttcctgcagcccctgctgattggagagctggcccctgaggagcccagccaggacggccccctgaatgcccagctggtggaggacttccgggccctgcaccaggccgctgaggacatgaagctgtttgatgccagccccaccttctttgccttcctgctgggccacatcctggccatggaggtgctggcctggctgctgatctacctgctgggccctggctgggtgcccagcgccctggccgccttcatcctggccatcagccaggcccagagctggtgcctgcagcacgacctgggccacgccagcatcttcaagaagtcctggtggaaccacgtggcccagaagtttgtgatgggccagctgaagggcttcagcgcccactggtggaacttccgccacttccagcaccacgccaagcccaacatcttccacaaggaccctgatgtgacagtggcccctgtgttcctgctgggggagagctctgtggagtatggcaagaagaagaggcgctacctgccctacaaccagcagcacctgtacttcttcctgattggcccccccctgctgaccctggtgaactttgaggtggagaacctggcctacatgctggtgtgcatgcagtgggccgacctgctgtgggccgccagcttctacgcccgcttcttcctgagctacctgcccttctatggagtgcctggggtgctgctcttctttgtggccgtgcgggtgctggagagccactggtttgtgtggatcacccagatgaaccacatccccaaggagatcggccacgagaagcaccgggactgggtgagcagccagctggccgccacctgcaatgtggagcccagcctcttcaccaactggttcagcggccacctgaacttccagatcgagcaccacctgttccccaggatgcccaggcacaactacagccgggtggcccccctggtgaagagcctgtgtgccaagcacggcctgtcctatgaggtgaagcccttcctgacagccctggtggacatcgtgcgcagcctgaagaagagcggggacatctggctggatgcctacctgcaccagtag

SEQ ID NO: 152137 - DNA, 1158 bp, Artificial Sequence
  Description of Artificial Sequence: Synthetic coding sequence
atgggcggcgtgggggagcccggcccccgggagggccctgcccagcccggggcccccctgcccaccttctgctgggagcagatccgggcccatgaccagcccggggacaagtggctggtgattgaaagaagagtgtatgacatcagccgctgggcccagaggcaccctgggggcagccgcctcatcggccaccacggggctgaagatgccacagatgccttccgggccttccaccaggacctgaactttgtgaggaagttcctgcagcccctgctgattggagagctggcccctgaggagcccagccaggacggccccctgaatgcccagctggtggaggacttccgggccctgcaccaggccgctgaggacatgaagctgtttgatgccagccccaccttctttgccttcctgctgggccacatcctggccatggaggtgctggcctggctgctgatctacctgctgggccctggctgggtgcccagcgccctggccgccttcatcctggccatcagccaggcccagagctggtgcctgcagcacgacctgggccacgccagcatcttcaagaagtcctggtggaaccacgtggcccagaagtttgtgatgggccagctgaagggcttcagcgcccactggtggaacttccgccacttccagcaccacgccaagcccaacatcttccacaaggaccctgatgtgacagtggcccctgtgttcctgctgggggagagctctgtggagtatggcaagaagaagaggcgctacctgccctacaaccagcagcacctgtacttcttcctgattggcccccccctgctgaccctggtgaactttgaggtggagaacctggcctacatgctggtgtgcatgcagtgggccgacctgctgtgggccgccagcttctacgcccgcttcttcctgagctacctgcccttctatggagtgcctggggtgctgctcttctttgtggccgtgcgctatggccgggagtggaggggccacacccaggccaccggggacccccactgcagccccccacctgagctgcccttcagccggctgcagaatggagccagcggcacagccagcctggcctgctggtggaaccacatcaacacctctgtggccggggcccagggccgctgggtgtag

SEQ ID NO: 152138 - DNA, 1017 bp, Artificial Sequence
  Description of Artificial Sequence: Synthetic coding sequence
atgttccaggccttccctggggactatgattctggcagccgctgcagcagcagccccagcgctgagagccagtacctgagctctgtggacagctttggcagccccccaacagctgctgccagccaggagtgtgccggcctgggggagatgcctggcagctttgtgcccaccgtgacagccatcaccaccagccaggacctgcagtggctggtgcagcccaccctcatcagctccatggcccagagccagggccagcccctggccagccagccccctgtggtggacccctatgacatgcctggcaccagctacagcaccccaggcatgagcggctacagcagcggcggggccagcggcagcggcggccccagcaccagcggcaccaccagcggccctggccctgcccggcctgcccgggcccggccccggcggccccgggaggagaccctgaccccagaggaggaggagaagagaagagtgagaagagagaggaacaagctggccgccgccaagtgcaggaacagaagaagagagctgacagaccggctgcaggccgagacagaccagctggaggaggagaaggccgagctggagagcgagattgctgagctgcagaaggagaaggagcggctggagtttgtgctggtggcccacaagccaggctgcaagatcccctatgaggagggccctggccctggccccctggccgaggtgcgggacctgcccggcagcgccccagccaaggaggatggcttctcctggctgctgcccccacctcctcctccacccctgcccttccagaccagccaggatgccccacccaacctgacagccagcctcttcacccacagcgaggtgcaggtgctgggggaccccttccctgtggtgaaccccagctacaccagcagctttgtgctgacctgcccagaggtgtctgcctttgctggggcccagaggaccagcggcagtgaccagcccagcgaccccctgaacagccccagcctgctggccctgtag

SEQ ID NO: 152139 - DNA, 909 bp, Artificial Sequence
  Description of Artificial Sequence: Synthetic coding sequence
atgttccaggccttccctggggactatgattctggcagccgctgcagcagcagccccagcgctgagagccagtacctgagctctgtggacagctttggcagccccccaacagctgctgccagccaggagtgtgccggcctgggggagatgcctggcagctttgtgcccaccgtgacagccatcaccaccagccaggacctgcagtggctggtgcagcccaccctcatcagctccatggcccagagccagggccagcccctggccagccagccccctgtggtggacccctatgacatgcctggcaccagctacagcaccccaggcatgagcggctacagcagcggcggggccagcggcagcggcggccccagcaccagcggcaccaccagcggccctggccctgcccggcctgcccgggcccggccccggcggccccgggaggagacagaaacagaccagctggaggaggagaaggccgagctggagagcgagattgctgagctgcagaaggagaaggagcggctggagtttgtgctggtggcccacaagccaggctgcaagatcccctatgaggagggccctggccctggccccctggccgaggtgcgggacctgcccggcagcgccccagccaaggaggatggcttctcctggctgctgcccccacctcctcctccacccctgcccttccagaccagccaggatgccccacccaacctgacagccagcctcttcacccacagcgaggtgcaggtgctgggggaccccttccctgtggtgaaccccagctacaccagcagctttgtgctgacctgcccagaggtgtctgcctttgctggggcccagaggaccagcggcagtgaccagcccagcgaccccctgaacagccccagcctgctggccctgtag

SEQ ID NO: 152140 - DNA, 588 bp, Artificial Sequence
  Description of Artificial Sequence: Synthetic coding sequence
atgttccaggccttccctggggactatgattctggcagccgctgcagcagcagccccagcgctgagagccagtacctgagctctgtggacagctttggcagccccccaacagctgctgccagccaggagacagaccagctggaggaggagaaggccgagctggagagcgagattgctgagctgcagaaggagaaggagcggctggagtttgtgctggtggcccacaagccaggctgcaagatcccctatgaggagggccctggccctggccccctggccgaggtgcgggacctgcccggcagcgccccagccaaggaggatggcttctcctggctgctgcccccacctcctcctccacccctgcccttccagaccagccaggatgccccacccaacctgacagccagcctcttcacccacagcgaggtgcaggtgctgggggaccccttccctgtggtgaaccccagctacaccagcagctttgtgctgacctgcccagaggtgtctgcctttgctggggcccagaggaccagcggcagtgaccagcccagcgaccccctgaacagccccagcctgctggccctgtag

SEQ ID NO: 152141 - DNA, 876 bp, Artificial Sequence
  Description of Artificial Sequence: Synthetic coding sequence
atgttccaggccttccctggggactatgattctggcagccgctgcagcagcagccccagcgctgagagccagtacctgagctctgtggacagctttggcagccccccaacagctgctgccagccaggagtgtgccggcctgggggagatgcctggcagctttgtgcccaccgtgacagccatcaccaccagccaggacctgcagtggctggtgcagcccaccctcatcagctccatggcccagagccagggccagcccctggccagccagccccctgtggtggacccctatgacatgcctggcaccagctacagcaccccaggcatgagcggctacagcagcggcggggccagcggcagcggcggccccagcaccagcggcaccaccagcggccctggccctgcccggcctgcccgggcccggccccggcggccccgggaggagaccctgaccccagaggaggaggagaagagaagagtgagaagagagaggaacaagctggccgccgccaagtgcaggaacagaagaagagagctgacagaccggctgcaggccgagacagaccagctggaggaggagaaggccgagctggagagcgagattgctgagctgcagaaggagaaggagcggctggagtttgtgctggtggcccacaagccaggctgcaagatcccctatgaggagggccctggccctggccccctggccgaggaggtgcaggtgctgggggaccccttccctgtggtgaaccccagctacaccagcagctttgtgctgacctgcccagaggtgtctgcctttgctggggcccagaggaccagcggcagtgaccagcccagcgaccccctgaacagccccagcctgctggccctgtag

SEQ ID NO: 152142 - DNA, 912 bp, Artificial Sequence
  Description of Artificial Sequence: Synthetic coding sequence
atgtctgacaacggggtgtgtgtgctggccttcaagtgccccggcctgctgcgctacacagcctaccgctgcaagcagctgagtgacaccagcatcatcgctgtggccagccactgccccctgctgcagaaggtgcacgtgggcaaccaggacaagctgacagatgagggcctgaagcagctgggcagcaagtgccgggagctgaaggacatccacttcggccagtgctacaagatcagtgatgagggcatgattgtgattgccaagggctgcctgaagctgcagaggatctacatgcaggagaacaagctggtgacagaccagagcgtgaaggcctttgctgagcactgcccagagctgcagtatgtgggcttcatgggctgcagcgtgaccagcaaaggagtcatccacctgaccaagctgaggaacctgagcagcctggacctgcggcacatcacagagctggacaatgaaacagtgatggagatcgtgaagcgctgcaagaacctgagcagcctgaacctgtgcctgaactggatcatcaatgacagatgtgtggaggtgattgccaaggagggccagaacctgaaggagctgtacctggtgtcctgcaagatcacagattatgccctgattgccatcggccgctacagcatgaccattgaaacagtggatgtgggctggtgcaaggagatcacagaccagggcgccaccctcatcgcccagagcagcaagagcctgcgctacctgggcctgatgagatgtgacaaggtgaatgaggtgacagtggagcagctggtgcagcagtacccccacatcaccttcagcacagtgctgcaggactgcaagaggaccctggagcgggcctaccagatgggctggacccccaacatgtctgctgccagcagctag

SEQ ID NO: 152143 - DNA, 945 bp, Artificial Sequence
  Description of Artificial Sequence: Synthetic coding sequence
atgtctgacaacggggtgtgtgtgctggccttcaagtgccccggcctgctgcgctacacagcctaccgctgcaagcagctgagtgacaccagcatcatcgctgtggccagccactgccccctgctgcagaaggtgcacgtgggcaaccaggacaagctgacagatgagggcctgaagcagctgggcagcaagtgccgggagctgaaggacatccacttcggccagtgctacaagatcagtgatgagggcatgattgtgattgccaagggctgcctgaagctgcagaggatctacatgcaggagaacaagctggtgacagaccagagcgtgaaggcctttgctgagcactgcccagagctgcagtatgtgggcttcatgggctgcagcgtgaccagcaaaggagtcatccacctgaccaagctgaggaacctgagcagcctggacctgcggcacatcacagagctggacaatgaaacagtgatggagatcgtgaagcgctgcaagaacctgagcagcctgaacctgtgcctgaactggatcatcaatgacagatgtgtggaggtgattgccaaggagggccagaacctgaaggagctgtacctggtgtcctgcaagatcacagattatgccctgattgccatcggccgctacagcatgaccattgaaacagtggatgtgggctggtgcaaggagatcacagaccagggcgccaccctcatcgcccagagcagcaagagcctgcgctacctgggcctgatgagatgtgacaaggtgcgggtggactaccaggtggtgtgcttcctgcacatcagcatcgtgaacagcctgatgagctaccccctgtccttcagcatcagcacccctgtgtactacatcctgtacatccacttcatctgcatctatgccatcatcgccatgcactgcctgcctgcctttgtgaactag

SEQ ID NO: 152144 - DNA, 2106 bp, Artificial Sequence
  Description of Artificial Sequence: Synthetic coding sequence
atgggccacctgctgagcaaggagcccaggaaccggcccagccagaagaggccccgctgctgctcctggtgcagaagaagaagacccctgctgcggctgcccaggaggaccccagccaaggtgcccccccagcctgctgcccccaggagccgggactgcttcttccggggcccctgcatgctgtgcttcatcgtgcacagccctggggccccagccccagctggccctgaggaggagccccccctgagccccccaccaagagatggagcctatgctgctgccagcagcagccagcacctggcccggcgctatgctgccctggccgctgaggactgtgccgctgctgcccggcgcttcctgctgagcagcgctgctgctgctgctgctgctgctgccagcgccagcagccctgccagctgctgcaaggagctgggcctggccgctgctgctgcctgggagcagcagggccgcagcctcttcctggccagcctgggccctgtgcgcttcctgggccccccagctgctgtgcagctgttccggggccccacccccagccctgctgagctgcccaccccacctgagatggtgtgcaagaggaagggggccggcgtgcctgcctgcaccccctgcaagcagccccgctgtggcggcggcggctgcggcggcggcggcggcggcggcggcggcggcggccctgctgggggcggggccagccccccccggcccccagatgctggctgctgccaggcccctgagcagcccccccagcccctgtgccccccacccagcagccccaccagcgagggcgcccccacagaggccggaggagatgctgtgcgggccggcggcacagcccccctgagcgcccagcagcagcatgaatgtggagatgctgactgccgggagagccctgagaacccctgtgactgccaccgggagcccccacctgagaccccagacatcaaccagctgcccccatccatcctgctgaagatcttcagcaacctgagcctggatgagcgctgcctgagcgccagcctggtgtgcaagtactggagggacctgtgcctggacttccagttctggaagcagctggacctgagcagccggcagcaggtgacagatgagctgctggagaagatcgccagccgcagccagaacatcatcgagatcaacatcagtgactgccgctccatgtctgacaacggggtgtgtgtgctggccttcaagtgccccggcctgctgcgctacacagcctaccgctgcaagcagctgagtgacaccagcatcatcgctgtggccagccactgccccctgctgcagaaggtgcacgtgggcaaccaggacaagctgacagatgagggcctgaagcagctgggcagcaagtgccgggagctgaaggacatccacttcggccagtgctacaagatcagtgatgagggcatgattgtgattgccaagggctgcctgaagctgcagaggatctacatgcaggagaacaagctggtgacagaccagagcgtgaaggcctttgctgagcactgcccagagctgcagtatgtgggcttcatgggctgcagcgtgaccagcaaaggagtcatccacctgaccaagctgaggaacctgagcagcctggacctgcggcacatcacagagctggacaatgaaacagtgatggagatcgtgaagcgctgcaagaacctgagcagcctgaacctgtgcctgaactggatcatcaatgacagatgtgtggaggtgattgccaaggagggccagaacctgaaggagctgtacctggtgtcctgcaagatcacagattatgccctgattgccatcggccgctacagcatgaccattgaaacagtggatgtgggctggtgcaaggagatcacagaccagggcgccaccctcatcgcccagagcagcaagagcctgcgctacctgggcctgatgagatgtgacaaggtgaatgaggtgacagtggagcagctggtgcagcagtacccccacatcaccttcagcacagtgctgcaggactgcaagaggaccctggagcgggcctaccagatgggctggacccccaacatgtctgctgccagcagctag

SEQ ID NO: 152145 - DNA, 2025 bp, Artificial Sequence
  Description of Artificial Sequence: Synthetic coding sequence
atgagcagcagcagccggggccctggggccggggccaggagaagaaggacccgctgccgccgctgccgggcctgtgtgaggacagaatgtggggactgccacttctgccgggacatgaagaagtttggaggccctggccgcatgaagcagagctgcctgctgcggcagtgcacagcccctgtgctgccccacacagctgtgtgcctgctgtgtggggaggccggcaaggaggacacagtggagggggaggaggagaagtttggcctgagcctgatggagtgcaccatctgcaatgagatcgtgcaccctggctgcctgaagatgggcaaggccgagggcgtcatcaatgctgagatccccaactgctgggagtgcccccgctgcacccaggagggccgcaccagcaaggacagcggggagggccctggaagaagaagagctgacaatggagaggagggcgccagcctgggcagcggctggaagctgacagaggagccccccctgcccccacctccacccaggaggaagggccccctgcctgctggccccccaccagaagatgtgcccggcccccccaagaggaaggagcgggaggccggaaatgaaccacccacccccaggaagaaggtgaagggcggccgggagcggcacctgaagaaggtgggcggagatgcctgcctgctgcggggcagtgaccccggcggccctggcctgctgcccccccgggtgctgaaccccagccaggccttcagcagctgccaccctggcctgcccccagagaactgggagaagcccaagccacccctggccagcgctgagggccctgctgtgcccagccccagcccccagcgggagaagctggagcgcttcaagaggatgtgccagctgctggagcgggtgcctgacaccagcagcagcagcagtgacagcgacagcgacagcgacagcagcggcaccagcctgtctgaagatgaggcccctggagaggccagaaatggccggcggcctgcccggggcagcagtggagagaaggaaaatagaggaggccggcgggctgtgcggcccggcagcggcggccccctgctgtcctggcccctgggccctgcccccccaccccggcccccccagctggagcggcacgtggtgcggcccccacccaggagccctgagccagacaccctgcccctggccgccggcagtgaccaccccctgcccagggctgcctggctgcgggtcttccagcacctgggcccccgggagctgtgcatctgcatgagggtgtgcaggacctggagccgctggtgctatgacaagaggctgtggcccaggatggacctgagcaggaggaagagcctgaccccacccatgctgagcggcgtggtgcggcggcagccccgggccctggacctgtcctggacaggagtgtccaagaagcagctgatgtggctgctgaaccggctgcagggcctgcaggagctggtgctgagcggctgctcctggctgtctgtgtctgccctgggcagcgcccccctgcctgccctgcggctgctggacctgcgctggattgaagatgtgaaggacagccagctgcgggagctgctgctgcccccaccagacaccaagccaggccagacagagagccggggccgcctgcagggcgtggccgagctgcggctggccggcctggagctgacagatgccagcctgcggctgctgctgcggcatgccccccagctgagcgccctggacctgagccactgtgcccacgtgggggaccccagcgtgcacctgctgacagcccccaccagccccctgcgggagaccctggtgcacctgaacctggccggctgccaccggctgacagaccactgcctgcccctcttccgccgctgcccccggctgcggcggctggacctgcggagctgccggcagctgagccctgaggcctgtgcccggctggccgccgccggccccccaggccccttccgctgcccagaggagaagctgctgctgaaggacagctag

SEQ ID NO: 152146 - DNA, 2085 bp, Artificial Sequence
  Description of Artificial Sequence: Synthetic coding sequence
atgggcatgaaggtgcctgggaagggggagagcggccccagcgccctgctgaccccacccatgagcagcagcagccggggccctggggccggggccaggagaagaaggacccgctgccgccgctgccgggcctgtgtgaggacagaatgtggggactgccacttctgccgggacatgaagaagtttggaggccctggccgcatgaagcagagctgcctgctgcggcagtgcacagcccctgtgctgccccacacagctgtgtgcctgctgtgtggggaggccggcaaggaggacacagtggagggggaggaggagaagtttggcctgagcctgatggagtgcaccatctgcaatgagatcgtgcaccctggctgcctgaagatgggcaaggccgagggcgtcatcaatgctgagatccccaactgctgggagtgcccccgctgcacccaggagggccgcaccagcaaggacagcggggagggccctggaagaagaagagctgacaatggagaggagggcgccagcctgggcagcggctggaagctgacagaggagccccccctgcccccacctccacccaggaggaagggccccctgcctgctggccccccaccagaagatgtgcccggcccccccaagaggaaggagcgggaggccggaaatgaaccacccacccccaggaagaaggtgaagggcggccgggagcggcacctgaagaaggtgggcggagatgcctgcctgctgcggggcagtgaccccggcggccctggcctgctgcccccccgggtgctgaaccccagccaggccttcagcagctgccaccctggcctgcccccagagaactgggagaagcccaagccacccctggccagcgctgagggccctgctgtgcccagccccagcccccagcgggagaagctggagcgcttcaagaggatgtgccagctgctggagcgggtgcctgacaccagcagcagcagcagtgacagcgacagcgacagcgacagcagcggcaccagcctgtctgaagatgaggcccctggagaggccagaaatggccggcggcctgcccggggcagcagtggagagaaggaaaatagaggaggccggcgggctgtgcggcccggcagcggcggccccctgctgtcctggcccctgggccctgcccccccaccccggcccccccagctggagcggcacgtggtgcggcccccacccaggagccctgagccagacaccctgcccctggccgccggcagtgaccaccccctgcccagggctgcctggctgcgggtcttccagcacctgggcccccgggagctgtgcatctgcatgagggtgtgcaggacctggagccgctggtgctatgacaagaggctgtggcccaggatggacctgagcaggaggaagagcctgaccccacccatgctgagcggcgtggtgcggcggcagccccgggccctggacctgtcctggacaggagtgtccaagaagcagctgatgtggctgctgaaccggctgcagggcctgcaggagctggtgctgagcggctgctcctggctgtctgtgtctgccctgggcagcgcccccctgcctgccctgcggctgctggacctgcgctggattgaagatgtgaaggacagccagctgcgggagctgctgctgcccccaccagacaccaagccaggccagacagagagccggggccgcctgcagggcgtggccgagctgcggctggccggcctggagctgacagatgccagcctgcggctgctgctgcggcatgccccccagctgagcgccctggacctgagccactgtgcccacgtgggggaccccagcgtgcacctgctgacagcccccaccagccccctgcgggagaccctggtgcacctgaacctggccggctgccaccggctgacagaccactgcctgcccctcttccgccgctgcccccggctgcggcggctggacctgcggagctgccggcagctgagccctgaggcctgtgcccggctggccgccgccggccccccaggccccttccgctgcccagaggagaagctgctgctgaaggacagctag

SEQ ID NO: 152147 - DNA, 1761 bp, Artificial Sequence
  Description of Artificial Sequence: Synthetic coding sequence
tgaagaatgaagcagagctgcctgctgcggcagtgcacagcccctgtgctgccccacacagctgtgtgcctgctgtgtggggaggccggcaaggaggacacagtggagggggaggaggagaagtttggcctgagcctgatggagtgcaccatctgcaatgaaattgtgcaccctggctgcctgaagatgggcaaggccgagggcgtcatcaatgctgagatccccaactgctgggagtgcccccgctgcacccaggagggccgcaccagcaaggacagcggggagggccctggaagaagaagagctgacaacggggaggagggcgccagcctgggcagcggctggaagctgacagaggagccccccctgcccccacctccacccaggaggaagggccccctgcctgctggccccccaccagaagatgtgcccggcccccccaagaggaaggagcgggaggccggaaatgagccccccacccccaggaagaaggtgaagggcggccgggagcggcacctgaagaagaagcccaagccacccctggccagcgctgagggccctgctgtgcccagccccagcccccagcgggagaagctggagcgcttcaagaggatgtgccagctgctggagcgggtgcctgacaccagcagcagcagcagtgacagcgacagcgacagcgacagcagcggcaccagcctgtctgaagatgaggcccctggagaggccagaaatggccggcggcctgcccggggcagcagtggagagaaggaaaatagaggaggccggcgggctgtgcggcccggcagcggcggccccctgctgtcctggcccctgggccctgcccccccaccccggcccccccagctggagcggcacgtggtgcggcccccacccaggagccctgagccagacaccctgcccctggccgccggcagtgaccaccccctgcccagggctgcctggctgcgggtcttccagcacctgggcccccgggagctgtgcatctgcatgagggtgtgcaggacctggagccgctggtgctatgacaagaggctgtggcccaggatggacctgagcaggaggaagagcctgaccccacccatgctgagcggcgtggtgcggcggcagccccgggccctggacctgtcctggacaggagtgtccaagaagcagctgatgtggctgctgaaccggctgcagggcctgcaggagctggtgctgagcggctgctcctggctgtctgtgtctgccctgggcagcgcccccctgcctgccctgcggctgctggacctgcgctggattgaagatgtgaaggacagccagctgcgggagctgctgctgcccccaccagacaccaagccaggccagacagagagccggggccgcctgcagggcgtggccgagctgcggctggccggcctggagctgacagatgccagcctgcggctgctgctgcggcatgccccccagctgagcgccctggacctgagccactgtgcccacgtgggggaccccagcgtgcacctgctgacagcccccaccagccccctgcgggagaccctggtgcacctgaacctggccggctgccaccggctgacagaccactgcctgcccctcttccgccgctgcccccggctgcggcggctggacctgcggagctgccggcagctgagccctgaggcctgtgcccggctggccgccgccggccccccaggccccttccgctgcccagaggagaagctgctgctgaaggacagctag

SEQ ID NO: 152148 - DNA, 495 bp, Artificial Sequence
  Description of Artificial Sequence: Synthetic coding sequence
atggacctggaggagtgcatcctgatcacagacagcaccctcatccagctgagcatccactgccccaagctgcaggccctggtgtccctgtccttcagtgacatcatccacctgctgaagatgaaggagcccagccaccacaacaagaagctgtttggcttctccttctgcaagagcctgagccactgtgagctgatcacagatgatggcatcctgcacctgagcaacagcacctgtggccacgagcggctgcgggtgctggagctggacaactgcctgctgatcacagatgtggccctggagcacctggagaactgccggggcctggagcggctggagctgtatgactgccagcaggtgaccagggctggcatcaagaggatgagggcccagctgccccacgtgaaggtgcacgcctactttgcccctgtgaccccacccacagctgtggccggcagcggccagaggctgtgccgctgctgcgtcatcctgtag

SEQ ID NO: 152149 - DNA, 1272 bp, Artificial Sequence
  Description of Artificial Sequence: Synthetic coding sequence
atggtgttcagcaacaatgatgagggcctcatcaacaagaagctgcccaaggagctgctgctgcgcatcttctccttcctggacatcgtgaccctgtgccgctgtgcccagatcagcaaggcctggaacatcctggccctggatggcagcaactggcagagaattgacctcttcaacttccagacagatgtggagggccgggtggtggagaacatcagcaagagatgtggcggcttcctgaggaagctgagcctgcggggctgcattggagtgggggacagcagcctgaagacctttgcccagaactgcaggaacatcgagcacctgaacctgaatggctgcaccaagatcacagacagcacctgctacagcctgagccgcttctgcagcaagctgaagcacctggacctgaccagctgtgtgtccatcaccaacagcagcctgaagggcatcagcgagggctgcaggaacctggagtacctgaacctgtcctggtgtgaccagatcaccaaggatggcatcgaggccctggtgcggggctgccggggcctgaaggccctgctgctgcggggctgcacccagctggaggatgaggccctgaagcacatccagaactactgccacgagctggtgtccctgaacctgcagagctgcagccgcatcacagatgaaggagtggtgcagatctgccggggctgccaccggctgcaggccctgtgcctgagcggctgcagcaacctgacagatgccagcctgacagccctgggcctgaactgcccccggctgcagatcctggaggccgcccgctgcagccacctgacagatgctggcttcaccctgctggccaggaactgccacgagctggagaagatggacctggaggagtgcatcctgatcacagacagcaccctcatccagctgagcatccactgccccaagctgcaggccctgagcctgagccactgtgagctgatcacagatgatggcatcctgcacctgagcaacagcacctgtggccacgagcggctgcgggtgctggagctggacaactgcctgctgatcacagatgtggccctggagcacctggagaactgccggggcctggagcggctggagctgtatgactgccagcaggtgacccgggccggcatcaagaggatgagggcccagctgccccacgtgaaggtgcacgcctactttgcccctgtgaccccacccacagctgtggccggcagcggccagaggctgtgccgctgctgcgtcatcctgtag

SEQ ID NO: 152150 - DNA, 1020 bp, Artificial Sequence
  Description of Artificial Sequence: Synthetic coding sequence
atgtacatcgccctggtgtggatcctgtttgtgatgtggacctttgcccagaactgcaggaacatcgagcacctgaacctgaatggctgcaccaagatcacagacagcacctgctacagcctgagccgcttctgcagcaagctgaagcacctggacctgaccagctgtgtgtccatcaccaacagcagcctgaagggcatcagcgagggctgcaggaacctggagtacctgaacctgtcctggtgtgaccagatcaccaaggatggcatcgaggccctggtgcggggctgccggggcctgaaggccctgctgctgcggggctgcacccagctggaggatgaggccctgaagcacatccagaactactgccacgagctggtgtccctgaacctgcagagctgcagccgcatcacagatgaaggagtggtgcagatctgccggggctgccaccggctgcaggccctgtgcctgagcggctgcagcaacctgacagatgccagcctgacagccctgggcctgaactgcccccggctgcagatcctggaggccgcccgctgcagccacctgacagatgctggcttcaccctgctggccaggaactgccacgagctggagaagatggacctggaggagtgcatcctgatcacagacagcaccctcatccagctgagcatccactgccccaagctgcaggccctgagcctgagccactgtgagctgatcacagatgatggcatcctgcacctgagcaacagcacctgtggccacgagcggctgcgggtgctggagctggacaactgcctgctgatcacagatgtggccctggagcacctggagaactgccggggcctggagcggctggagctgtatgactgccagcaggtgacccgggccggcatcaagaggatgagggcccagctgccccacgtgaaggtgcacgcctactttgcccctgtgaccccacccacagctgtggccggcagcggccagaggctgtgccgctgctgcgtcatcctgtag

SEQ ID NO: 152151 - DNA, 1068 bp, Artificial Sequence
  Description of Artificial Sequence: Synthetic coding sequence
atggtgttcagcaacaatgatgagggcctcatcaacaagaagctgcccaaggagctgctgctgcgcatcttctccttcctggacatcgtgaccctgtgccgctgtgcccagatcagcaaggcctggaacatcctggccctggatggcagcaactggcagagaattgacctcttcaacttccagacagatgtggagggccgggtggtggagaacatcagcaagagatgtggcggcttcctgaggaagctgagcctgcggggctgcattggagtgggggacagcagcctgaagacctttgcccagaactgcaggaacatcgagcacctgaacctgaatggctgcaccaagatcacagacagcacctgctacagcctgagccgcttctgcagcaagctgaagcacatccagaactactgccacgagctggtgtccctgaacctgcagagctgcagccgcatcacagatgaaggagtggtgcagatctgccggggctgccaccggctgcaggccctgtgcctgagcggctgcagcaacctgacagatgccagcctgacagccctgggcctgaactgcccccggctgcagatcctggaggccgcccgctgcagccacctgacagatgctggcttcaccctgctggccaggaactgccacgagctggagaagatggacctggaggagtgcatcctgatcacagacagcaccctcatccagctgagcatccactgccccaagctgcaggccctgagcctgagccactgtgagctgatcacagatgatggcatcctgcacctgagcaacagcacctgtggccacgagcggctgcgggtgctggagctggacaactgcctgctgatcacagatgtggccctggagcacctggagaactgccggggcctggagcggctggagctgtatgactgccagcaggtgacccgggccggcatcaagaggatgagggcccagctgccccacgtgaaggtgcacgcctactttgcccctgtgaccccacccacagctgtggccggcagcggccagaggctgtgccgctgctgcgtcatcctgtag

SEQ ID NO: 152152 - DNA, 402 bp, Artificial Sequence
  Description of Artificial Sequence: Synthetic coding sequence
atggacctggaggagtgcatcctgatcacagacagcaccctcatccagctgagcatccactgccccaagctgcaggccctgagcctgagccactgtgagctgatcacagatgatggcatcctgcacctgagcaacagcacctgtggccacgagcggctgcgggtgctggagctggacaactgcctgctgatcacagatgtggccctggagcacctggagaactgccggggcctggagcggctggagctgtatgactgccagcaggtgacccgggccggcatcaagaggatgagggcccagctgccccacgtgaaggtgcacgcctactttgcccctgtgaccccacccacagctgtggccggcagcggccagaggctgtgccgctgctgcgtcatcctgtag

SEQ ID NO: 152153 - DNA, 1068 bp, Artificial Sequence; identical to SEQ ID NO: 152151
  Description of Artificial Sequence: Synthetic coding sequence

SEQ ID NO: 152154 - DNA, 1260 bp, Artificial Sequence
  Description of Artificial Sequence: Synthetic coding sequence
atggtgttttctgctgtgctgacagccttccacacaggcaccagcaacaccacctttgtggtgtatgagaacacctacatgaacatcaccctgcccccacccttccagcacccagacctgagccccctgctgcgctacagctttgagaccatggcccccaccggcctgagcagcctgactgtgaacagcacagctgtgcccaccaccccagctgccttcaagagcctgaacctgcccctgcagatcaccctgagcgccatcatgatcttcatcctgtttgtgtccttcctgggcaacctggtggtgtgcctgatggtgtaccagaaggccgccatgaggtctgccatcaacatcctgctggccagcctggcctttgctgacatgctgctggccgtgctgaacatgccctttgccctggtgaccatcctgaccacccgctggatctttgggaagttcttctgccgggtgtctgccatgttcttctggctgtttgtgattgagggcgtggccatcctgctgatcatcagcattgaccgcttcctgatcatcgtgcagaggcaggacaagctgaacccctaccgggccaaggtgctgattgctgtgtcctgggccaccagcttctgtgtggccttccccctggccgtgggcaacccagacctgcagatccccagccgggccccccagtgtgtgtttggctacaccaccaaccctggctaccaggcctacgtgatcctgatcagcctcatctccttcttcatccccttcctggtgatcctgtacagcttcatgggcatcctgaacaccctgcggcacaatgccctgcgcatccacagctacccagagggcatctgcctgagccaggccagcaagctgggcctgatgagcctgcagaggcccttccagatgagcattgacatgggcttcaagacccgggccttcaccaccatcctgatcctgtttgctgtgttcatcgtgtgctgggcccccttcaccacctacagcctggtggccaccttcagcaagcacttctactaccagcacaacttctttgagatcagcacctggctgctgtggctgtgctacctgaagagcgccctgaaccccctcatctactactggaggatcaagaagttccatgatgcctgcctggacatgatgcccaagagcttcaagttcctgccccagctgcccggccacaccaagaggcgcatccggcccagcgctgtgtatgtgtgtggggagcacaggacagtggtgtag

SEQ ID NO: 152155 - DNA, 1866 bp, Artificial Sequence
  Description of Artificial Sequence: Synthetic coding sequence
atgagccctgtgttccccatgctgactgtgctgaccatgttctactacatctgcctgcggcggcgggccaggacagccaccagaggagagatgatgaacacccaccgggccatcgagagcaacagccagaccagccccctgaatgctgaggtggtgcagtatgccaaggaggtggtggacttcagcagccactacggcagcgagaacagcatgagctacaccatgtggaacctggccggcgtgcccaacgtgttccccagcagcggggacttcacccagacagctgtgttccgcacctacggcacctggtgggaccagtgccccagcgccagcctgcccttcaagaggaccccacccaacttccagagccaggactatgtggagctgacctttgagcagcaggtgtaccccacagctgtgcacgtgctggagacctaccaccctggggccgtcatccgcatcctggcctgcagcgccaacccctacagccccaaccccccagctgaggtgcgctgggagatcctgtggagcgagcggcccaccaaggtgaatgccagccaggcccggcagttcaagccctgcatcaagcagatcaacttccccaccaacctgatccggctggaggtgaacagcagcctgctggagtactacacagagctggatgctgtggtgctgcacggcgtgaaggacaagcctgtgctgagcctgaagaccagcctgattgacatgaatgacattgaagatgatgcctatgcagagaaggatggctgcggcatggacagcctgaacaagaagttcagcagcgctgtgctgggggagggccccaacaacggctactttgacaagctgccctatgagctgatccagctgatcctgaaccacctgaccctgcctgacctgtgccgcctggcccagacctgcaagctgctgagccagcactgctgtgaccccctgcagtacatccacctgaacctgcagccctactgggccaagctggatgacaccagcctggagttcctgcagagccgctgcaccctggtgcagtggctgaacctgtcctggacaggcaacagaggcttcatctctgtggccggcttcagccgcttcctgaaggtgtgtggcagcgagctggtgcggctggagctgagctgcagccacttcctgaatgagacctgcctggaggtgatcagcgagatgtgccccaacctgcaggccctgaacctgagcagctgtgacaagctgcccccccaggccttcaaccacatcgccaagctgtgcagcctgaagaggctggtgctgtaccgcaccaaggtggagcagacagccctgctgagcatcctgaacttctgcagcgagctgcagcacctgagcctgggcagctgtgtgatgattgaagattatgatgtgattgcctccatgattggagccaagtgcaagaagctgcggaccctggacctgtggcgctgcaagaacatcacagaaaatggaattgctgagctggccagcggctgccccctgctggaggagctggacctgggctggtgccccaccctgcagagcagcacaggctgcttcacccggctggcccaccagctgcccaacctgcagaagctgttcctgacagccaacagatctgtgtgtgacacagacattgatgagctggcctgcaactgcacccggctgcagcagctggacatcctgggcaccaggatggtgtccccagccagcctgaggaagctgctggagagctgcaaggacctgagcctgctggatgtgtccttctgcagccagattgacaacagagctgtgctggagctgaatgccagcttccccaaggtgttcatcaagaagagcttcacccagtag

SEQ ID NO: 152156 - DNA, 2076 bp, Artificial Sequence
  Description of Artificial Sequence: Synthetic coding sequence
atggcccccttccctgaggaggtggatgtgttcaccgccccccactggaggatgaagcagctggtgggcctgtactgtgacaagctgagcaagaccaacttcagcaacaacaatgacttccgggccctgctgcagagcctgtatgccaccttcaaggagttcaagatgcatgagcagattgaaaatgagtacatcatcggcctgctgcagcagaggagccagaccatctacaacgtgcacagcgacaacaagctgtctgagatgctgagcctgtttgagaagggcctgaagaatgtgaagaatgaatatgagcagctgaactatgccaagcagctgaaggagcggctggaggccttcacccgggacttcctgccccacatgaaggaggaggaggaggtgttccagcccatgctgatggagtacttcacctatgaggagctgaaggacatcaagaagaaggtgattgcccagcactgcagccagaaggacacagctgagctgctgcggggcctgagcctgtggaaccacgccgaggagcggcagaagttcttcaagtacagcgtggatgagaagagtgacaaggaggccgaggtgtctgagcacagcacaggcatcacccacctgcccccagaggtgatgctgagcatcttctcctacctgaacccccaggagctgtgccgctgcagccaggtgtccatgaagtggagccagctgaccaagacaggcagcctgtggaagcacctgtaccctgtgcactgggcccggggggactggtacagcggccctgccacagagctggacacagagccagatgatgagtgggtgaagaacaggaaggatgagagccgggccttccacgagtgggatgaagatgctgacattgatgaaagtgaggagagcgctgaggagagcatcgccatcagcatcgcccagatggagaagaggctgctgcacggcctcatccacaacgtgctgccctacgtgggcacctctgtgaagaccctggtgctggcctacagcagcgctgtgagcagcaagatggtgcggcagatcctggagctgtgccccaacctggagcacctggacctgacccagacagacatcagtgacagcgcctttgacagctggagctggctgggctgctgccagagcctgcggcacctggacctgagcggctgtgagaagatcacagatgtggccctggagaagatcagccgggccctgggcatcctgaccagccaccagagcggcttcctgaagaccagcaccagcaagatcaccagcacagcctggaagaacaaggacatcaccatgcagagcaccaagcagtatgcctgcctgcatgacctgaccaacaagggcattggagaggagattgacaatgagcacccctggaccaagcctgtgtcctctgagaacttcaccagcccctacgtgtggatgctggatgctgaggacctggccgacattgaagatactgtggagtggaggcacagaaatgtggagagcctgtgtgtgatggagacagccagcaacttcagctgcagcaccagcggctgcttcagcaaggacatcgtgggcctgcggacctctgtgtgctggcagcagcactgtgccagccctgcctttgcctactgcggccacagcttctgctgcacaggaacagccctgcggaccatgagcagcctgcctgagagcagcgccatgtgcaggaaggccgcccggacccggctgccccggggcaaggacctgatctactttggaagtgagaagagtgaccaggagaccggccgggtgctgctcttcctgagcctgagcggctgctaccagatcacagaccacggcctgcgggtgctgaccctgggcggcggcctgccctacctggagcacctgaacctgagcggctgcctgaccatcaccggggccggcctgcaggacctggtgtctgcctgccccagcctgaatgatgagtacttctactactgtgacaacatcaatggcccccacgccgacacagccagcggctgccagaacctgcagtgtggcttccgggcctgctgccgctctggagagtag

SEQ ID NO: 152157 - DNA, 1698 bp, Artificial Sequence
  Description of Artificial Sequence: Synthetic coding sequence
atgaaggaggaggaggaggtgttccagcccatgctgatggagtacttcacctatgaggagctgaaggacatcaagaagaaggtgattgcccagcactgcagccagaaggacacagctgagctgctgcggggcctgagcctgtggaaccacgccgaggagcggcagaagttcttcaagtacagcgtggatgagaagagtgacaaggaggccgaggtgtctgagcacagcacaggcatcacccacctgcccccagaggtgatgctgagcatcttctcctacctgaacccccaggagctgtgccgctgcagccaggtgtccatgaagtggagccagctgaccaagacaggcagcctgtggaagcacctgtaccctgtgcactgggcccggggggactggtacagcggccctgccacagagctggacacagagccagatgatgagtgggtgaagaacaggaaggatgagagccgggccttccacgagtgggatgaagatgctgacattgatgaaagtgaggagagcgctgaggagagcatcgccatcagcatcgcccagatggagaagaggctgctgcacggcctcatccacaacgtgctgccctacgtgggcacctctgtgaagaccctggtgctggcctacagcagcgctgtgagcagcaagatggtgcggcagatcctggagctgtgccccaacctggagcacctggacctgacccagacagacatcagtgacagcgcctttgacagctggagctggctgggctgctgccagagcctgcggcacctggacctgagcggctgtgagaagatcacagatgtggccctggagaagatcagccgggccctgggcatcctgaccagccaccagagcggcttcctgaagaccagcaccagcaagatcaccagcacagcctggaagaacaaggacatcaccatgcagagcaccaagcagtatgcctgcctgcatgacctgaccaacaagggcattggagaggagattgacaatgagcacccctggaccaagcctgtgtcctctgagaacttcaccagcccctacgtgtggatgctggatgctgaggacctggccgacattgaagatactgtggagtggaggcacagaaatgtggagagcctgtgtgtgatggagacagccagcaacttcagctgcagcaccagcggctgcttcagcaaggacatcgtgggcctgcggacctctgtgtgctggcagcagcactgtgccagccctgcctttgcctactgcggccacagcttctgctgcacaggaacagccctgcggaccatgagcagcctgcctgagagcagcgccatgtgcaggaaggccgcccggacccggctgccccggggcaaggacctgatctactttggaagtgagaagagtgaccaggagaccggccgggtgctgctcttcctgagcctgagcggctgctaccagatcacagaccacggcctgcgggtgctgaccctgggcggcggcctgccctacctggagcacctgaacctgagcggctgcctgaccatcaccggggccggcctgcaggacctggtgtctgcctgccccagcctgaatgatgagtacttctactactgtgacaacatcaatggcccccacgccgacacagccagcggctgccagaacctgcagtgtggcttccgggcctgctgccgctctggagagtag

SEQ ID NO: 152158 - DNA, 2025 bp, Artificial Sequence
  Description of Artificial Sequence: Synthetic coding sequence
atggcccccttccctgaggaggtggatgtgttcaccgccccccactggaggatgaagcagctggtgggcctgtactgtgacaagagcctgtatgccaccttcaaggagttcaagatgcatgagcagattgaaaatgagtacatcatcggcctgctgcagcagaggagccagaccatctacaacgtgcacagcgacaacaagctgtctgagatgctgagcctgtttgagaagggcctgaagaatgtgaagaatgaatatgagcagctgaactatgccaagcagctgaaggagcggctggaggccttcacccgggacttcctgccccacatgaaggaggaggaggaggtgttccagcccatgctgatggagtacttcacctatgaggagctgaaggacatcaagaagaaggtgattgcccagcactgcagccagaaggacacagctgagctgctgcggggcctgagcctgtggaaccacgccgaggagcggcagaagttcttcaagtacagcgtggatgagaagagtgacaaggaggccgaggtgtctgagcacagcacaggcatcacccacctgcccccagaggtgatgctgagcatcttctcctacctgaacccccaggagctgtgccgctgcagccaggtgtccatgaagtggagccagctgaccaagacaggcagcctgtggaagcacctgtaccctgtgcactgggcccggggggactggtacagcggccctgccacagagctggacacagagccagatgatgagtgggtgaagaacaggaaggatgagagccgggccttccacgagtgggatgaagatgctgacattgatgagagcgaggagagcgctgaggagagcatcgccatcagcatcgcccagatggagaagaggctgctgcacggcctcatccacaacgtgctgccctacgtgggcacctctgtgaagaccctggtgctggcctacagcagcgctgtgagcagcaagatggtgcggcagatcctggagctgtgccccaacctggagcacctggacctgacccagacagacatcagtgacagcgcctttgacagctggagctggctgggctgctgccagagcctgcggcacctggacctgagcggctgtgagaagatcacagatgtggccctggagaagatcagccgggccctgggcatcctgaccagccaccagagcggcttcctgaagaccagcaccagcaagatcaccagcacagcctggaagaacaaggacatcaccatgcagagcaccaagcagtatgcctgcctgcatgacctgaccaacaagggcatcggggaggagattgacaatgagcacccctggaccaagcctgtgtcctctgagaacttcaccagcccctacgtgtggatgctggatgctgaggacctggccgacatcgaggacacagtggagtggaggcacagaaatgtggagagcctgtgtgtgatggagacagccagcaacttcagctgcagcaccagcggctgcttcagcaaggacatcgtgggcctgcggacctctgtgtgctggcagcagcactgtgccagccctgcctttgcctactgcggccacagcttctgctgcaccggcacagccctgcggaccatgagcagcctgcctgagagcagcgccatgtgcaggaaggccgcccggacccggctgccccggggcaaggacctgatctacttcggcagcgagaagagtgaccaggagaccggccgggtgctgctcttcctgagcctgagcggctgctaccagatcacagaccacggcctgcgggtgctgaccctgggcggcggcctgccctacctggagcacctgaacctgagcggctgcctgaccatcactggagctggcctgcaggacctggtgtctgcctgccccagcctgaatgatgagtacttctactactgtgacaacatcaatggcccccatgctgacacagccagcggctgccagaacctgcagtgtggcttccgggcctgctgccgcagcggggagtag

SEQ ID NO: 152159 - DNA, 1440 bp, Artificial Sequence
  Description of Artificial Sequence: Synthetic coding sequence
gggaagggcagcagcagcatcagcagtgatgtgagcagcagcacagaccacacccccaccaaggcccagaagaatgtggccaccagcgaggacagcgacctgtccatgaggaccctgagcacccccagccctgccctgatctgcccccccaacctgcccggcttccagaatggccggggcagcagcaccagcagcagcagcatcactggagagaccgtggccatggtgcacagccccccacccacccggctgacccaccccctcatccggctggccagccggccccagaaggagcaggccagcattgaccggctgcctgaccacagcatggtgcagatcttctccttcctgcccaccaaccagctgtgccgctgtgcccgggtgtgccgccgctggtacaacctggcctgggacccccggctgtggaggaccatccggctgaccggggagaccatcaacgtggaccgggccctgaaggtgctgacccggcggctgtgccaggacaccccaaatgtgtgcctgatgctggagaccgtgacagtgtctggctgccggcggctgacagaccggggcctgtacaccatcgcccagtgctgcccagagctgcggcggctggaggtgtctggctgctacaacatcagcaatgaagctgtgtttgatgtggtgtccctgtgccccaacctggagcacctggatgtgtctggctgcagcaaggtgacctgcatcagcctgacccgggaggccagcatcaagctgagccccctgcacggcaagcagatcagcatccgctacctggacatgacagactgctttgtgctggaggatgagggcctgcacaccatcgccgcccactgcacccagctgacccacctgtacctgcggcgctgtgtgcggctgacagatgagggcctgcgctacctggtgatctactgtgccagcatcaaggagctgtctgtgtctgactgccgctttgtgtctgactttggcctgcgggagatcgccaagctggagagccggctgcgctacctgagcatcgcccactgcggccgggtgacagatgtgggcatccgctacgtggccaagtactgcagcaagctgcgctacctgaatgcccggggctgtgagggcatcacagaccacggcgtggagtacctggccaagaactgcaccaagctgaagagcctggacattggaaaatgtcccctggtgtctgacaccggcctggagtgcctggccctgaactgcttcaacctgaagaggctgagcctgaagagctgtgagagcatcaccggccagggcctgcagatcgtggccgccaactgctttgacctgcagaccctgaatgtgcaggactgtgaggtgtctgtggaggccctgcgctttgtgaagaggcactgcaagagatgtgtgattgagcacaccaacccagccttcttctag

SEQ ID NO: 152160 - DNA, 1476 bp, Artificial Sequence
  Description of Artificial Sequence: Synthetic coding sequence
atgggcgccaacaacgggaagcagtatggcagcgagggcaagggcagcagcagcatcagcagtgatgtgagcagcagcacagaccacacccccaccaaggcccagaagaatgtggccaccagcgaggacagcgacctgtccatgaggaccctgagcacccccagccctgccctgatctgcccccccaacctgcccggcttccagaatggccggggcagcagcaccagcagcagcagcatcactggagagaccgtggccatggtgcacagccccccacccacccggctgacccaccccctcatccggctggccagccggccccagaaggagcaggccagcattgaccggctgcctgaccacagcatggtgcagatcttctccttcctgcccaccaaccagctgtgccgctgtgcccgggtgtgccgccgctggtacaacctggcctgggacccccggctgtggaggaccatccggctgaccggggagaccatcaacgtggaccgggccctgaaggtgctgacccggcggctgtgccaggacaccccaaatgtgtgcctgatgctggagaccgtgacagtgtctggctgccggcggctgacagaccggggcctgtacaccatcgcccagtgctgcccagagctgcggcggctggaggtgtctggctgctacaacatcagcaatgaagctgtgtttgatgtggtgtccctgtgccccaacctggagcacctggatgtgtctggctgcagcaaggtgacctgcatcagcctgacccgggaggccagcatcaagctgagccccctgcacggcaagcagatcagcatccgctacctggacatgacagactgctttgtgctggaggatgagggcctgcacaccatcgccgcccactgcacccagctgacccacctgtacctgcggcgctgtgtgcggctgacagatgagggcctgcgctacctggtgatctactgtgccagcatcaaggagctgtctgtgtctgactgccgctttgtgtctgactttggcctgcgggagatcgccaagctggagagccggctgcgctacctgagcatcgcccactgcggccgggtgacagatgtgggcatccgctacgtggccaagtactgcagcaagctgcgctacctgaatgcccggggctgtgagggcatcacagaccacggcgtggagtacctggccaagaactgcaccaagctgaagagcctggacattggaaaatgtcccctggtgtctgacaccggcctggagtgcctggccctgaactgcttcaacctgaagaggctgagcctgaagagctgtgagagcatcaccggccagggcctgcagatcgtggccgccaactgctttgacctgcagaccctgaatgtgcaggactgtgaggtgtctgtggaggccctgcgctttgtgaagaggcactgcaagagatgtgtgattgagcacaccaacccagccttcttctag

SEQ ID NO: 152161 - DNA, 3000 bp, Artificial Sequence
  Description of Artificial Sequence: Synthetic coding sequence
atggagaacctggagagccggctgaagaatgccccctacttccgctgtgagaagggcacagacagcatccccctgtgcaggaaatgtgagacctgtgtgctggcctggaagatcttcagcaccaaggagtggttctgccgcatcaatgacatcagccagaggcgcttcctggtgggcatcctgaagcagctgaacagcctgtacctgctgcactacttccagaacatcctgcagaccacccagggcaaggacttcatctacaacagaagccgcatcaacctgagcaagaaggagggcaaggtggtgaagagcagcctgaaccagatgctggacaagacagtggagcagaagatgaaggagatcctgtactggtttgccaacagcacccagtggaccaaggccaactacaccctgctgctgctgcagatgtgcaaccccaagctgctgctgacagctgccaacgtcatccgggtgctcttcctgcgggaggagaacaacatcagcggcctgaaccaggacatcacagatgtgtgcttcagccctgagaaggaccacagcagcaagagcgccaccagccaggtgtactggacagccaagacccagcacaccagcctgcccctgagcaaggccccagaaaatgagcacctgctgggcgccgccagcaaccctgaggagccctggaggaacagcctgcgctgcatcagcgagatgaacagactcttcagcggcaagggggacatcaccaagccaggctatgacccctgcaacctgctggtggacctggatgacatccgggacctgagcagcggcttcagcaagtacagagacttcatccgctacctgcccatccacctgagcaagtacatcctgaggatgctggacagacacaccctgaacaagtgtgcctctgtgtcccagcactgggccgccatggcccagcaggtgaagatggacctgagcgcccacggcttcatccagaaccagatcaccttcctgcagggcagctacacccggggcatcgaccccaactatgccaacaaggtgtccatccctgtgcccaagatggtggatgatggcaagtccatgagggtgaagcaccccaagtggaagctgcggaccaagaatgagtacaacctgtggacagcctaccagaatgaggagacccagcaggtgctgattgaggagagaaatgtgttctgtggcacctacaacgtgcgcatcctgagtgacacctgggaccagaacagagtcatccactacagcggcggggacctgattgctgtgagcagcaacaggaagatccacctgctggacatcatccaggtgaaggccatccctgtggagttccggggccatgctggctctgtgcgggccctcttcctgtgtgaggaggagaacttcctgctgagcggcagctatgacctgagcatccgctactgggacctgaagagcggcgtgtgcacccgcatctttggaggccaccagggcaccatcacctgcatggacctgtgcaagaaccggctggtgtctgggggccgggactgccaggtgaaggtgtgggatgtggacaccgggaagtgcctgaagaccttccgccacaaggaccccatcctggccacccgcatcaatgacacctacatcgtgagcagctgtgagcggggcctggtgaaggtgtggcacatcgccatggcccagctggtgaagaccctgagcggccatgaaggagctgtgaagtgcctcttctttgaccagtggcacctgctgagcggcagcacagatggcctggtgatggcctggagcatggtgggcaagtatgagcgctgcctgatggccttcaagcaccccaagatggtggtgaacacagagagcaatgtgctgatgttccagtttgagcacatcaagtggcagtatgctgtggagaagaccaagcagaagaagaacaaggagaaggaggaggagaaggaggagaacagcctgatggagatcctgagcaagtgcaacatccaggtgcacagcccccgggagagcgtgagcagcaagcagaccgtcatccaggagctgctgcccgggaagccacccaagagccgggtgctgctgaagccagccaagttcagcagcgctgtgctgattgaggagctgcagagccagggcaagagcaagagccccaggagagatgctgatgatgtggagaaggcccagaagcagggccagctggagaccccaggcaagctgcccagccaccccaagaagaagtcctggaagatccccatgagcccagaccagttcctgctgactgtgtctgccctgcagcacgcccacaacagcggggagtttgcctacccctgccggccccagacagagatcacagatgtgtggggccccagcatctcctaccccaggaaggtgctgaacttcaagggcaagagcatccagagagctgtggaccggctgcggctgagcaacccccccattgatgtgaagaggaccagcatccccctggagatccagaagctgcagcccaacctgaagatcagcctgcacagcccccgggtgcagagcaccatcccccagcccatgatcatccgcagccgcttcagcggcagcctgaagggcggggaccaggtgaccagcagcattgaaagagctgtgtgcagcacaggccccctgacctccatgcaggtgatcaagcccaacaggatgctggccccccaggtgggcacagccaccctgagcctgaagaaggagcggccccgcatctacacagccctggaccccttccgggtgaacacagaatttgtgctgctgactgtgaaggaggagaaggagcaccaggaggccaagatgaaggagtaccaggcccgggagagcactggagtggtggaccccgggaaggtgtccaaggccgcctggatcaggaagatcaagggcctgcccatcgacaacttcaccaagcagggcaagacagctgcccctgagctgggccagaatgtgttcatctag

SEQ ID NO: 152162 - DNA, 3186 bp, Artificial Sequence
  Description of Artificial Sequence: Synthetic coding sequence
atggagaacctggagagccggctgaagaatgccccctacttccgctgtgagaagggcacagacagcatccccctgtgcaggaaatgtgagacctgtgtgctggcctggaagatcttcagcaccaaggagtggttctgccgcatcaatgacatcagccagaggcgcttcctggtgggcatcctgaagcagctgaacagcctgtacctgctgcactacttccagaacatcctgcagaccacccagggcaaggacttcatctacaacagaagccgcatcaacctgagcaagaaggagggcaaggtggtgaagagcagcctgaaccagatgctggacaagacagtggagcagaagatgaaggagatcctgtactggtttgccaacagcacccagtggaccaaggccaactacaccctgctgctgctgcagatgtgcaaccccaagctgctgctgacagctgccaacgtcatccgggtgctcttcctgcgggaggagaacaacatcagcggcctgaaccaggacatcacagatgtgtgcttcagccctgagaaggaccacagcagcaagagcgccaccagccaggtgtactggacagccaagacccagcacaccagcctgcccctgagcaaggccccagaaaatgagcacctgctgggcgccgccagcaaccctgaggagccctggaggaacagcctgcgctgcatcagcgagatgaacagactcttcagcggcaagggggacatcaccaagccaggctatgacccctgcaacctgctggtggacctggatgacatccgggacctgagcagcggcttcagcaagtacagagacttcatccgctacctgcccatccacctgagcaagtacatcctgtccatgctgggctgcatgaggggcttccccaggcacctgcccagctggcccagcagtggagtgtctggcagcatcttcttcttccctggcatgctggacagacacaccctgaacaagtgtgcctctgtgtcccagcactgggccgccatggcccagcaggtgaagatggacctgagcgcccacggcttcatccagaaccagatcaccttcctgcagggcagctacacccggggcatcgaccccaactatgccaacaaggtgtccatccctgtgcccaagatggtggatgatggcaagtccatgagggtgaagcaccccaagtggaagctgcggaccaagaatgagtacaacctgtggacagcctaccagaatgaggagacccagcaggtgctgattgaggagagaaatgtgttctgtggcacctacaacgtgcgcatcctgagtgacacctgggaccagaacagagtcatccactacagcggcggggacctgattgctgtgagcagcaacaggaagatccacctgctggacatcatccaggtgaaggccatccctgtggagttccggggccacgccggctctgtgcgggccctcttcctgtgtgaggaggagaacttcctgctgagcggcagctatgacctgagcatccgctactgggacctgaagtctggagtgtgcacccgcatctttggaggccaccagggcaccatcacctgcatggacctgtgcaagaaccggctggtgtctgggggccgggactgccaggtgaaggtgtgggatgtggacaccgggaagtgcctgaagaccttccgccacaaggaccccatcctggccacccgcatcaatgacacctacatcgtgagcagctgtgagcggggcctggtgaaggtgtggcacatcgccatggcccagctggtgaagaccctgagcggccacgagggcgctgtgaagtgcctcttctttgaccagtggcacctgctgagcggcagcacagatggcctggtgatggcctggagcatggtgggcaagtatgagcgctgcctgatggccttcaagcaccccaaggaggtgctggatgtgtccctgctcttcctgcgggtcatcagcgcctgtgctgatggcaagatccgcatctacaacttcctgaatggaaactgcatgaaggtgctgaaggccaacggccgcggggaccctgtgctgtccttcttcatccagggcaacaggatggtggtgaacacagagagcaatgtgctgatgttccagtttgagcacatcaagtggcagtatgctgtggagaagaccaagcagaagaagaacaaggagaaggaggaggagaaggaggagaacagcctgatggagatcctgagcaagtgcaacatccaggtgcacagcccccgggagagcgtgagcagcaagcagaccgtcatccaggagctgctgcccgggaagccacccaagagccgggtgctgctgaagccagccaagttcagcagtgatgatgtggagaaggcccagaagcagggccagctggagaccccaggcaagctgcccagccaccccaagaagaagtcctggaagatccccatgagcccagaccagttcctgctgactgtgtctgccctgcagcacgcccacaacagcggggagtttgcctacccctgccggccccagacagagatcacagatgtgtggggccccagcatctcctaccccaggaaggtgctgaacttcaagggcaagagcatccagagagctgtggaccggctgcggctgagcaacccccccattgatgtgaagaggaccagcatccccctggagatccagaagctgcagcccaacctgaagatcagcctgcacagcccccgggtgcagagcaccatcccccagcccatgatcatccgcagccgcttcagcggcagcctgaagggcggggaccaggtgaccagcagcattgaaagagctgtgtgcagcacaggccccctgacctccatgcaggtgatcaagcccaacaggatgctggccccccaggtgggcacagccaccctgagcctgaagaaggagcggccccgcatctacacagccctggaccccttccgggtgaacacagaatttgtgctgctgactgtgaaggaggagaaggagcaccaggaggccaagatgaaggagtaccaggcccgggagagcactggagtggtggaccccgggaaggtgtccaaggccgcctggatcaggaagatcaagggcctgcccatcgacaacttcaccaagcagggcaagacagctgcccctgagctgggccagaatgtgttcatctag

SEQ ID NO: 152163 - DNA, 3159 bp, Artificial Sequence
  Description of Artificial Sequence: Synthetic coding sequence
atggagaacctggagagccggctgaagaatgccccctacttccgctgtgagaagggcacagacagcatccccctgtgcaggaaatgtgagacctgtgtgctggcctggaagatcttcagcaccaaggagtggttctgccgcatcaatgacatcagccagaggcgcttcctggtgggcatcctgaagcagctgaacagcctgtacctgctgcactacttccagaacatcctgcagaccacccagggcaaggacttcatctacaacagaagccgcatcaacctgagcaagaaggagggcaaggtggtgaagagcagcctgaaccagatgctggacaagacagtggagcagaagatgaaggagatcctgtactggtttgccaacagcacccagtggaccaaggccaactacaccctgctgctgctgcagatgtgcaaccccaagctgctgctgacagctgccaacgtcatccgggtgctcttcctgcgggaggagaacaacatcagcggcctgaaccaggacatcacagatgtgtgcttcagccctgagaaggaccacagcagcaagagcgccaccagccaggtgtactggacagccaagacccagcacaccagcctgcccctgagcaaggccccagaaaatgagcacctgctgggcgccgccagcaaccctgaggagccctggaggaacagcctgcgctgcatcagcgagatgaacagactcttcagcggcaagggggacatcaccaagccaggctatgacccctgcaacctgctggtggacctggatgacatccgggacctgagcagcggcttcagcaagtacagagacttcatccgctacctgcccatccacctgagcaagtacatcctgaggatgctggacagacacaccctgaacaagtgtgcctctgtgtcccagcactgggccgccatggcccagcaggtgaagatggacctgagcgcccacggcttcatccagaaccagatcaccttcctgcagggcagctacacccggggcatcgaccccaactatgccaacaaggtgtccatccctgtgcccaagatggtggatgatggcaagtccatgagggtgaagcaccccaagtggaagctgcggaccaagaatgagtacaacctgtggacagcctaccagaatgaggagacccagcaggtgctgattgaggagagaaatgtgttctgtggcacctacaacgtgcgcatcctgagtgacacctgggaccagaacagagtcatccactacagcggcggggacctgattgctgtgagcagcaacaggaagatccacctgctggacatcatccaggtgaaggccatccctgtggagttccggggccatgctggctctgtgcgggccctcttcctgtgtgaggaggagaacttcctgctgagcggcagctatgacctgagcatccgctactgggacctgaagagcggcgtgtgcacccgcatctttggaggccaccagggcaccatcacctgcatggacctgtgcaagaaccggctggtgtctgggggccgggactgccaggtgaaggtgtgggatgtggacaccgggaagtgcctgaagaccttccgccacaaggaccccatcctggccacccgcatcaatgacacctacatcgtgagcagctgtgagcggggcctggtgaaggtgtggcacatcgccatggcccagctggtgaagaccctgagcggccatgaaggagctgtgaagtgcctcttctttgaccagtggcacctgctgagcggcagcacagatggcctggtgatggcctggagcatggtgggcaagtatgagcgctgcctgatggccttcaagcaccccaaggaggtgctggatgtgtccctgctcttcctgcgggtcatcagcgcctgtgctgatggcaagatccgcatctacaacttcctgaatggaaactgcatgaaggtgctgaaggccaacggccgcggggaccctgtgctgtccttcttcatccagggcaacaggatggtggtgaacacagagagcaatgtgctgatgttccagtttgagcacatcaagtggcagtatgctgtggagaagaccaagcagaagaagaacaaggagaaggaggaggagaaggaggagaacagcctgatggagatcctgagcaagtgcaacatccaggtgcacagcccccgggagagcgtgagcagcaagcagaccgtcatccaggagctgctgcccgggaagccacccaagagccgggtgctgctgaagccagccaagttcagcagcgctgtgctgattgaggagctgcagagccagggcaagagcaagagccccaggagagatgctgatgatgtggagaaggcccagaagcagggccagctggagacccctgggaagctgcccagccaccccaagaagaagtcctggaagatccccatgagcccagaccagttcctgctgactgtgtctgccctgcagcacgcccacaacagcggggagtttgcctacccctgccggccccagacagagatcacagatgtgtggggccccagcatctcctaccccaggaaggtgctgaacttcaagggcaagagcatccagagagctgtggaccggctgcggctgagcaacccccccattgatgtgaagaggaccagcatccccctggagatccagaagctgcagcccaacctgaagatcagcctgcacagcccccgggtgcagagcaccatcccccagcccatgatcatccgcagccgcttcagcggcagcctgaagggcggggaccaggtgaccagcagcattgaaagagctgtgtgcagcacaggccccctgacctccatgcaggtgatcaagcccaacaggatgctggccccccaggtgggcacagccaccctgagcctgaagaaggagcggccccgcatctacacagccctggaccccttccgggtgaacacagaatttgtgctgctgactgtgaaggaggagaaggagcaccaggaggccaagatgaaggagtaccaggcccgggagagcactggagtggtggaccccgggaaggtgtccaaggccgcctggatcaggaagatcaagggcctgcccatcgacaacttcaccaagcagggcaagacagctgcccctgagctgggccagaatgtgttcatctag

SEQ ID NO: 152164 - DNA, 3156 bp, Artificial Sequence
  Description of Artificial Sequence: Synthetic coding sequence
atggagaacctggagagccggctgaagaatgccccctacttccgctgtgagaagggcacagacagcatccccctgtgcaggaaatgtgagacctgtgtgctggcctggaagatcttcagcaccaaggagtggttctgccgcatcaatgacatcagccagaggcgcttcctggtgggcatcctgaagcagctgaacagcctgtacctgctgcactacttccagaacatcctgcagaccacccagggcaaggacttcatctacaacagaagccgcatcaacctgagcaagaaggagggcaaggtggtgaagagcagcctgaaccagatgctggacaagacagtggagcagaagatgaaggagatcctgtactggtttgccaacagcacccagtggaccaaggccaactacaccctgctgctgctgcagatgtgcaaccccaagctgctgctgacagctgccaacgtcatccgggtgctcttcctgcgggaggagaacaacatcagcggcctgaaccaggacatcacagatgtgtgcttcagccctgagaaggaccacagcagcaagagcgccaccagccaggtgtactggacagccaagacccagcacaccagcctgcccctgagcaaggccccagaaaatgagcacctgctgggcgccgccagcaaccctgaggagccctggaggaacagcctgcgctgcatcagcgagatgaacagactcttcagcggcaagggggacatcaccaagccaggctatgacccctgcaacctgctggtggacctggatgacatccgggacctgagcagcggcttcagcaagtacagagacttcatccgctacctgcccatccacctgagcaagtacatcctgaggatgctggacagacacaccctgaacaagtgtgcctctgtgtcccagcactgggccgccatggcccagcaggtgaagatggacctgagcgcccacggcttcatccagaaccagatcaccttcctgcagggcagctacacccggggcatcgaccccaactatgccaacaaggtgtccatccctgtgcccaagatggtggatgatggcaagtccatgagggtgaagcaccccaagtggaagctgcggaccaagaatgagtacaacctgtggacagcctaccagaatgaggagacccagcaggtgctgattgaggagagaaatgtgttctgtggcacctacaacgtgcgcatcctgagtgacacctgggaccagaacagagtcatccactacagcggcggggacctgattgctgtgagcagcaacaggaagatccacctgctggacatcatccaggtgaaggccatccctgtggagttccggggccatgctggctctgtgcgggccctcttcctgtgtgaggaggagaacttcctgctgagcggcagctatgacctgagcatccgctactgggacctgaagagcggcgtgtgcacccgcatctttggaggccaccagggcaccatcacctgcatggacctgtgcaagaaccggctggtgtctgggggccgggactgccaggtgaaggtgtgggatgtggacaccgggaagtgcctgaagaccttccgccacaaggaccccatcctggccacccgcatcaatgacacctacatcgtgagcagctgtgagcggggcctggtgaaggtgtggcacatcgccatggcccagctggtgaagaccctgagcggccatgaaggagctgtgaagtgcctcttctttgaccagtggcacctgctgagcggcagcacagatggcctggtgatggcctggagcatggtgggcaagtatgagcgctgcctgatggccttcaagcaccccaaggaggtgctggatgtgtccctgctcttcctgcgggtcatcagcgcctgtgctgatggcaagatccgcatctacaacttcctgaatggaaactgcatgaaggtgctgaaggccaacggccgcggggaccctgtgctgtccttcttcatccagggcaacaggatggtggtgaacacagagagcaatgtgctgatgttccagtttgagcacatcaagtggcagtatgctgtggagaagaccaagcagaagaagaacaaggagaaggaggaggagaaggaggagaacagcctgatggagatcctgagcaagtgcaacatccaggtgcacagcccccgggagagcgtgagcagcaagcagaccgtcatccaggagctgctgcccgggaagccacccaagagccgggtgctgctgaagccagccaagttcagcagcgctgtgctgattgaggagctgcagagccagggcaagagcaagagccccaggagagatgatgatgtggagaaggcccagaagcagggccagctggagaccccaggcaagctgcccagccaccccaagaagaagtcctggaagatccccatgagcccagaccagttcctgctgactgtgtctgccctgcagcacgcccacaacagcggggagtttgcctacccctgccggccccagacagagatcacagatgtgtggggccccagcatctcctaccccaggaaggtgctgaacttcaagggcaagagcatccagagagctgtggaccggctgcggctgagcaacccccccattgatgtgaagaggaccagcatccccctggagatccagaagctgcagcccaacctgaagatcagcctgcacagcccccgggtgcagagcaccatcccccagcccatgatcatccgcagccgcttcagcggcagcctgaagggcggggaccaggtgaccagcagcattgaaagagctgtgtgcagcacaggccccctgacctccatgcaggtgatcaagcccaacaggatgctggccccccaggtgggcacagccaccctgagcctgaagaaggagcggccccgcatctacacagccctggaccccttccgggtgaacacagaatttgtgctgctgactgtgaaggaggagaaggagcaccaggaggccaagatgaaggagtaccaggcccgggagagcactggagtggtggaccccgggaaggtgtccaaggccgcctggatcaggaagatcaagggcctgcccatcgacaacttcaccaagcagggcaagacagctgcccctgagctgggccagaatgtgttcatctag

SEQ ID NO: 152165 - DNA, 1629 bp, Artificial Sequence
  Description of Artificial Sequence: Synthetic coding sequence
atggagccagattctgtgattgaggacaagaccatcgagctgatgtgcagcgtgcccaggagcctgtggctgggctgtgccaacctggtggagagcatgtgtgccctgagctgcctgcagagcatgcccagcgtgcgctgcctgcagatcagcaatggcaccagcagcgtcatcgtgtccaggaagaggccttctgagggcaactaccagaaggagaaggacctgtgcatcaagtactttgaccagtggagcgagagtgaccaggtggagtttgtggagcacctgatcagcaggatgtgccactaccagcacggccacatcaacagctacctgaagcccatgctgcagagggacttcatcacagccctgcctgagcagggcctggaccacatcgccgagaacatcctgagctacctggatgcccggagcctgtgtgccgctgagctggtgtgcaaggagtggcagagggtcatcagcgagggcatgctgtggaagaagctgattgaaagaatggtgaggacagaccccctgtggaagggcctgtctgagcggcggggctgggaccagtacctgttcaagaaccggcccacagatggcccccccaacagcttctaccgcagcctgtaccccaagatcatccaggacatcgagaccatcgagagcaactggaggtgtggccgccacaacctgcagaggatccagtgccgctctgagaacagcaaaggagtgtactgcctgcagtatgatgatgagaagatcatcagcggcctgcgggacaacagcatcaagatctgggacaagaccagcctggagtgcctgaaggtgctgaccggccacacaggctctgtgctgtgcctgcagtatgatgagcgggtgattgtgacaggcagcagtgacagcacagtgcgggtgtgggatgtgaacacaggagaggtgctgaacaccctcatccaccacaatgaggccgtgctgcacctgcgcttcagcaatggcctgatggtgacctgcagcaaggacaggagcattgctgtgtgggacatggccagcgccacagacatcaccctgcggcgggtgctggtgggccacagagctgctgtgaatgtggtggactttgatgacaagtacatcgtgtctgccagcggggacaggaccatcaaggtgtggagcaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctgcaggccgccctggacccccgggccccagccagcaccctgtgcctgcggaccctggtggagcacagcggccgggtcttccggctgcagtttgatgagttccagatcatcagcagcagccatgatgacaccatcctgatctgggacttcctgaatgtgcccccatctgcccagaatgagaccaggagccccagcaggacctacacctacatcagcaggtag

SEQ ID NO: 152166 - DNA, 1590 bp, Artificial Sequence
  Description of Artificial Sequence: Synthetic coding sequence
atggagccagattctgtgattgaggacaagaccatcgagctgatgaacacctctgtgatggaggaccagaatgaagatgagagccccaagaagaacaccctgtggcagatcagcaatggcaccagctctgtgattgtgtccaggaagaggcccagcgagggcaactaccagaaggagaaggacctgtgcatcaagtactttgaccagtggagcgagagtgaccaggtggagtttgtggagcacctgatcagcaggatgtgccactaccagcacggccacatcaacagctacctgaagcccatgctgcagagggacttcatcacagccctgcctgagcagggcctggaccacatcgccgagaacatcctgagctacctggatgcccggagcctgtgtgccgctgagctggtgtgcaaggagtggcagagggtcatcagcgagggcatgctgtggaagaagctgattgaaagaatggtgaggacagaccccctgtggaagggcctgtctgaaagaagaggctgggaccagtacctgttcaagaaccggcccacagatggcccccccaacagcttctaccgcagcctgtaccccaagatcatccaggacatcgagaccatcgagagcaactggaggtgtggccgccacaacctgcagaggatccagtgccgctctgagaacagcaagggcgtgtactgcctgcagtatgatgatgagaagatcatcagcggcctgcgggacaacagcatcaagatctgggacaagaccagcctggagtgcctgaaggtgctgaccggccacactggatctgtgctgtgcctgcagtatgatgagagggtcatcgtgacaggcagcagtgacagcacagtgcgggtgtgggatgtgaacacaggagaggtgctgaacaccctcatccaccacaatgaagctgtgctgcacctgcgcttcagcaatggcctgatggtgacctgcagcaaggacaggagcattgctgtgtgggacatggccagcgccacagacatcaccctgcggcgggtgctggtgggccacagagctgctgtgaatgtggtggactttgatgacaagtacatcgtgtctgccagcggggacaggaccatcaaggtgtggagcaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctgcaggccgccctggacccccgggccccagccagcaccctgtgcctgcggaccctggtggagcacagcggccgggtcttccggctgcagtttgatgagttccagatcatcagcagcagccatgatgacaccatcctgatctgggacttcctgaatgtgccccccagcgcccagaatgagaccaggagccccagcaggacctacacctacatcagcaggtag

SEQ ID NO: 152167 - DNA, 1527 bp, Artificial Sequence
  Description of Artificial Sequence: Synthetic coding sequence
atggagccagattctgtgattgaggacaagaccatcgagctgatgatcagcaatggcaccagcagcgtcatcgtgtccaggaagaggccttctgagggcaactaccagaaggagaaggacctgtgcatcaagtactttgaccagtggagcgagagtgaccaggtggagtttgtggagcacctgatcagcaggatgtgccactaccagcacggccacatcaacagctacctgaagcccatgctgcagagggacttcatcacagccctgcctgagcagggcctggaccacatcgccgagaacatcctgagctacctggatgcccggagcctgtgtgccgctgagctggtgtgcaaggagtggcagagggtcatcagcgagggcatgctgtggaagaagctgattgaaagaatggtgaggacagaccccctgtggaagggcctgtctgagcggcggggctgggaccagtacctgttcaagaaccggcccacagatggcccccccaacagcttctaccgcagcctgtaccccaagatcatccaggacatcgagaccatcgagagcaactggaggtgtggccgccacaacctgcagaggatccagtgccgctctgagaacagcaaaggagtgtactgcctgcagtatgatgatgagaagatcatcagcggcctgcgggacaacagcatcaagatctgggacaagaccagcctggagtgcctgaaggtgctgaccggccacacaggctctgtgctgtgcctgcagtatgatgagcgggtgattgtgacaggcagcagtgacagcacagtgcgggtgtgggatgtgaacacaggagaggtgctgaacaccctcatccaccacaatgaggccgtgctgcacctgcgcttcagcaatggcctgatggtgacctgcagcaaggacaggagcattgctgtgtgggacatggccagcgccacagacatcaccctgcggcgggtgctggtgggccacagagctgctgtgaatgtggtggactttgatgacaagtacatcgtgtctgccagcggggacaggaccatcaaggtgtggagcaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctgcaggccgccctggacccccgggccccagccagcaccctgtgcctgcggaccctggtggagcacagcggccgggtcttccggctgcagtttgatgagttccagatcatcagcagcagccatgatgacaccatcctgatctgggacttcctgaatgtgcccccatctgcccagaatgagaccaggagccccagcaggacctacacctacatcagcaggtag

SEQ ID NO: 152168 - DNA, 1533 bp, Artificial Sequence
  Description of Artificial Sequence: Synthetic coding sequence
atggaggaccagaatgaagatgagagccccaagaagaacaccctgtggcagatcagcaatggcaccagcagcgtcatcgtgtccaggaagaggccttctgagggcaactaccagaaggagaaggacctgtgcatcaagtactttgaccagtggagcgagagtgaccaggtggagtttgtggagcacctgatcagcaggatgtgccactaccagcacggccacatcaacagctacctgaagcccatgctgcagagggacttcatcacagccctgcctgagcagggcctggaccacatcgccgagaacatcctgagctacctggatgcccggagcctgtgtgccgctgagctggtgtgcaaggagtggcagagggtcatcagcgagggcatgctgtggaagaagctgattgaaagaatggtgaggacagaccccctgtggaagggcctgtctgagcggcggggctgggaccagtacctgttcaagaaccggcccacagatggcccccccaacagcttctaccgcagcctgtaccccaagatcatccaggacatcgagaccatcgagagcaactggaggtgtggccgccacaacctgcagaggatccagtgccgctctgagaacagcaaaggagtgtactgcctgcagtatgatgatgagaagatcatcagcggcctgcgggacaacagcatcaagatctgggacaagaccagcctggagtgcctgaaggtgctgaccggccacacaggctctgtgctgtgcctgcagtatgatgagcgggtgattgtgacaggcagcagtgacagcacagtgcgggtgtgggatgtgaacacaggagaggtgctgaacaccctcatccaccacaatgaggccgtgctgcacctgcgcttcagcaatggcctgatggtgacctgcagcaaggacaggagcattgctgtgtgggacatggccagcgccacagacatcaccctgcggcgggtgctggtgggccacagagctgctgtgaatgtggtggactttgatgacaagtacatcgtgtctgccagcggggacaggaccatcaaggtgtggagcaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctgcaggccgccctggacccccgggccccagccagcaccctgtgcctgcggaccctggtggagcacagcggccgggtcttccggctgcagtttgatgagttccagatcatcagcagcagccatgatgacaccatcctgatctgggacttcctgaatgtgcccccatctgcccagaatgagaccaggagccccagcaggacctacacctacatcagcaggtag

SEQ ID NO: 152169 - DNA, 1395 bp, Artificial Sequence
  Description of Artificial Sequence: Synthetic coding sequence
atggagatccggctgcctgacctggccctgaagaggatcttctccttcctggacctgtttggcctgctgcaggtgtcccaggtgaacaagcactggaacagaattgctgacagcgactacctgtggaggagcctgagcctgcagcgctgggactgcagcaacttcaccaaccagcacctgggcacccacacctggaagcagttcttcctgcaccagaggaggaaggagctgcggctggccctggcccagccccacaacttcatctacaaggtgaccaagaacatcgcctttgaaacagagctggcctacctgagcggcaaccggctgactgtggatgagcaggagaagagcatcatctgcagcgtgagccccaagcaggagctgtgtgcctgggatgtgcaggagggcaccatgatctggagcagccctgtgcaggagttccacttcagcaacctggtgaccctgccccagatgcacctggccatcaccatggacaggaagaagaccatcaaggtgtggaactgccaggacagagatgccctggccgtgctgcccatgccccagccctgctactgcatggaggcctacctgaccaaggatggccccttcctgatggtgggagatgctgctggggacatctacaccttcaccctgcccggcctgagagatgtgtccaaggtgacagccttccagtatggcatcgtgctgctgcactgcagcccagacaagaagtgggtgtttgcctgtggcacctacagcaggaccctgccccaggtgttcctgacagagagcctgctgcggcccagcgagggctctgtgcccctgagcaccttcctgccccacaagctgtgtgccagcgcctgctggacccccaaggtgaagaaccgcatcaccctgatgagccagagcagcacaggcaagaagacagagttcatcacctttgacctgaccaccaagaagacaggaggccagaccgtcatccaggcctatgagatcgccagcttccaggtggccgcccacctgaagtgccccatctggatgggcgccagtgatggctacatgattgtgttcaccagcggcccctacctgctgctcttcagcatcaccggcttcctgctgcagagatttgaggaccaccaggccgccatcaacaacttctgggtggacccctgctacgtgctgaccaccagcgagaacagcgtgcacgtgtacatgtgggaggagggcggccgccacccctacctgcggagctgctgccacctggagaacacctggcatgaccacaccacagacagctgcatcagctctgtgatgtgtgacaatgccagcatcgtgctgcgggtgaggaaggtgtctgacagcagcatcctggtgatgtacagcctgaacacctag

SEQ ID NO: 152170 - DNA, 1092 bp, Artificial Sequence
  Description of Artificial Sequence: Synthetic coding sequence
atgctggccctgagagatgagccccacagcccagacagccgcagccaggcctttgaaacagagctggcctacctgagcggcaaccggctgactgtggatgagcaggagaagagcatcatctgcagcgtgagccccaagcaggagctgtgtgcctgggatgtgcaggagatgcacctggccatcaccatggacaggaagaagaccatcaaggtgtggaactgccaggacagagatgccctggccgtgctgcccatgccccagccctgctactgcatggaggcctacctgaccaaggatggccccttcctgatggtgggagatgctgctggggacatctacaccttcaccctgcccggcctgagagatgtgtccaaggtgacagccttccagtatggaattgtgctgctgcactgcagcccagacaagaagtgggtgtttgcctgtggcacctacagcaggaccctgccccaggtgttcctgacagagagcctgctgcggcccagcgagggctctgtgcccctgagcaccttcctgccccacaagctgtgtgccagcgcctgctggacccccaaggtgaagaaccgcatcaccctgatgagccagagcagcacaggcaagaagacagagttcatcacctttgacctgaccaccaagaagacaggaggccagaccgtcatccaggcctatgaaattgccagcttccaggtggccgcccacctgaagtgccccatctggatgggcgccagtgatggctacatgattgtgttcaccagcggcccctacctgctgctcttcagcatcaccggcttcctgctgcagagatttgaggaccaccaggccgccatcaacaacttctgggtggacccctgctacgtgctgaccaccagtgaaaattctgtgcacgtgtacatgtgggaggagggcggccgccacccctacctgcggagctgctgccacctggagaacacctggcatgaccacaccacagacagctgcatcagctctgtgatgtgtgacaatgccagcatcgtgctgcgggtgaggaaggtgtctgacagcagcatcctggtgatgtacagcctgaacacctag

SEQ ID NO: 152171 - DNA, 1185 bp, Artificial Sequence
  Description of Artificial Sequence: Synthetic coding sequence
atggagatccggctgcctgacctggccctgaagaggatcttctccttcctggacctgtttggcctgctgcaggtgtcccaggtgaacaagcactggaacagaattgctgacagcgactacctgtggaggagcctgagcctgcagcgctgggactgcagcaacttcaccaaccagcacctgggcacccacacctggaagcagttcttcctgcaccagaggaggaaggagctgcggctggccctggcccagccccacaacttcatctacaaggtgaccaagaacatcgcctttgaaacagagctggcctacctgagcggcaaccggctgactgtggatgagcaggagaagagcatcatctgcagcgtgagccccaagcaggagctgtgtgcctgggatgtgcaggaggtgggagatgctgctggggacatctacaccttcaccctgcccggcctgagagatgtgtccaaggtgacagccttccagtatggcatcgtgctgctgcactgcagcccagacaagaagtgggtgtttgcctgtggcacctacagcaggaccctgccccaggtgttcctgacagagagcctgctgcggcccagcgagggctctgtgcccctgagcaccttcctgccccacaagctgtgtgccagcgcctgctggacccccaaggtgaagaaccgcatcaccctgatgagccagagcagcacaggcaagaagacagagttcatcacctttgacctgaccaccaagaagacaggaggccagaccgtcatccaggcctatgagatcgccagcttccaggtggccgcccacctgaagtgccccatctggatgggcgccagtgatggctacatgattgtgttcaccagcggcccctacctgctgctcttcagcatcaccggcttcctgctgcagagatttgaggaccaccaggccgccatcaacaacttctgggtggacccctgctacgtgctgaccaccagcgagaacagcgtgcacgtgtacatgtgggaggagggcggccgccacccctacctgcggagctgctgccacctggagaacacctggcatgaccacaccacagacagctgcatcagctctgtgatgtgtgacaatgccagcatcgtgctgcgggtgaggaaggtgtctgacagcagcatcctggtgatgtacagcctgaacacctag

SEQ ID NO: 152172 - DNA, 1338 bp, Artificial Sequence
  Description of Artificial Sequence: Synthetic coding sequence
atgagccccacccaccagatccaggaccccaagcactggaacagaattgctgacagcgactacctgtggaggagcctgagcctgcagcgctgggactgcagcaacttcaccaaccagcacctgggcacccacacctggaagcagttcttcctgcaccagaggaggaaggagctgcggctggccctggcccagccccacaacttcatctacaaggtgaccaagaacatcgcctttgaaacagagctggcctacctgagcggcaaccggctgactgtggatgagcaggagaagagcatcatctgcagcgtgagccccaagcaggagctgtgtgcctgggatgtgcaggagggcaccatgatctggagcagccctgtgcaggagttccacttcagcaacctggtgaccctgccccagatgcacctggccatcaccatggacaggaagaagaccatcaaggtgtggaactgccaggacagagatgccctggccgtgctgcccatgccccagccctgctactgcatggaggcctacctgaccaaggatggccccttcctgatggtgggagatgctgctggggacatctacaccttcaccctgcccggcctgagagatgtgtccaaggtgacagccttccagtatggaattgtgctgctgcactgcagcccagacaagaagtgggtgtttgcctgtggcacctacagcaggaccctgccccaggtgttcctgacagagagcctgctgcggcccagcgagggctctgtgcccctgagcaccttcctgccccacaagctgtgtgccagcgcctgctggacccccaaggtgaagaaccgcatcaccctgatgagccagagcagcacaggcaagaagacagagttcatcacctttgacctgaccaccaagaagacaggaggccagaccgtcatccaggcctatgaaattgccagcttccaggtggccgcccacctgaagtgccccatctggatgggcgccagtgatggctacatgattgtgttcaccagcggcccctacctgctgctcttcagcatcaccggcttcctgctgcagagatttgaggaccaccaggccgccatcaacaacttctgggtggacccctgctacgtgctgaccaccagtgaaaattctgtgcacgtgtacatgtgggaggagggcggccgccacccctacctgcggagctgctgccacctggagaacacctggcatgaccacaccacagacagctgcatcagctctgtgatgtgtgacaatgccagcatcgtgctgcgggtgaggaaggtgtctgacagcagcatcctggtgatgtacagcctgaacacctag

SEQ ID NO: 152173 - DNA, 1239 bp, Artificial Sequence
  Description of Artificial Sequence: Synthetic coding sequence
atggctgctgctgctggggaggaggaggaggaggaggaggccgcccgggagagcgctgcccggcctgctgctggccctgccctgtggaggctgcctgaggagctgctgctgctgatctgcagctacctggacatgagggccctgggccgcctggcccaggtgtgccgctggctgcggcgcttcaccagctgtgacctgctgtggaggagaattgcccgggccagcctgaacagcggcttcacccggctgggcacagacctgatgacctctgtgcctgtgaaggagcgggtgaaggtgtcccagaactggaggctgggccgctgccgggagggcatcctgctgaagtggcgctgccggcagatgccctggatgcagctggaggatgacagcctgtacatcagccaggccaacttcatcctggcctaccagttccggccagatggagccagcctgaacagaagacccctgggcgtgtttgctggccatgatgaagatgtgtgccactttgtgctggccaacagccacatcgtgtctgctggaggagatggcaagattggcatccacaagatccacagcaccttcaccgtgaagtacagcgcccacgagcaggaggtgaactgtgtggactgcaagggcggcatcatcgtgtctggcagccgggacagaacagccaaggtgtggcccctggccagcggccgcctgggccagtgcctgcacaccatccagacagaggacagagtgtggagcatcgccatcagccccctgctgagcagctttgtgactggaacagcctgctgcggccacttcagccccctgcgcatctgggacctgaacagcggccagctgatgacccacctgggcagtgacttccccccaggggccggcgtgctggatgtgatgtatgagagccccttcaccctgctgagctgtggctatgacacctacgtgcgctactgggacctgcggacctctgtgaggaaatgtgtgatggagtgggaggagccccatgacagcaccctgtactgcctgcagacagatggcaaccacctgctggccaccggcagcagctactacggcgtggtgcggctgtgggaccggcggcagagggcctgcctgcacgccttccccctgaccagcacccccctgagcagccctgtgtactgcctgcggctgaccaccaagcacctgtatgctgccctgagctacaacctgcacgtgctggacttccagaacccctag

SEQ ID NO: 152174 - DNA, 1239 bp, Artificial Sequence
  Description of Artificial Sequence: Synthetic coding sequence
atggctgctgctgctggggaggaggaggaggaggaggaggccgcccgggagagcgctgcccggcctgctgctggccctgccctgtggaggctgcctgaggagctgctgctgctgatctgcagctacctggacatgagggccctgggccgcctggcccaggtgtgccgctggctgcggcgcttcaccagctgtgacctgctgtggaggagaattgcccgggccagcctgaacagcggcttcacccggctgggcacagacctgatgacctctgtgcctgtgaaggagcgggtgaaggtgtcccagaactggaggctgggccgctgccgggagggcatcctgctgaagtggcgctgcagccagatgccctggatgcagctggaggatgacagcctgtacatcagccaggccaacttcatcctggcctaccagttccggccagatggagccagcctgaacagaagacccctgggcgtgtttgctggccatgatgaagatgtgtgccactttgtgctggccaacagccacatcgtgtctgctggaggagatggcaagattggcatccacaagatccacagcaccttcaccgtgaagtacagcgcccacgagcaggaggtgaactgtgtggactgcaagggcggcatcatcgtgtctggcagccgggacagaacagccaaggtgtggcccctggccagcggccgcctgggccagtgcctgcacaccatccagacagaggacagagtgtggagcatcgccatcagccccctgctgagcagctttgtgactggaacagcctgctgcggccacttcagccccctgcgcatctgggacctgaacagcggccagctgatgacccacctgggcagtgacttccccccaggggccggcgtgctggatgtgatgtatgagagccccttcaccctgctgagctgtggctatgacacctacgtgcgctactgggacctgcggacctctgtgaggaaatgtgtgatggagtgggaggagccccatgacagcaccctgtactgcctgcagacagatggcaaccacctgctggccaccggcagcagctactacggcgtggtgcggctgtgggaccggcggcagagggcctgcctgcacgccttccccctgaccagcacccccctgagcagccctgtgtactgcctgcggctgaccaccaagcacctgtatgctgccctgagctacaacctgcacgtgctggacttccagaacccctag

SEQ ID NO: 152175 - DNA, 639 bp, Artificial Sequence
  Description of Artificial Sequence: Synthetic coding sequence
atgagggccctgggccgcctggcccaggtgtgccgctggctgcggcgcttcaccagctgtgacctgctgtggaggagaattgcccgggccagcctgaacagcggcttcacccggctgggcacagacctgatgacctctgtgcctgtgaaggagcgggtgaaggtgtcccagaactggaggctgggccgctgccgggagggcatcctgctgaagtggcgctgccggcagatgccctggatgcagctggaggatgacagcctgtacatcagccaggccaacttcatcctggcctaccagttccggccagatggagccagcctgaacagaagacccctgggcgtgtttgctggccatgatgaagatgtgtgccactttgtgctggccaacagccacatcgtgtctgctggaggagatggcaagattggcatccacaagatccacagcaccttcaccgtgaagtacagcgcccacgagcaggaggtgaactgtgtggactgcaagggcggcatcatcgtgtctggcagccgggacagaacagccaaggtgtggcccctggccagcggccgcctgggccagtgcctgcacaccatccagacagaggacagagtgtggagcatcgccatcagccccctgctgtag

SEQ ID NO: 152176 - DNA, 576 bp, Artificial Sequence
  Description of Artificial Sequence: Synthetic coding sequence
atgacctctgtgcctgtgaaggagcgggtgaaggtgtcccagaactggaggctgggccgctgccgggagggcatcctgctgaagtggcgctgccggcagatgccctggatgcagctggaggatgacagcctgtacatcagccaggccaacttcatcctggcctaccagttccggccagatggagccagcctgaacagaagacccctgggcgtgtttgctggccatgatgaagatgtgtgccactttgtgctggccaacagccacatcgtgtctgctggaggagatggcaagattggcatccacaagatccacagcaccttcaccgtgaagtacagcgcccacgagcaggaggtgaactgtgtggactgcaagggcggcatcatcgtgtctggcagccgggacagaacagccaaggtgtggcccctggccagcggccgcctgggccagtgcctgcacaccatccagacagaagatagagtgtggagcatcgccatcagccccctgctgagcagctttgtgactggaacagcctgctgcggccacttcagccccctgcgcatctgggacctgaactag

SEQ ID NO: 152177 - DNA, 1884 bp, Artificial Sequence
  Description of Artificial Sequence: Synthetic coding sequence
atgtgtgtgcccaggagcggcctcatcctgagctgcatctgcctgtactgcggcgtgctgctgcctgtgctgctgcccaacctgcccttcctgacctgcctgtccatgagcaccctggagagcgtgacctacctgcctgagaagggcctgtactgccagaggctgcccagcagcaggacccatggaggaacagagagcctgaagggcaagaacacagagaacatgggcttctacggcaccctgaagatgatcttctacaagatgaagaggaagctggaccacggcagcgaggtgcgctccttcagcctgggcaagaagccctgcaaggtgtctgagtacaccagcaccaccggcctggtgccctgcagcgccacccccaccacctttggagacctgcgggccgccaacggccagggccagcagaggcggcgcatcacctctgtgcagccccccaccggcctgcaggagtggctgaagatgttccagagctggagcggccctgagaagctgctggccctggatgagctgattgacagctgtgagcccacccaggtgaagcacatgatgcaggtgattgagccccagttccagagggacttcatcagcctgctgcccaaggagctggccctgtatgtgctgtccttcctggagcccaaggacctgctgcaggccgcccagacctgccgctactggaggatcctggccgaggacaacctgctgtggagggagaagtgcaaggaggagggcattgatgagcccctgcacatcaagaggaggaaggtgatcaagccaggcttcatccacagcccctggaagagcgcctacatccggcagcacagaattgacaccaactggaggagaggagagctgaagagccccaaggtgctgaagggccatgatgaccacgtgatcacctgcctgcagttctgtggcaaccgcatcgtgtctggcagtgatgacaacaccctgaaggtgtggagcgctgtgacaggcaagtgcctgcggaccctggtgggccacactggaggagtgtggagcagccagatgagggacaacatcatcatcagcggcagcacagacaggaccctgaaggtgtggaatgctgagaccggggagtgcatccacaccctgtatggccacaccagcacagtgcgctgcatgcacctgcacgagaagagggtggtgtctggcagcagagatgccaccctgcgggtgtgggacatcgagaccggccagtgcctgcacgtgctgatgggccacgtggccgctgtgcgctgtgtgcagtatgatggccggcgggtggtgtctggggcctatgacttcatggtgaaggtgtgggaccctgagacagagacctgcctgcacaccctgcagggccacaccaacagagtgtacagcctgcagtttgatggcatccacgtggtgtctggcagcctggacaccagcatccgggtgtgggatgtggagaccggcaactgcatccacaccctgaccggccaccagagcctgaccagcggcatggagctgaaggacaacatcctggtgtctggaaatgctgacagcacagtgaagatctgggacatcaagacaggccagtgcctgcagaccctgcagggccccaacaagcaccagagcgctgtgacctgcctgcagttcaacaagaacttcgtcatcaccagcagtgatgatggcaccgtgaagctgtgggacctgaagacaggagagttcatccggaacctggtgaccctggagagcggcggcagcggcggcgtggtgtggaggatccgggccagcaacaccaagctggtgtgtgctgtgggcagcagaaatggaacagaggagaccaagctgctggtgctggactttgatgtggacatgaagtag

SEQ ID NO: 152178 - DNA, 2124 bp, Artificial Sequence
  Description of Artificial Sequence: Synthetic coding sequence
atgaaccaggagctgctgtctgtgggcagcaagagaagaagaactggaggcagcctgcggggcaaccccagcagcagccaggtggatgaggagcagatgaacagagtggtggaggaggagcagcagcagcagctgcggcagcaggaggaggagcacacagccagaaatggagaggtggtgggcgtggagcccaggcctgggggccagaatgacagccagcagggccagctggaggagaacaacaaccgcttcatctctgtggatgaggacagcagcggcaaccaggaggagcaggaggaggatgaggagcacgccggggagcaggatgaagaagatgaggaggaggaggagatggaccaggagagtgatgactttgaccagagtgatgacagcagccgggaggatgagcacacccacaccaacagcgtgaccaacagcagcagcatcgtggacctgcctgtgcaccagctgagcagccccttctacaccaagaccaccaagatgaagaggaagctggaccacggcagcgaggtgcgctccttcagcctgggcaagaagccctgcaaggtgtctgagtacaccagcaccaccggcctggtgccctgcagcgccacccccaccacctttggagacctgcgggccgccaacggccagggccagcagaggcggcgcatcacctctgtgcagccccccaccggcctgcaggagtggctgaagatgttccagagctggagcggccctgagaagctgctggccctggatgagctgattgacagctgtgagcccacccaggtgaagcacatgatgcaggtgattgagccccagttccagagggacttcatcagcctgctgcccaaggagctggccctgtatgtgctgtccttcctggagcccaaggacctgctgcaggccgcccagacctgccgctactggaggatcctggccgaggacaacctgctgtggagggagaagtgcaaggaggagggcattgatgagcccctgcacatcaagaggaggaaggtgatcaagccaggcttcatccacagcccctggaagagcgcctacatccggcagcacagaattgacaccaactggaggagaggagagctgaagagccccaaggtgctgaagggccatgatgaccacgtgatcacctgcctgcagttctgtggcaaccgcatcgtgtctggcagtgatgacaacaccctgaaggtgtggagcgctgtgacaggcaagtgcctgcggaccctggtgggccacactggaggagtgtggagcagccagatgagggacaacatcatcatcagcggcagcacagacaggaccctgaaggtgtggaatgctgagaccggggagtgcatccacaccctgtatggccacaccagcacagtgcgctgcatgcacctgcacgagaagagggtggtgtctggcagcagagatgccaccctgcgggtgtgggacatcgagaccggccagtgcctgcacgtgctgatgggccacgtggccgctgtgcgctgtgtgcagtatgatggccggcgggtggtgtctggggcctatgacttcatggtgaaggtgtgggaccctgagacagagacctgcctgcacaccctgcagggccacaccaacagagtgtacagcctgcagtttgatggcatccacgtggtgtctggcagcctggacaccagcatccgggtgtgggatgtggagaccggcaactgcatccacaccctgaccggccaccagagcctgaccagcggcatggagctgaaggacaacatcctggtgtctggaaatgctgacagcacagtgaagatctgggacatcaagacaggccagtgcctgcagaccctgcagggccccaacaagcaccagagcgctgtgacctgcctgcagttcaacaagaacttcgtcatcaccagcagtgatgatggcaccgtgaagctgtgggacctgaagacaggagagttcatccggaacctggtgaccctggagagcggcggcagcggcggcgtggtgtggaggatccgggccagcaacaccaagctggtgtgtgctgtgggcagcagaaatggaacagaggagaccaagctgctggtgctggactttgatgtggacatgaagtag

SEQ ID NO: 152179 - DNA, 1770 bp, Artificial Sequence
  Description of Artificial Sequence: Synthetic coding sequence
atgagcaagccaggcaagcccaccctgaaccacggcctggtgcctgtggacctgaagagcgccaaggagcccctgccccaccagacagtgatgaagatcttcagcatcagcatcatcgcccagggcctgcccttctgcagaagaaggatgaagaggaagctggaccacggcagcgaggtgcgctccttcagcctgggcaagaagccctgcaaggtgtctgagtacaccagcaccaccggcctggtgccctgcagcgccacccccaccacctttggagacctgcgggccgccaacggccagggccagcagaggcggcgcatcacctctgtgcagccccccaccggcctgcaggagtggctgaagatgttccagagctggagcggccctgagaagctgctggccctggatgagctgattgacagctgtgagcccacccaggtgaagcacatgatgcaggtgattgagccccagttccagagggacttcatcagcctgctgcccaaggagctggccctgtatgtgctgtccttcctggagcccaaggacctgctgcaggccgcccagacctgccgctactggaggatcctggccgaggacaacctgctgtggagggagaagtgcaaggaggagggcattgatgagcccctgcacatcaagaggaggaaggtgatcaagccaggcttcatccacagcccctggaagagcgcctacatccggcagcacagaattgacaccaactggaggagaggagagctgaagagccccaaggtgctgaagggccatgatgaccacgtgatcacctgcctgcagttctgtggcaaccgcatcgtgtctggcagtgatgacaacaccctgaaggtgtggagcgctgtgacaggcaagtgcctgcggaccctggtgggccacactggaggagtgtggagcagccagatgagggacaacatcatcatcagcggcagcacagacaggaccctgaaggtgtggaatgctgagaccggggagtgcatccacaccctgtatggccacaccagcacagtgcgctgcatgcacctgcacgagaagagggtggtgtctggcagcagagatgccaccctgcgggtgtgggacatcgagaccggccagtgcctgcacgtgctgatgggccacgtggccgctgtgcgctgtgtgcagtatgatggccggcgggtggtgtctggggcctatgacttcatggtgaaggtgtgggaccctgagacagagacctgcctgcacaccctgcagggccacaccaacagagtgtacagcctgcagtttgatggcatccacgtggtgtctggcagcctggacaccagcatccgggtgtgggatgtggagaccggcaactgcatccacaccctgaccggccaccagagcctgaccagcggcatggagctgaaggacaacatcctggtgtctggaaatgctgacagcacagtgaagatctgggacatcaagacaggccagtgcctgcagaccctgcagggccccaacaagcaccagagcgctgtgacctgcctgcagttcaacaagaacttcgtcatcaccagcagtgatgatggcaccgtgaagctgtgggacctgaagacaggagagttcatccggaacctggtgaccctggagagcggcggcagcggcggcgtggtgtggaggatccgggccagcaacaccaagctggtgtgtgctgtgggcagcagaaatggaacagaggagaccaagctgctggtgctggactttgatgtggacatgaagtag

SEQ ID NO: 152180 - DNA, 1596 bp, Artificial Sequence
  Description of Artificial Sequence: Synthetic coding sequence
atgctgttcttcaagtgcatcagcctgctgctgatctggctgatccctggccagagcaccaccggcctggtgccctgcagcgccacccccaccacctttggagacctgcgggccgccaacggccagggccagcagaggcggcgcatcacctctgtgcagccccccaccggcctgcaggagtggctgaagatgttccagagctggagcggccctgagaagctgctggccctggatgagctgattgacagctgtgagcccacccaggtgaagcacatgatgcaggtgattgagccccagttccagagggacttcatcagcctgctgcccaaggagctggccctgtatgtgctgtccttcctggagcccaaggacctgctgcaggccgcccagacctgccgctactggaggatcctggccgaggacaacctgctgtggagggagaagtgcaaggaggagggcattgatgagcccctgcacatcaagaggaggaaggtgatcaagccaggcttcatccacagcccctggaagagcgcctacatccggcagcacagaattgacaccaactggaggagaggagagctgaagagccccaaggtgctgaagggccatgatgaccacgtgatcacctgcctgcagttctgtggcaaccgcatcgtgtctggcagtgatgacaacaccctgaaggtgtggagcgctgtgacaggcaagtgcctgcggaccctggtgggccacactggaggagtgtggagcagccagatgagggacaacatcatcatcagcggcagcacagacaggaccctgaaggtgtggaatgctgagaccggggagtgcatccacaccctgtatggccacaccagcacagtgcgctgcatgcacctgcacgagaagagggtggtgtctggcagcagagatgccaccctgcgggtgtgggacatcgagaccggccagtgcctgcacgtgctgatgggccacgtggccgctgtgcgctgtgtgcagtatgatggccggcgggtggtgtctggggcctatgacttcatggtgaaggtgtgggaccctgagacagagacctgcctgcacaccctgcagggccacaccaacagagtgtacagcctgcagtttgatggcatccacgtggtgtctggcagcctggacaccagcatccgggtgtgggatgtggagaccggcaactgcatccacaccctgaccggccaccagagcctgaccagcggcatggagctgaaggacaacatcctggtgtctggaaatgctgacagcacagtgaagatctgggacatcaagacaggccagtgcctgcagaccctgcagggccccaacaagcaccagagcgctgtgacctgcctgcagttcaacaagaacttcgtcatcaccagcagtgatgatggcaccgtgaagctgtgggacctgaagacaggagagttcatccggaacctggtgaccctggagagcggcggcagcggcggcgtggtgtggaggatccgggccagcaacaccaagctggtgtgtgctgtgggcagcagaaatggaacagaggagaccaagctgctggtgctggactttgatgtggacatgaagtag

SEQ ID NO: 152181 - DNA, 1797 bp, Artificial Sequence
  Description of Artificial Sequence: Synthetic coding sequence
atggatgactacagcctggatgagttcagaagacgctggcaggaggagctggcccaggcccaggcccccaagaagagaagaagacctgaggccgctgagcggcgggcccggcggcctgaggtgggcagcggccgcggggagcaggccagcggggaccctgccctggcccagaggctgctggagggcgccggccggcccccagctgcccgggccaccagggctgagggccaggatgtggccagccgcagccgcagccccctggcccgggagggcgctgggggcggggagcagctggtggaccagctgatccgggacctgaatgagatgaatgatgtgcccttctttgacatccagctgccctatgagctggccatcaacatcttccagtacctggacaggaaggagctgggccgctgtgcccaggtgtccaagacctggaaggtgattgctgaagatgaggtgctgtggtaccgcctgtgccagcaggagggccacctgcctgacagcagcatcagtgactacagctgctggaagctgatcttccaggagtgccgggccaaggagcacatgctgcggaccaactggaagaacagaaaaggagctgtgtctgagctggagcacgtgcctgacacagtgctgtgtgatgtgcacagccatgatggagtggtgattgctggctacaccagcggagatgtgcgggtgtgggacaccaggacctgggactatgtggcccccttcctggagagtgaagatgaagaagatgagcccggcatgcagcccaacgtgtcctttgtgcgcatcaacagcagcctggccgtggccgcctatgaagatggcttcctgaacatctgggacctgaggacaggcaagtaccctgtgcacagatttgaacatgatgcccgcatccaggccctggccctgagccaggatgatgccaccgtggccacagccagcgcctttgatgtggtgatgctgagccccaatgaggagggctactggcagattgctgctgagtttgaggtgcccaagctggtgcagtacctggagatcgtgcctgagacccggcgctaccctgtggccgtggccgccgccggggacctgatgtacctgctgaaggccgaggacagcgcccggaccctgctgtatgcccacggcccccctgtgacctgcctggatgtgtctgccaaccaggtggccttcggcgtgcagggcctgggctgggtgtatgagggcagcaagatcctggtgtacagcctggaggccggccgccgcctgctgaagctgggcaatgtgctgcgggacttcacctgtgtgaacctgagtgacagcccccccaacctgatggtgtctggcaacatggatggccgggtgcgcatccatgacctgcggagcggcaacatcgccctgagcctgagcgcccaccagctgcgggtgtctgctgtgcagatggatgactggaagatcgtgtctggaggagaggagggcctggtgtctgtgtgggactacaggatgaaccagaagctgtgggaggtgtacagcggccaccctgtgcagcacatctccttcagcagccacagcctcatcacagccaacgtgccctaccagacagtgatgagaaatgctgacctggacagcttcaccacccaccggcggcaccggggcctcatccgggcctatgaatttgctgtggaccagctggccttccagagccccctgcctgtgtgccgcagcagctgtgatgccatggccacccactactatgacctggccctggccttcccctacaaccacgtgtag

SEQ ID NO: 152182 - DNA, 1599 bp, Artificial Sequence
  Description of Artificial Sequence: Synthetic coding sequence
atggatgactacagcctggatgagttcagaagacgctggcaggaggagctggcccaggcccaggcccccaagaagagaagaagacctgaggccgctgagcggcgggcccggcggccagaaaatgagatgaatgatgtgcccttctttgacatccagctgccctatgagctggccatcaacatcttccagtacctggacaggaaggagctgggccgctgtgcccaggtgtccaagacctggaaggtgattgctgaagatgaggtgctgtggtaccgcctgtgccagcaggagggccacctgcctgacagcagcatcagtgactacagctgctggaagctgatcttccaggagtgccgggccaaggagcacatgctgcggaccaactggaagaacagaaaaggagctgtgtctgagctggagcacgtgcctgacacagtgctgtgtgatgtgcacagccatgatggagtggtgattgctggctacaccagcggagatgtgcgggtgtgggacaccaggacctgggactatgtggcccccttcctggagagtgaagatgaagaagatgagcccggcatgcagcccaacgtgtcctttgtgcgcatcaacagcagcctggccgtggccgcctatgaagatggcttcctgaacatctgggacctgaggacaggcaagtaccctgtgcacagatttgaacatgatgcccgcatccaggccctggccctgagccaggatgatgccaccgtggccacagccagcgcctttgatgtggtgatgctgagccccaatgaggagggctactggcagattgctgctgagtttgaggtgcccaagctggtgcagtacctggagatcgtgcctgagacccggcgctaccctgtggccgtggccgccgccggggacctgatgtacctgctgaaggccgaggacagcgcccggaccctgctgtatgcccacggcccccctgtgacctgcctggatgtgtctgccaaccaggtggccttcggcgtgcagggcctgggctgggtgtatgagggcagcaagatcctggtgtacagcctggaggccggccgccgcctgctgaagctgggcaatgtgctgcgggacttcacctgtgtgaacctgagtgacagcccccccaacctgatggtgtctggcaacatggatggccgggtgcgcatccatgacctgcggagcggcaacatcgccctgagcctgagcgcccaccagctgcgggtgtctgctgtgcagatggatgactggaagatcgtgtctggaggagaggagggcctggtgtctgtgtgggactacaggatgaaccagaagctgtgggaggtgtacagcggccaccctgtgcagcacatctccttcagcagccacagcctcatcacagccaacgtgccctaccagacagtgatgagaaatgctgacctggacagcttcaccacccaccggcggcaccggggcctcatccgggcctatgaatttgctgtggaccagctggccttccagagccccctgcctgtgtgccgcagcagctgtgatgccatggccacccactactatgacctggccctggccttcccctacaaccacgtgtag

SEQ ID NO: 152183 - DNA, 1599 bp, Artificial Sequence; identical to SEQ ID NO: 152182
  Description of Artificial Sequence: Synthetic coding sequence

SEQ ID NO: 152184 - DNA, 2871 bp, Artificial Sequence
  Description of Artificial Sequence: Synthetic coding sequence
atggaggccggcggcctgcccctggagctgtggaggatgatcctggcctacctgcacctgcctgacctgggccgctgcagcctggtgtgccgggcctggtatgagctgatcctgagcctggacagcacccgctggaggcagctgtgcctgggctgcacagagtgccgccaccccaactggcccaaccagccagatgtggagcctgagagctggagggaggccttcaagcagcactacctggccagcaagacctggaccaagaatgccctggacctggagagcagcatctgcttcagcctcttcagaagaagaagagaaagaaggaccctgtctgtgggccctggccgggagtttgacagcctgggcagcgccctggccatggccagcctgtatgaccgcatcgtgctcttccctggggtgtatgaggagcagggcgagatcatcctgaaggtgcctgtggagatcgtgggccagggcaagctgggggaggtggccctgctggccagcattgaccagcactgcagcaccacccggctgtgcaacctggtgttcaccccagcctggttcagccccatcatgtacaagaccaccagcggccacgtgcagtttgacaactgcaactttgaaaatggccacatccaggtgcacggccctggcacctgccaggtgaagttctgcaccttcaagaacacccacatcttcctgcacaacgtgcccctgtgtgtgctggagaactgtgaatttgtgggcagcgagaacaacagcgtgacagtggagggccaccccagcgctgacaagaactgggcctacaagtacctgctgggcctcatcaagagcagccccaccttcctgcccacagaagattctgacttcctgatgagcctggacctggagagccgggaccaggcctggagccccaagacctgtgacatcgtgattgagggcagccagagccccaccagccctgccagcagcagccccaagccaggcagcaaggccggcagccaggaggccgaggtgggcagtgatggagagcgggtggcccagaccccagacagcagtgatggcggcctgagccccagcggagaagatgaagatgaggaccagctgatgtaccgcctgagctaccaggtgcagggccccaggcctgtgctgggcggcagcttcctgggcccccccctgcccggggccagcatccagctgcccagctgcctggtgctgaacagcctgcagcaggagctgcagaaggacaaggaggccatggccctggccaacagcgtgcagggctgcctgatcaggaagtgcctcttcagagatggaaaaggaggagtgtttgtgtgcagccacggccgggccaagatggagggcaacatcttcaggaacctgacctatgctgtgcgctgcatccacaacagcaagatcatcatgctgagaaatgacatctaccgctgccgggccagcggcatcttcctgcggctggagggcggcggcctgattgctggcaacaacatctaccacaatgctgaggccggcgtggacatcaggaagaagagcaaccccctcatcctgtgcaaccagatccaccacggcctgcggtctggaattgtggtgctgggcaatggcaagggcatcatccggaacaaccagatcttcagcaacaaggaggccggcatctacatcctgtaccacggcaaccctgtggtgtctggcaaccacatcttcaagggccgggctgctggcattgctgtgaatgaaaatggcaagggcctcatcacagaaaatgtcatccgggagaaccagtggggcggcgtggacatcagaagaggaggcatccctgtgctgcggagcaacctgatctgcttcggctacagtgatggagtggtggtgggagatgagggcaagggcctgattgagggcaacaccatctatgccaacaagggctgcggcgtgtggatgatgagcagcagcctgccccacgtgaccagcaaccacgtgtcctacaacggcctgtatggagtggccgtgttcagccagaaggatggcagcagcgagctgccccggggccaccgggcccaggagaacttctctgaagatggagatgccatcctgtgggagacagagctggagaaggaggatgaccccctgcggcggcccatcaccatcgccctggtggagagcaacagcatcaaccacaacggggccagcggcctgtatgtgcagagcagcgaggccctgcacgtgatcaccaacgtcatccacgccaatggagaccggggcatcaccgtggcccagagcagccagcccaccagggtggccaacaacagcatcagctgcaaccggcagagcggcgtgaaggtggaggcccagtgcaaggtggagctgcggggaaatggcatctatgacaacagaggacatggcatcatcaccaagggggacagcaccatcgtgattgaaaatgacatcatcggcaacagaggcagcggcctgcagctgctgcccaggagtgacaccaaggtgatcaagaaccgcatccacagcttccgggcctacggcattgctgtgcggggccgggccaaggccctggtgcaggagaacatcatcttccagggcaagaccagcaagaccatcttccagcagatcagcaacaaccgggagtgcatcatgcagaacaacaagttcctggtgttcaagaagaagagtgacacctggaggctggtgaaccccccagcccggccccacctggagaacagcctgcggcggcccagcgctgcccacaacggccagaaggtgacagccatggccacccgcatcacagcccgggtggagggcggctaccacagcaacagaagtgtcttctgcaccatcctgtag

SEQ ID NO: 152185 - DNA, 216 bp, Artificial Sequence
  Description of Artificial Sequence: Synthetic coding sequence
atggaggccggcggcctgcccctggagctgtggaggatgatcctggcctacctgcacctgcctgacctgggccgctgcagcctggtgtgccgggcctggtatgagctgatcctgagcctggacagcacccgctggaggcagctgtgcctgggctgcacagagtgccgccaccccaactggcccaaccagccagatgtggagcctgagagctggtag

SEQ ID NO: 152186 - DNA, 1446 bp, Artificial Sequence
  Description of Artificial Sequence: Synthetic coding sequence
atgctgagaaatgacatctaccgctgccgggccagcggcatcttcctgcggctggagggcggcggcctgattgctggcaacaacatctaccacaatgctgaggccggcgtggacatcaggaagaagagcaaccccctcatcctgtgcaaccagatccaccacggcctgcggagcggcatcgtggtgctgggcaatggcaagggcatcatccggaacaaccagatcttcagcaacaaggaggccggcatctacatcctgtaccacggcaaccctgtggtgtctggcaaccacatcttcaagggccgggccgccggcattgctgtgaatgaaaatggcaagggcctcatcacagaaaatgtcatccgggagaaccagtggggcggcgtggacatccggcggggcggcatccctgtgctgcggagcaacctgatctgcttcggctacagtgatggagtggtggtgggagatgagggcaagggcctcatcgagggcaacaccatctatgccaacaagggctgcggcgtgtggatgatgagcagcagcctgccccacgtgaccagcaaccacgtgtcctacaacggcctgtatggagtggccgtgttcagccagaaggatggcagcagcgagctgccccggggccaccgggcccaggagaacttctctgaagatggagatgccatcctgtgggagacagagctggagaaggaggatgaccccctgcggcggcccatcaccatcgccctggtggagagcaacagcatcaaccacaatggagccagcggcctgtatgtgcagagcagcgaggccctgcacgtgatcaccaacgtcatccacgccaacggggaccggggcatcaccgtggcccagagcagccagcccaccagggtggccaacaacagcatcagctgcaaccggcagagcggcgtgaaggtggaggcccagtgcaaggtggagctgcggggaaatggcatctatgacaacagaggccacggcatcatcaccaagggggacagcaccatcgtgattgaaaatgacatcatcggcaacagaggcagcggcctgcagctgctgcccaggagtgacaccaaggtgatcaagaaccgcatccacagcttccgggcctatggaattgctgtgcggggccgggccaaggccctggtgcaggagaacatcatcttccagggcaagaccagcaagaccatcttccagcagatcagcaacaaccgggagtgcatcatgcagaacaacaagttcctggtgttcaagaagaagagtgacacctggaggctggtgaaccccccagcccggccccacctggagaacagcctgcggcggcccagcgctgcccacaacggccagaaggtgacagccatggccacccgcatcacagcccgggtggagggcggctaccacagcaacagatctgtgttctgcaccatcctgtag

SEQ ID NO: 152187 - DNA, 2532 bp, Artificial Sequence
  Description of Artificial Sequence: Synthetic coding sequence
atggtggccgaggagagcggccctggggcccagaacagcccctaccagctgcggaggaagaccctgctgcccaagaggacagcctgccccaccaagaacagcatggagggcgccagcaccagcaccacagagaactttggccaccgggccaagagggcccgggtgtctgggaagagccaggacctgtctgctgccccagctgagcagtacctgcaggagaagctgcctgatgaggtggtgctgaagatcttctcctacctgctggagcaggacctgtgcagagctgcctgtgtgtgcaagcgcttcagcgagctggccaatgaccccatcctgtggaagaggctgtacatggaggtgtttgagtacacccggcccatgatgcaccctgagcccgggaagttctaccagatcaaccctgaggagtatgagcaccccaacccctggaaggagagcttccagcagctgtacaagggggcccacgtgaagccaggctttgctgagcacttctacagcaacccagcccgctacaagggccgggagaacatgctgtactatgacaccattgaagatgccctgggcggcgtgcaggaggcccactttgatggcctcatctttgtgcacagcggcatctacacagatgagtggatctacatcgagagccccatcaccatgattggagctgcccctgggaaggtggccgacaaggtgatcatcgagaacacccgggacagcacctttgtgttcatggagggctctgaagatgcctacgtgggctacatgaccatccgcttcaacccagatgacaagagcgcccagcaccacaatgcccaccactgcctggagatcaccgtgaactgcagccccatcatcgaccactgcatcatccgcagcacctgcaccgtgggcagcgctgtgtgtgtgtctggccagggcgcctgccccaccatcaagcactgcaacatcagtgactgtgaaaatgtgggcctgtacatcacagaccacgcccagggcatctatgaggacaatgagatcagcaacaatgccctggccggcatctgggtgaagaaccacggcaaccccatcatcagaagaaaccacatccaccacggcagagatgtgggcgtcttcacctttgaccacggcatgggctactttgagagctgcaacatccacaggaacagaattgctggctttgaggtgaaggcctatgccaaccccaccgtggtgcgctgtgagatccaccacggccagacaggaggcatctacgtgcatgagaagggccggggccagttcatcgagaacaagatctatgccaacaactttgctggggtgtggatcaccagcaacagcgaccccaccatccggggcaacagcatcttcaatggaaaccagggcggcgtgtacatctttggagatggccggggcctgattgagggcaatgacatctatggaaatgccctggccggcatccagatccgcaccaacagctgccccatcgtgcgccacaacaagatccatgatggccagcacggcggcatctacgtgcatgagaagggccagggcgtgattgaagaaaatgaggtgtacagcaacaccctggccggcgtgtgggtgaccaccggcagcacccctgtgctgcggaggaaccgcatccacagcggcaagcaggtgggcgtgtacttctatgacaatggccacggcgtgctggaggacaatgacatctacaaccacatgtacagcggcgtgcagatcagaacaggcagcaaccccaagatcagaagaaacaagatctggggcggccagaatggaggcatcctggtgtacaacagcggcctgggctgcatcgaggacaatgagatctttgacaatgccatggccggcgtgtggatcaagacagacagcaaccccaccctgcggaggaacaagatccatgatggaagagatggcggcatctgcatcttcaatggaggccggggcctgctggaggagaatgacatcttcagaaatgcccaggccggcgtgctgatcagcaccaacagccaccccatcctgaggaagaaccgcatctttgatggctttgctgctggcatcgagatcaccaaccacgccacagccaccctggagggcaaccagatcttcaacaacagatttggaggcctcttcctggccagcggcgtgaatgtgaccatgaaggacaacaagatcatgaacaaccaggatgccatcgagaaggctgtgtcccggggccagtgcctgtacaagatcagcagctacaccagctaccccatgcatgacttctaccgctgccacacctgcaacaccacagacagaaatgccatctgtgtgaactgcatcaagaagtgccaccagggccatgatgtggagttcatcagacatgaccgcttcttctgtgactgtggggccggcaccctgagcaacccctgcaccctggccggggagcccacccatgacacagacaccctgtatgattctgccccacccatcgagagcaacaccctgcagcacaactag

SEQ ID NO: 152188 - DNA, 282 bp, Artificial Sequence
  Description of Artificial Sequence: Synthetic coding sequence
atggagggcgccagcaccagcaccacagagaactttggccaccgggccaagagggcccgggtgtctgggaagagccaggacctgtctgctgccccagctgagcagtacctgcaggagaagctgcctgatgaggtggtgctgaagatcttctcctacctgctggagcaggacctgtgcagagctgcctgtgtgtgcaagcgcttcagcgagctggccaatgaccccatcctgtggctgggggaggtggcccacgcctacaaccccagcaccctgggcggctag

SEQ ID NO: 152189 - DNA, 2532 bp, Artificial Sequence; identical to SEQ ID NO: 152187
  Description of Artificial Sequence: Synthetic coding sequence

SEQ ID NO: 152190 - DNA, 2784 bp, Artificial Sequence
  Description of Artificial Sequence: Synthetic coding sequence
atgaacagcgtgcgggccgccaacagaagaccccggcgggtgtcccggcccaggcctgtgcagcagcagcagcagcagcccccccagcagcccccaccccagcccccccagcagcagcccccccagcagcagcccccacctccaccccagcagcagcagcagcagcagcccccacctcctcctcctcctcctccacccctgccccaggagagaaataatgtgggggagagagatgatgatgtgcctgctgacatggtggccgaggagagcggccctggggcccagaacagcccctaccagctgcggaggaagaccctgctgcccaagaggacagcctgccccaccaagaacagcatggagggcgccagcaccagcaccacagagaactttggccaccgggccaagagggcccgggtgtctgggaagagccaggacctgtctgctgccccagctgagcagtacctgcaggagaagctgcctgatgaggtggtgctgaagatcttctcctacctgctggagcaggacctgtgcagagctgcctgtgtgtgcaagcgcttcagcgagctggccaatgaccccatcctgtggaagaggctgtacatggaggtgtttgagtacacccggcccatgatgcaccctgagcccgggaagttctaccagatcaaccctgaggagtatgagcaccccaacccctggaaggagagcttccagcagctgtacaagggggcccacgtgaagccaggctttgctgagcacttctacagcaacccagcccgctacaagggccgggagaacatgctgtactatgacaccattgaagatgccctgggcggcgtgcaggaggcccactttgatggcctcatctttgtgcacagcggcatctacacagatgagtggatctacatcgagagccccatcaccatgattggagctgcccctgggaaggtggccgacaaggtgatcatcgagaacacccgggacagcacctttgtgttcatggagggctctgaagatgcctacgtgggctacatgaccatccgcttcaacccagatgacaagagcgcccagcaccacaatgcccaccactgcctggagatcaccgtgaactgcagccccatcatcgaccactgcatcatccgcagcacctgcaccgtgggcagcgctgtgtgtgtgtctggccagggcgcctgccccaccatcaagcactgcaacatcagtgactgtgaaaatgtgggcctgtacatcacagaccacgcccagggcatctatgaggacaatgagatcagcaacaatgccctggccggcatctgggtgaagaaccacggcaaccccatcatcagaagaaaccacatccaccacggcagagatgtgggcgtcttcacctttgaccacggcatgggctactttgagagctgcaacatccacaggaacagaattgctggctttgaggtgaaggcctatgccaaccccaccgtggtgcgctgtgagatccaccacggccagacaggaggcatctacgtgcatgagaagggccggggccagttcatcgagaacaagatctatgccaacaactttgctggggtgtggatcaccagcaacagcgaccccaccatccggggcaacagcatcttcaatggaaaccagggcggcgtgtacatctttggagatggccggggcctgattgagggcaatgacatctatggaaatgccctggccggcatccagatccgcaccaacagctgccccatcgtgcgccacaacaagatccatgatggccagcacggcggcatctacgtgcatgagaagggccagggcgtgattgaagaaaatgaggtgtacagcaacaccctggccggcgtgtgggtgaccaccggcagcacccctgtgctgcggaggaaccgcatccacagcggcaagcaggtgggcgtgtacttctatgacaatggccacggcgtgctggaggacaatgacatctacaaccacatgtacagcggcgtgcagatcagaacaggcagcaaccccaagatcagaagaaacaagatctggggcggccagaatggaggcatcctggtgtacaacagcggcctgggctgcatcgaggacaatgagatctttgacaatgccatggccggcgtgtggatcaagacagacagcaaccccaccctgcggaggaacaagatccatgatggaagagatggcggcatctgcatcttcaatggaggccggggcctgctggaggagaatgacatcttcagaaatgcccaggccggcgtgctgatcagcaccaacagccaccccatcctgaggaagaaccgcatctttgatggctttgctgctggcatcgagatcaccaaccacgccacagccaccctggagggcaaccagatcttcaacaacagatttggaggcctcttcctggccagcggcgtgaatgtgaccatgaaggacaacaagatcatgaacaaccaggatgccatcgagaaggctgtgtcccggggccagtgcctgtacaagatcagcagctacaccagctaccccatgcatgacttctaccgctgccacacctgcaacaccacagacagaaatgccatctgtgtgaactgcatcaagaagtgccaccagggccatgatgtggagttcatcagacatgaccgcttcttctgtgactgtggggccggcaccctgagcaacccctgcaccctggccggggagcccacccatgacacagacaccctgtatgattctgccccacccatcgagagcaacaccctgcagcacaactag

SEQ ID NO: 152191 - DNA, 1056 bp, Artificial Sequence
  Description of Artificial Sequence: Synthetic coding sequence
atggagatcaaggaggagttcaccagcctggtgatggatgaggccctgctgaaggagatgaccttcatgcatgagaagggccagggcgtgattgaagaaaatgaggtgtacagcaacaccctggccggcgtgtgggtgaccaccggcagcacccctgtgctgcggaggaaccgcatccacagcggcaagcaggtgggcgtgtacttctatgacaatggccacggcgtgctggaggacaatgacatctacaaccacatgtacagcggcgtgcagatcagaacaggcagcaaccccaagatcagaagaaacaagatctggggcggccagaatggaggcatcctggtgtacaacagcggcctgggctgcatcgaggacaatgagatctttgacaatgccatggccggcgtgtggatcaagacagacagcaaccccaccctgcggaggaacaagatccatgatggaagagatggcggcatctgcatcttcaatggaggccggggcctgctggaggagaatgacatcttcagaaatgcccaggccggcgtgctgatcagcaccaacagccaccccatcctgaggaagaaccgcatctttgatggctttgctgctggcatcgagatcaccaaccacgccacagccaccctggagggcaaccagatcttcaacaacagatttggaggcctcttcctggccagcggcgtgaatgtgaccatgaaggacaacaagatcatgaacaaccaggatgccatcgagaaggctgtgtcccggggccagtgcctgtacaagatcagcagctacaccagctaccccatgcatgacttctaccgctgccacacctgcaacaccacagacagaaatgccatctgtgtgaactgcatcaagaagtgccaccagggccatgatgtggagttcatcagacatgaccgcttcttctgtgactgtggggccggcaccctgagcaacccctgcaccctggccggggagcccacccatgacacagacaccctgtatgattctgccccacccatcgagagcaacaccctgcagcacaactag

SEQ ID NO: 152192 - DNA, 1305 bp, Artificial Sequence
  Description of Artificial Sequence: Synthetic coding sequence
atgcccagcgagatcctgctgaagatcttctcctacctggatgctgtgtccctgctgtgcaccggctgtgtgagccgccgcttctaccacctggccaatgacaacttcatctggattggcatctacagcacagccttcagccctgcccggagcaactggaagttcaacagcgtggagaagatcgccatgtccatgtccttcctgtctgtgcaggacaaggaggccggctactggaagaaggagtacatcaccaagcagatcgcctctgtgaaggccgccctggccgacatcctgaagcctgtgaacccctacacaggcctgcctgtgaagaccaaggaggccctgcgcatcttcggcctgggctgggccatcatcctgaaggagaagggcggcaaggagtacatcatggagcacgtggacctgagcatcaatgacacctctgtgaccgtcatctggtacggcaagaagtggccctgcctggccagcctgagcaccctggacctgtgtggcatgacccctgtgttcacagactggtacaagacccccaccaagcaccggctgcgctggcacagcctgattgccaagtacaacctgagccacctgaccatcagcaccatgattggctgtgacaggctcatccgcatcttctgcctgcaccctggcctgctggtgggcgtgtggaagaaggaggaggagctggcctttgtgatggccaacctgcacttccaccacctggtggagaggagcaccctgggcagcgccaccatcccctatgagctgcccccccacagccccttcctggatgacagcccagaatatggcctgcacggctaccagctgcacgtggacctgcacagcggcggcgtcttctacctgtgtggcaccttcaggaacctcttcaccaagaggggcaacattgaaaatggccacgtgaagctgattgtcatccacctgaagaacaaccgggagcacctgcccctcatcggcaaggtgggcctgtcctggaagacagacatctttgatggctgcatcaagagctgcagcatgatggatgtgaccctgctggatgagcacggcaagcccttctggtgcttcagcagccctgtgtgcctgcggagccctgccacccccagcgacagcagcagcttcctgggccagacctacaacgtggactatgtggatgctgagggccgggtgcacgtggagctggtgtggatccgggagacagaggagtacctgattgtgaacctggtgctgtacctgagcatcgccaagatcaaccactggtttggaacagagtactag

SEQ ID NO: 152193 - DNA, 1533 bp, Artificial Sequence
  Description of Artificial Sequence: Synthetic coding sequence
atggccaccggccggggccgcatcctgcagcagcactggctgggcctgcagaccctgcggggccccagcagaggaggaggagctgcccggggccgggcccgggccttcggctgcaggaagggccctggggtgaagctgtctgctggcagcgctgccctgcgctgccacgccggcggcggccagcactgggagagcagcttcagctgctgcagcggcttcctggatggcatgcccagcgagatcctgctgaagatcttctcctacctggatgctgtgtccctgctgtgcaccggctgtgtgagccgccgcttctaccacctggccaatgacaacttcatctggattggcatctacagcacagccttcagccctgcccggagcaactggaagttcaacagcgtggagaagatcgccatgtccatgtccttcctgtctgtgcaggacaaggaggccggctactggaagaaggagtacatcaccaagcagatcgcctctgtgaaggccgccctggccgacatcctgaagcctgtgaacccctacacaggcctgcctgtgaagaccaaggaggccctgcgcatcttcggcctgggctgggccatcatcctgaaggagaagggcggcaaggagtacatcatggagcacgtggacctgagcatcaatgacacctctgtgaccgtcatctggtacggcaagaagtggccctgcctggccagcctgagcaccctggacctgtgtggcatgacccctgtgttcacagactggtacaagacccccaccaagcaccggctgcgctggcacagcctgattgccaagtacaacctgagccacctgaccatcagcaccatgattggctgtgacaggctcatccgcatcttctgcctgcaccctggcctgctggtgggcgtgtggaagaaggaggaggagctggcctttgtgatggccaacctgcacttccaccacctggtggagaggagcaccctgggcagcgccaccatcccctatgagctgcccccccacagccccttcctggatgacagcccagaatatggcctgcacggctaccagctgcacgtggacctgcacagcggcggcgtcttctacctgtgtggcaccttcaggaacctcttcaccaagaggggcaacattgaaaatggccacgtgaagctgattgtcatccacctgaagaacaaccgggagcacctgcccctcatcggcaaggtgggcctgtcctggaagacagacatctttgatggctgcatcaagagctgcagcatgatggatgtgaccctgctggatgagcacggcaagcccttctggtgcttcagcagccctgtgtgcctgcggagccctgccacccccagcgacagcagcagcttcctgggccagacctacaacgtggactatgtggatgctgagggccgggtgcacgtggagctggtgtggatccgggagacagaggagtacctgattgtgaacctggtgctgtacctgagcatcgccaagatcaaccactggtttggaacagagtactag

SEQ ID NO: 152194 - DNA, 879 bp, Artificial Sequence
  Description of Artificial Sequence: Synthetic coding sequence
atgatggcctttgccccacccaagaacacagatggccccaagatgcagaccaagatgagcacctggacccccctgaaccaccagctgctgaatgacagagtgtttgaggagcggcgggccctgctgggcaagtggtttgacaagtggacagacagccagaggcggcgcatcctgaccggcctgctggagcgctgcagcctgagccagcagaagttctgctgcaggaagctgcaggagaagatcccagctgaggccctggacttcaccaccaagctgccccgggtgctgagcctgtacatcttctccttcctggaccccaggagcctgtgccgctgtgcccaggtgtgctggcactggaagaacctggccgagctggaccagctgtggatgctgaagtgcctgcgcttcaactggtacatcaacttcagccccaccccatttgagcagggcatctggaagaagcactacatccagatggtgaaggagctgcacatcaccaagcccaagaccccacccaaggatggctttgtgattgctgatgtgcagctggtgaccagcaacagccctgaggagaagcagagccccctgagcgccttccgcagcagcagcagcctgaggaagaagaacaacagcggggagaaggccctgcccccctggaggagcagtgacaagcaccccacagacatcatccgcttcaactacctggacaacagagaccccatggagaccgtgcagcagggccgcaggaagaggaaccagatgaccccagacttcagccggcagagccatgacaagaagaacaagctgcaggacaggacccggctgaggaaggcccagagcatgatgagcagaagaaaccccttccccctgtgcccctag

SEQ ID NO: 152195 - DNA, 891 bp, Artificial Sequence
  Description of Artificial Sequence: Synthetic coding sequence
atggatggagatggagaccctgagagcgtgggccagcctgaggaggccagccctgaggagcagcctgaggaggccagcgctgaggaggagaggcctgaggaccagcaggaggaggaggccgctgctgctgctgcctacctggatgagctgcctgagcccctgctgctgcgggtgctggccgccctgcctgctgctgagctggtgcaggcctgccgcctggtgtgcctgcgctggaaggagctggtggatggagcccccctgtggctgctgaagtgccagcaggagggcctggtgcctgagggcggcgtggaggaggagcgggaccactggcagcagttctacttcctgagcaagagaagaagaaacctgctgaggaacccctgtggggaggaggacctggagggctggtgtgatgtggagcacggcggagatggctggagggtggaggagctgcccggggacagcggcgtggagttcacccatgatgagagcgtgaagaagtactttgccagcagctttgagtggtgcaggaaggcccaggtgattgacctgcaggccgagggctactgggaggagctgctggacaccacccagcctgccatcgtggtgaaggactggtacagcggccgcagtgatgctggctgcctgtatgagctgactgtgaagctgctgtctgaacatgaaaatgtgctggccgagttcagcagcggccaggtggccgtgccccaggacagtgatggcggcggctggatggagatcagccacaccttcacagattatggccctggggtgcgctttgtgcgctttgaacatggaggccaggacagcgtgtactggaagggctggtttggagcccgggtgaccaacagctctgtgtgggtggagccctag

SEQ ID NO: 152196 - DNA, 594 bp, Artificial Sequence
  Description of Artificial Sequence: Synthetic coding sequence
atggatggagatggagaccctgagagcgtgggccagcctgaggaggccagccctgaggagcagcctgaggaggccagcgctgaggaggagaggcctgaggaccagcaggaggaggaggccgctgctgctgctgcctacctggatgagctgcctgagcccctgctgctgcgggtgctggccgccctgcctgctgctgagctggtgcaggcctgccgcctggtgtgcctgcgctggaaggagctggtggatggagcccccctgtggctgctgaagtgccagcaggagggcctggtgcctgagggcggcgtggaggaggagcgggaccactggcagcagttctacttcctgagcaagagaagaagaaacctgctgaggaacccctgtggggaggaggacctggagggctggtgtgatgtggagcacggcggagatggctggagggtggaggagctgcccggggacagcggcgtggagttcacccatgatgagagcgcccctgtgctgcctggaggagtggccaagcaccggggcctgctgggcggcgctgctggccatgattctgctggccacagaggagagggcctggtgaggtag

SEQ ID NO: 152197 - DNA, 1614 bp, Artificial Sequence
  Description of Artificial Sequence: Synthetic coding sequence
atgaagcactacagccccacagattatgtgaactggctggaggagtacaaggtgcggcagaaggccggcctggaggccaggaagatcgtggccagcttcagcaagcgcttcttcagcgagcacgtgccctgcaatggcttcagtgacatcgagaacctggagggccctgagatcttctttgaagatgagctggtgtgcatcctgaacatggagggcaggaaggccctgacctggaagtactatgccaagaagatcctgtactacctgcggcagcagaagatcctgaacaacctgaaggccttcctgcagcagccagatgattatgagagctacctggagggcgctgtgtacatcgaccagtactgcaaccccctgagtgacatcagcctgaaggacatccaggcccagattgacagcatcgtggagctggtgtgcaagaccctgcggggcatcaacagccgccaccccagcctggccttcaaggccggggagagctccatgatcatggagattgagctgcagagccaggtgctggatgccatgaactacgtgctgtatgaccagctgaagttcaagggcaacaggatggactactacaatgccctgaacctgtacatgcaccaggtgctgatccggaggacaggcatccccatctccatgagcctgctgtacctgaccatcgcccggcagctgggcgtgcccctggagcctgtgaacttccccagccacttcctgctgcgctggtgccagggcgctgagggcgccaccctggacatctttgactacatctacattgatgccttcggcaagggcaagcagctgactgtgaaggaatgtgagtacctgattggccagcacgtgacagctgccctgtatggagtggtgaatgtgaagaaggtgctgcagaggatggtgggcaacctgctgagcctgggcaagcgggagggcatcgaccagagctaccagctgctgcgggacagcctggacctgtacctggccatgtacccagaccaggtgcagctgctgctgctgcaggcccggctgtacttccacctgggcatctggccagagaaggtgctggacatcctgcagcacatccagaccctggaccccggccagcacggggctgtgggctacctggtgcagcacaccctggagcacatcgagaggaagaaggaggaggtgggcgtggaggtgaagctgcggagtgatgagaagcacagagatgtgtgctacagcatcggcctcatcatgaagcacaagagatatggctacaactgtgtgatctacggctgggaccccacctgcatgatgggccacgagtggatccggaacatgaatgtgcacagcctgccccacggccaccaccagcccttctacaacgtgctggtggaggatggcagctgccgctatgctgcccaggagaacctggagtacaacgtggagccccaggagatcagccacccagatgtgggccgctacttcagcgagttcaccggcacccactacatccccaatgctgagctggagatccgctacccagaggacctggagtttgtgtatgaaacagtgcagaacatctacagcgccaagaaggaaaatattgatgaatag

SEQ ID NO: 152198 - DNA, 1887 bp, Artificial Sequence
  Description of Artificial Sequence: Synthetic coding sequence
atggctgctgctgctgtggacagcgccatggaggtggtgcctgccctggccgaggaggccgcccctgaggtggccggcctgagctgcctggtgaacctgcccggggaggtgctggagtacatcctgtgctgcggcagcctgacagctgctgacatcggccgggtgagcagcacctgccggcggctgcgggagctgtgccagagcagcggcaaggtgtggaaggagcagttccgggtgcgctggcccagcctgatgaagcactacagccccacagattatgtgaactggctggaggagtacaaggtgcggcagaaggccggcctggaggccaggaagatcgtggccagcttcagcaagcgcttcttcagcgagcacgtgccctgcaatggcttcagtgacatcgagaacctggagggccctgagatcttctttgaagatgagctggtgtgcatcctgaacatggagggcaggaaggccctgacctggaagtactatgccaagaagatcctgtactacctgcggcagcagaagatcctgaacaacctgaaggccttcctgcagcagccagatgattatgagagctacctggagggcgctgtgtacatcgaccagtactgcaaccccctgagtgacatcagcctgaaggacatccaggcccagattgacagcatcgtggagctggtgtgcaagaccctgcggggcatcaacagccgccaccccagcctggccttcaaggccggggagagctccatgatcatggagattgagctgcagagccaggtgctggatgccatgaactacgtgctgtatgaccagctgaagttcaagggcaacaggatggactactacaatgccctgaacctgtacatgcaccaggtgctgatccggaggacaggcatccccatctccatgagcctgctgtacctgaccatcgcccggcagctgggcgtgcccctggagcctgtgaacttccccagccacttcctgctgcgctggtgccagggcgctgagggcgccaccctggacatctttgactacatctacattgatgccttcggcaagggcaagcagctgactgtgaaggaatgtgagtacctgattggccagcacgtgacagctgccctgtatggagtggtgaatgtgaagaaggtgctgcagaggatggtgggcaacctgctgagcctgggcaagcgggagggcatcgaccagagctaccagctgctgcgggacagcctggacctgtacctggccatgtacccagaccaggtgcagctgctgctgctgcaggcccggctgtacttccacctgggcatctggccagagaagagcttctgcctggtgctgaaggtgctggacatcctgcagcacatccagaccctggaccccggccagcacggggctgtgggctacctggtgcagcacaccctggagcacattgaaaggaagaaggaggaggtgggcgtggaggtgaagctgcggagtgatgagaagcacagagatgtgtgctacagcatcggcctcatcatgaagcacaagagatatggctacaactgtgtgatctacggctgggaccccacctgcatgatgggccacgagtggatccggaacatgaatgtgcacagcctgccccacggccaccaccagcccttctacaacgtgctggtggaggatggcagctgccgctatgctgcccaggagaacctggagtacaacgtggagccccaggagatcagccacccagatgtgggccgctacttcagcgagttcaccggcacccactacatccccaatgctgagctggagatccgctacccagaggacctggagtttgtgtatgagaccgtgcagaacatctacagcgccaagaaggagaacattgatgaatag

SEQ ID NO: 152199 - DNA, 1866 bp, Artificial Sequence
  Description of Artificial Sequence: Synthetic coding sequence
atggctgctgctgctgtggacagcgccatggaggtggtgcctgccctggccgaggaggccgcccctgaggtggccggcctgagctgcctggtgaacctgcccggggaggtgctggagtacatcctgtgctgcggcagcctgacagctgctgacatcggccgggtgagcagcacctgccggcggctgcgggagctgtgccagagcagcggcaaggtgtggaaggagcagttccgggtgcgctggcccagcctgatgaagcactacagccccacagattatgtgaactggctggaggagtacaaggtgcggcagaaggccggcctggaggccaggaagatcgtggccagcttcagcaagcgcttcttcagcgagcacgtgccctgcaatggcttcagtgacatcgagaacctggagggccctgagatcttctttgaagatgagctggtgtgcatcctgaacatggagggcaggaaggccctgacctggaagtactatgccaagaagatcctgtactacctgcggcagcagaagatcctgaacaacctgaaggccttcctgcagcagccagatgattatgagagctacctggagggcgctgtgtacatcgaccagtactgcaaccccctgagtgacatcagcctgaaggacatccaggcccagattgacagcatcgtggagctggtgtgcaagaccctgcggggcatcaacagccgccaccccagcctggccttcaaggccggggagagctccatgatcatggagattgagctgcagagccaggtgctggatgccatgaactacgtgctgtatgaccagctgaagttcaagggcaacaggatggactactacaatgccctgaacctgtacatgcaccaggtgctgatccggaggacaggcatccccatctccatgagcctgctgtacctgaccatcgcccggcagctgggcgtgcccctggagcctgtgaacttccccagccacttcctgctgcgctggtgccagggcgctgagggcgccaccctggacatctttgactacatctacattgatgccttcggcaagggcaagcagctgactgtgaaggaatgtgagtacctgattggccagcacgtgacagctgccctgtatggagtggtgaatgtgaagaaggtgctgcagaggatggtgggcaacctgctgagcctgggcaagcgggagggcatcgaccagagctaccagctgctgcgggacagcctggacctgtacctggccatgtacccagaccaggtgcagctgctgctgctgcaggcccggctgtacttccacctgggcatctggccagagaaggtgctggacatcctgcagcacatccagaccctggaccccggccagcacggggctgtgggctacctggtgcagcacaccctggagcacatcgagaggaagaaggaggaggtgggcgtggaggtgaagctgcggagtgatgagaagcacagagatgtgtgctacagcatcggcctcatcatgaagcacaagagatatggctacaactgtgtgatctacggctgggaccccacctgcatgatgggccacgagtggatccggaacatgaatgtgcacagcctgccccacggccaccaccagcccttctacaacgtgctggtggaggatggcagctgccgctatgctgcccaggagaacctggagtacaacgtggagccccaggagatcagccacccagatgtgggccgctacttcagcgagttcaccggcacccactacatccccaatgctgagctggagatccgctacccagaggacctggagtttgtgtatgaaacagtgcagaacatctacagcgccaagaaggaaaatattgatgaatag

SEQ ID NO: 152200 - DNA, 1434 bp, Artificial Sequence
  Description of Artificial Sequence: Synthetic coding sequence
atgaagcactacagccccacagattatgtgaactggctggaggagtacaaggtgcggcagaaggccggcctggaggccaggaagatcgtggccagcttcagcaagcgcttcttcagcgagcacgtgccctgcaatggcttcagtgacatcgagaacctggagggccctgagatcttctttgaagatgagctggtgtgcatcctgaacatggagggcaggaaggccctgacctggaagtactatgccaagaagatcctgtactacctgcggcagcagaagatcctgaacaacctgaaggccttcctgcagcagccagatgattatgagagctacctggagggcgctgtgtacatcgaccagtactgcaaccccctgagtgacatcagcctgaaggacatccaggcccagattgacagcatcgtggagctggtgtgcaagaccctgcggggcatcaacagccgccaccccagcctggccttcaaggccggggagagctccatgatcatggagattgagctgcagagccaggtgctggatgccatgaactacgtgctgtatgaccagctgaagttcaagggcaacaggatggactactacaatgccctgaacctgtacatgcaccaggtgctgatccggaggacaggcatccccatctccatgagcctgctgtacctgaccatcgcccggcagctgggcgtgcccctggagcctgtgaacttccccagccacttcctgctgcgctggtgccagggcgctgagggggagggcatcgaccagagctaccagctgctgcgggacagcctggacctgtacctggccatgtacccagaccaggtgcagctgctgctgctgcaggcccggctgtacttccacctgggcatctggccagagaaggtgctggacatcctgcagcacatccagaccctggaccccggccagcacggggctgtgggctacctggtgcagcacaccctggagcacatcgagaggaagaaggaggaggtgggcgtggaggtgaagctgcggagtgatgagaagcacagagatgtgtgctacagcatcggcctcatcatgaagcacaagagatatggctacaactgtgtgatctacggctgggaccccacctgcatgatgggccacgagtggatccggaacatgaatgtgcacagcctgccccacggccaccaccagcccttctacaacgtgctggtggaggatggcagctgccgctatgctgcccaggagaacctggagtacaacgtggagccccaggagatcagccacccagatgtgggccgctacttcagcgagttcaccggcacccactacatccccaatgctgagctggagatccgctacccagaggacctggagtttgtgtatgaaacagtgcagaacatctacagcgccaagaaggaaaatattgatgaatag

SEQ ID NO: 152201 - DNA, 1212 bp, Artificial Sequence
  Description of Artificial Sequence: Synthetic coding sequence
atggagcctgtgggctgctgcggagaatgtcggggcagctctgtggaccccaggagcacctttgtgctgagcaacctggccgaggtggtggagcgggtgctgaccttcctgcctgccaaggccctgctgcgggtggcctgtgtgtgccgcctgtggagagaatgtgtgagaagagtgctgcggacccacaggtctgtgacctggatctctgctggcctggccgaggccggccacctggagggccactgcctggtgcgggtggtggccgaggagctggagaatgtgcgcatcctgccccacacagtgctgtacatggctgacagcgagaccttcatcagcctggaggagtgccggggccacaagagggccaggaagaggacctccatggagacagccctggccctggagaagctgttccccaagcagtgccaggtgctgggcatcgtgaccccaggcatcgtggtgacccccatgggcagcggcagcaaccggccccaggagattgagatcggggagagcggctttgccctgctcttcccccagatcgagggcatcaagatccagcccttccacttcatcaaggaccccaagaacctgaccctggagcggcaccagctgacagaggtgggcctgctggacaaccctgagctgcgggtggtgctggtgtttggctacaactgctgcaaggtgggcgccagcaactacctgcagcaggtggtgtccaccttcagtgacatgaacatcatcctggccggcggccaggtggacaacctgagcagcctgaccagcgagaagaaccccctggacattgatgccagcggcgtggtgggcctgtccttcagcggccaccgcatccagagcgccaccgtgctgctgaatgaagatgtgtctgatgagaagacagctgaggccgccatgcagaggctgaaggccgccaacatccctgagcacaacaccatcggcttcatgtttgcctgtgtgggccggggcttccagtactaccgggccaagggaaatgtggaggctgatgccttcaggaagttcttccccagcgtgcccctgtttggcttctttggaaatggagaaattggctgtgaccgcatcgtgacaggcaacttcatcctgaggaaatgtaatgaggtgaaggatgatgacctcttccacagctacaccaccatcatggccctgatccacctgggcagcagcaagtag

SEQ ID NO: 152202 - DNA, 831 bp, Artificial Sequence
  Description of Artificial Sequence: Synthetic coding sequence
atggagcctgtgggctgctgcggagaatgtcggggcagctctgtggaccccaggagcacctttgtgctgagcaacctggccgaggtggtggagcgggtgctgaccttcctgcctgccaaggccctgctgcgggtggcctgtgtgtgccgcctgtggagagaatgtgtgagaagagtgctgcggacccacaggtctgtgacctggatctctgctggcctggccgaggccggccacctggagggccactgcctggtgcgggtggtggccgaggagctggagaatgtgcgcatcctgccccacacagtgctgtacatggctgacagcgagaccttcatcagcctggaggagtgccggggccacaagagggccaggaagaggacctccatggagacagccctggccctggagaagctgttccccaagcagtgccaggtgctgggcatcgtgaccccaggcatcgtggtgacccccatgggcagcggcagcaaccggccccaggagattgagatcggggagagcggctttgccctgctcttcccccagatcgagggcatcaagatccagcccttccacttcatcaaggaccccaagaacctgaccctggagcggcaccagctgacagaggtgggcctgctggacaaccctgagctgcgggtggtgctggtgtttggctacaactgctgcaaggtgggcgccagcaactacctgcagcaggtggtgtccaccttcagtgacatgaacatcatcctggccggcggccaggtggacaacctgagcagcctgaccagcgagaagtatgtgctgtgtgccagtgactttgtgtgtgagtag

SEQ ID NO: 152203 - DNA, 900 bp, Artificial Sequence
  Description of Artificial Sequence: Synthetic coding sequence
atggctgacagcgagaccttcatcagcctggaggagtgccggggccacaagagggccaggaagaggacctccatggagacagccctggccctggagaagctgttccccaagcagtgccaggtgctgggcatcgtgaccccaggcatcgtggtgacccccatgggcagcggcagcaaccggccccaggagattgagatcggggagagcggctttgccctgctcttcccccagatcgagggcatcaagatccagcccttccacttcatcaaggaccccaagaacctgaccctggagcggcaccagctgacagaggtgggcctgctggacaaccctgagctgcgggtggtgctggtgtttggctacaactgctgcaaggtgggcgccagcaactacctgcagcaggtggtgtccaccttcagtgacatgaacatcatcctggccggcggccaggtggacaacctgagcagcctgaccagcgagaagaaccccctggacattgatgccagcggcgtggtgggcctgtccttcagcggccaccgcatccagagcgccaccgtgctgctgaatgaagatgtgtctgatgagaagacagctgaggccgccatgcagaggctgaaggccgccaacatccctgagcacaacaccatcggcttcatgtttgcctgtgtgggccggggcttccagtactaccgggccaagggaaatgtggaggctgatgccttcaggaagttcttccccagcgtgcccctgtttggcttctttggaaatggagaaattggctgtgaccgcatcgtgacaggcaacttcatcctgaggaaatgtaatgaggtgaaggatgatgacctcttccacagctacaccaccatcatggccctgatccacctgggcagcagcaagtag

SEQ ID NO: 152204 - DNA, 1743 bp, Artificial Sequence
  Description of Artificial Sequence: Synthetic coding sequence
atgggagagaaggctgtgcccctgctgcggcggcggcgggtgaagaggagctgccccagctgtggcagcgagctgggcgtggaggagaagagaggaaaaggaaaccccatcagcatccagctgtttcctcctgagctggtggagcacatcatctccttcctgcctgtgcgggacctggtggccctgggccagacctgccgctacttccacgaggtgtgtgatggagaaggagtgtggaggcgcatctgccggcggctgagcccccggctgcaggaccagggcagcggcgtgcggccctggaagagagctgccatcctgaactacaccaagggcctgtacttccaggcctttggaggaagaagacgctgcctgagcaagtctgtggcccccctgctggcccacggctaccgccgcttcctgcccaccaaggaccacgtgttcatcctggactatgtgggcaccctcttcttcctgaagaatgccctggtgtccaccctgggccagatgcagtggaagagggcctgccgctacgtggtgctgtgccgcggggccaaggactttgccagtgacccccgctgtgacacagtgtacaggaagtacctgtatgtgctggccacccgggagccccaggaggtggtgggcaccaccagcagccgggcctgtgactgtgtggaggtgtacctgcagagcagcggccagagggtcttcaagatgaccttccaccacagcatgaccttcaagcagatcgtgctggtgggccaggagacccagagggccctgctgctgctgacagaggagggcaagatctacagcctggtggtgaatgagacccagctggaccagcccaggagctacacagtgcagctggccctgaggaaggtgagccactacctgccccacctgcgggtggcctgcatgaccagcaaccagagcagcaccctgtatgtgacagaccagggcggcgtgtactttgaggtgcacaccccaggagtgtacagagacctgtttggcaccctgcaggcctttgaccccctggaccagcagatgcccctggccctgagcctgcctgccaagatcctcttctgtgccctgggctacaaccacctgggcctggtggatgaatttggccgcatcttcatgcagggcaacaacagatatggccagctgggcactggagacaagatggacagaggagagcccacccaggtgtgctacctgcagaggcccatcaccctgtggtgtggcctgaaccacagcctggtgctgagccagagcagcgagttcagcaaggagctgctgggctgcggctgtggggccggcggccgcctgcccggctggcccaagggcagcgccagctttgtgaagctgcaggtgaaggtgcccctgtgtgcctgtgccctgtgtgccacccgggagtgcctgtacatcctgagcagccatgacatcgagcagcacgccccctaccgccacctgcctgccagccgggtggtgggcaccccagagcccagcctgggcgcccgggccccccaggaccccggcggcatggcccaggcctgtgaggagtacctgagccagatccacagctgccagaccctgcaggacagaacagagaagatgaaggagatcgtgggctggatgcccctgatggccgcccagaaggacttcttctgggaggccctggacatgctgcagagagctgagggcggcggcggcggcgtgggccccccagcccctgagacctag

SEQ ID NO: 152205 - DNA, 957 bp, Artificial Sequence
  Description of Artificial Sequence: Synthetic coding sequence
atgggagagaaggctgtgcccctgctgcggcggcggcgggtgaagaggagctgccccagctgtggcagcgagctgggcgtggaggagaagagaggaaaaggaaaccccatcagcatccagctgtttcctcctgagctggtggagcacatcatctccttcctgcctgtgcgggacctggtggccctgggccagacctgccgctacttccacgaggtgtgtgatggagaaggagtgtggaggcgcatctgccggcggctgagcccccggctgcaggaccaggacaccaagggcctgtacttccaggcctttggaggaagaagacgctgcctgagcaagtctgtggcccccctgctggcccacggctaccgccgcttcctgcccaccaaggaccacgtgttcatcctggactatgtgggcaccctcttcttcctgaagaatgccctggtgtccaccctgggccagatgcagtggaagagggcctgccgctacgtggtgctgtgccgcggggccaaggactttgccagtgacccccgctgtgacacagtgtacaggaagtacctgtatgtgctggccacccgggagccccaggaggtggtgggcaccaccagcagccgggcctgtgactgtgtggaggtgtacctgcagagcagcggccagagggtcttcaagatgaccttccaccacagcatgaccttcaagcagatcgtgctggtgggccaggagacccagagggccctgctgctgctgacagaggagggcaagatctacagcctggtggtgaatgagacccagctggaccagcccaggagctacacagtgcagctggccctgaggaaggtgagccactacctgccccacctgcgggtggcctgcatgaccagcaaccagagcagcaccctgtatgtgacagaccccatcctgtgctcctggctgcagcccccctggccaggcggctag

SEQ ID NO: 152206 - DNA, 1857 bp, Artificial Sequence
  Description of Artificial Sequence: Synthetic coding sequence
atggtgtgggagagccagcaggagcggggcggccagggcccccggcggcaggagggccgcagccgggagggcgccatccgcatggtgcggggcagccagaggaggaagctgcagaagttcacccggctgtgtggccgggaggagggcctgcgggtgaagaggagctgccccagctgtggcagcgagctgggcgtggaggagaagagaggaaaaggaaaccccatcagcatccagctgtttcctcctgagctggtggagcacatcatctccttcctgcctgtgcgggacctggtggccctgggccagacctgccgctacttccacgaggtgtgtgatggagaaggagtgtggaggcgcatctgccggcggctgagcccccggctgcaggaccagggcagcggcgtgcggccctggaagagagctgccatcctgaactacaccaagggcctgtacttccaggcctttggaggaagaagacgctgcctgagcaagtctgtggcccccctgctggcccacggctaccgccgcttcctgcccaccaaggaccacgtgttcatcctggactatgtgggcaccctcttcttcctgaagaatgccctggtgtccaccctgggccagatgcagtggaagagggcctgccgctacgtggtgctgtgccgcggggccaaggactttgccagtgacccccgctgtgacacagtgtacaggaagtacctgtatgtgctggccacccgggagccccaggaggtggtgggcaccaccagcagccgggcctgtgactgtgtggaggtgtacctgcagagcagcggccagagggtcttcaagatgaccttccaccacagcatgaccttcaagcagatcgtgctggtgggccaggagacccagagggccctgctgctgctgacagaggagggcaagatctacagcctggtggtgaatgagacccagctggaccagcccaggagctacacagtgcagctggccctgaggaaggtgagccactacctgccccacctgcgggtggcctgcatgaccagcaaccagagcagcaccctgtatgtgacagaccagggcggcgtgtactttgaggtgcacaccccaggagtgtacagagacctgtttggcaccctgcaggcctttgaccccctggaccagcagatgcccctggccctgagcctgcctgccaagatcctcttctgtgccctgggctacaaccacctgggcctggtggatgaatttggccgcatcttcatgcagggcaacaacagatatggccagctgggcactggagacaagatggacagaggagagcccacccaggtgtgctacctgcagaggcccatcaccctgtggtgtggcctgaaccacagcctggtgctgagccagagcagcgagttcagcaaggagctgctgggctgcggctgtggggccggcggccgcctgcccggctggcccaagggcagcgccagctttgtgaagctgcaggtgaaggtgcccctgtgtgcctgtgccctgtgtgccacccgggagtgcctgtacatcctgagcagccatgacatcgagcagcacgccccctaccgccacctgcctgccagccgggtggtgggcaccccagagcccagcctgggcgcccgggccccccaggaccccggcggcatggcccaggcctgtgaggagtacctgagccagatccacagctgccagaccctgcaggacagaacagagaagatgaaggagatcgtgggctggatgcccctgatggccgcccagaaggacttcttctgggaggccctggacatgctgcagagagctgagggcggcggcggcggcgtgggccccccagcccctgagacctag

SEQ ID NO: 152207 - DNA, 957 bp, Artificial Sequence; identical to SEQ ID NO: 152205
  Description of Artificial Sequence: Synthetic coding sequence

SEQ ID NO: 152208 - DNA, 1707 bp, Artificial Sequence
  Description of Artificial Sequence: Synthetic coding sequence
atggtgaagaggagctgccccagctgtggcagcgagctgggcgtggaggagaagagaggaaaaggaaaccccatcagcatccagctgtttcctcctgagctggtggagcacatcatctccttcctgcctgtgcgggacctggtggccctgggccagacctgccgctacttccacgaggtgtgtgatggagaaggagtgtggaggcgcatctgccggcggctgagcccccggctgcaggaccagggcagcggcgtgcggccctggaagagagctgccatcctgaactacaccaagggcctgtacttccaggcctttggaggaagaagacgctgcctgagcaagtctgtggcccccctgctggcccacggctaccgccgcttcctgcccaccaaggaccacgtgttcatcctggactatgtgggcaccctcttcttcctgaagaatgccctggtgtccaccctgggccagatgcagtggaagagggcctgccgctacgtggtgctgtgccgcggggccaaggactttgccagtgacccccgctgtgacacagtgtacaggaagtacctgtatgtgctggccacccgggagccccaggaggtggtgggcaccaccagcagccgggcctgtgactgtgtggaggtgtacctgcagagcagcggccagagggtcttcaagatgaccttccaccacagcatgaccttcaagcagatcgtgctggtgggccaggagacccagagggccctgctgctgctgacagaggagggcaagatctacagcctggtggtgaatgagacccagctggaccagcccaggagctacacagtgcagctggccctgaggaaggtgagccactacctgccccacctgcgggtggcctgcatgaccagcaaccagagcagcaccctgtatgtgacagaccagggcggcgtgtactttgaggtgcacaccccaggagtgtacagagacctgtttggcaccctgcaggcctttgaccccctggaccagcagatgcccctggccctgagcctgcctgccaagatcctcttctgtgccctgggctacaaccacctgggcctggtggatgaatttggccgcatcttcatgcagggcaacaacagatatggccagctgggcactggagacaagatggacagaggagagcccacccaggtgtgctacctgcagaggcccatcaccctgtggtgtggcctgaaccacagcctggtgctgagccagagcagcgagttcagcaaggagctgctgggctgcggctgtggggccggcggccgcctgcccggctggcccaagggcagcgccagctttgtgaagctgcaggtgaaggtgcccctgtgtgcctgtgccctgtgtgccacccgggagtgcctgtacatcctgagcagccatgacatcgagcagcacgccccctaccgccacctgcctgccagccgggtggtgggcaccccagagcccagcctgggcgcccgggccccccaggaccccggcggcatggcccaggcctgtgaggagtacctgagccagatccacagctgccagaccctgcaggacagaacagagaagatgaaggagatcgtgggctggatgcccctgatggccgcccagaaggacttcttctgggaggccctggacatgctgcagagagctgagggcggcggcggcggcgtgggccccccagcccctgagacctag

SEQ ID NO: 152209 - DNA, 1104 bp, Artificial Sequence
  Description of Artificial Sequence: Synthetic coding sequence
atgcccttcctgggccaggactggaggagccctggctggagctggatcaagacagaagatggctggaagagatgtgagagctgcagccagaagctggagcgggagaacaaccgctgcaacatcagccacagcatcatcctgaacagtgaagatggagagatcttcaacaatgaggagcacgagtatgccagcaagaagaggaagaaggaccacttcagaaatgacaccaacacccagagcttctaccgggagaagtggatctacgtgcacaaggagagcaccaaggagcggcacggctactgcaccctgggggaggccttcaaccggctggacttcagcagcgccatccaggacatccgccgcttcaactacgtggtgaagctgctgcagctgattgccaagagccagctgaccagcctgtctggagtggcccagaagaactacttcaacatcctggacaagatcgtgcagaaggtgctggatgaccaccacaaccccaggctcatcaaggacctgctgcaggacctgagcagcaccctgtgcatcctgatccggggcgtgggcaagtctgtgctggtgggcaacatcaacatctggatctgccgcctggagaccatcctggcctggcagcagcagctgcaggacctgcagatgaccaagcaggtgaacaacggcctgaccctgagtgacctgcccctgcacatgctgaacaacatcctgtaccgcttcagtgatggctgggacatcatcaccctgggccaggtgacccccaccctgtacatgctgtctgaggaccggcagctgtggaagaagctgtgccagtaccactttgctgagaagcagttctgccgccacctgatcctgtctgagaagggccacatcgagtggaagctgatgtactttgccctgcagaagcactacccagccaaggagcagtatggagacaccctgcacttctgccgccactgcagcatcctcttctggaaggactaccacctggccctgctcttcaaggacagcggccacccctgcacagctgctgaccctgacagctgcttcacccctgtgagcccccagcacttcatcgacctcttcaagttctag

SEQ ID NO: 152210 - DNA, 1077 bp, Artificial Sequence
  Description of Artificial Sequence: Synthetic coding sequence
atgcccttcctgggccaggactggaggagccctggctggagctggatcaagacagaagatggctggaagagatgtgagagctgcagccagaagctggagcgggagaacaaccgctgcaacatcagccacagcatcatcctgaacagtgaagatggagagatcttcaacaatgaggagcacgagtatgccagcaagaagaggaagaaggaccacttcagaaatgacaccaacacccagagcttctaccgggagaagtggatctacgtgcacaaggagagcaccaaggagcggcacggctactgcaccctgggggaggccttcaaccggctggacttcagcagcgccatccaggacatccgccgcttcaactacgtggtgaagctgctgcagctgattgccaagagccagctgaccagcctgtctggagtggcccagaagaactacttcaacatcctggacaagatcgtgcagaaggtgctggatgaccaccacaaccccaggctcatcaaggacctgctgcaggacctgagcagcaccctgtgcatcctgatccggggcgtgggcaagtctgtgctggtgggcaacatcaacatctggatctgccgcctggagaccatcctggcctggcagcagcagctgcaggacctgcagatgaccaagcaggtgaacaacggcctgaccctgagtgacctgcccctgcacatgctgaacaacatcctgtaccgcttcagtgatggctgggacatcatcaccctgggccaggtgacccccaccctgtacatgctgtctgaggaccggcagctgtggaagaagctgtgccagtaccactttgctgagaagcagttctgccgccacctgatcctgtctgagaagggccacatcgagtggaagctgatgtactttgccctgcagaagcactacccagccaaggagcagtatggagacaccctgcacttctgccgccactgcagcatcctcttctggaaggacagcggccacccctgcacagctgctgaccctgacagctgcttcacccctgtgagcccccagcacttcatcgacctcttcaagttctag

SEQ ID NO: 152211 - DNA, 876 bp, Artificial Sequence
  Description of Artificial Sequence: Synthetic coding sequence
atggagaagtacagcatcatgaagtccatgaacatgcacaggaagaagggcaagaggaccatcctggagatgacccagatcctgaagagacatggctactgcaccctgggggaggccttcaaccggctggacttcagcagcgccatccaggacatccgccgcttcaactacgtggtgaagctgctgcagctgattgccaagagccagctgaccagcctgagcggcgtggcccagaagaactacttcaacatcctggacaagatcgtgcagaaggtgctggatgaccaccacaaccccaggctcatcaaggacctgctgcaggacctgagcagcaccctgtgcatcctgatccggggcgtgggcaagtctgtgctggtgggcaacatcaacatctggatctgccgcctggagaccatcctggcctggcagcagcagctgcaggacctgcagatgaccaagcaggtgaacaacggcctgaccctgagtgacctgcccctgcacatgctgaacaacatcctgtaccgcttcagtgatggctgggacatcatcaccctgggccaggtgacccccaccctgtacatgctgtctgaagatcggcagctgtggaagaagctgtgccagtaccactttgctgagaagcagttctgccgccacctgatcctgtctgagaagggccacatcgagtggaagctgatgtactttgccctgcagaagcactacccagccaaggagcagtacggggacaccctgcacttctgccgccactgcagcatcctcttctggaaggacagcggccacccctgcacagctgctgaccctgacagctgcttcacccctgtgagcccccagcacttcatcgacctcttcaagttctag

SEQ ID NO: 152212 - DNA, 876 bp, Artificial Sequence; identical to SEQ ID NO: 152211
  Description of Artificial Sequence: Synthetic coding sequence

SEQ ID NO: 152213 - DNA, 993 bp, Artificial Sequence
  Description of Artificial Sequence: Synthetic coding sequence
atgcccttcctgggccaggactggaggagccctggctggagctggatcaagacagaagatggctggaagagatgtgagagctgcagccagaagctggagcgggagaacaaccgctgcaacatcagccacagcatcatcctgaacagtgaagatggagagatcttcaacaatgaggagcacgagtatgccagcaagaagaggaagaaggaccacttcagaaatgacaccaacacccagagcttctaccgggagaagtggatctacgtgcacaaggagagcaccaaggagcggcacggctactgcaccctgggggaggccttcaaccggctggacttcagcagcgccatccaggacatccgccgcttcaactacgtggtgaagctgctgcagctgattgccaagagccagctgaccagcctgtctggagtggcccagaagaactacttcaacatcctggacaagatcgtgcagaaggtgctggatgaccaccacaaccccaggctcatcaaggacctgctgcaggacctgagcagcaccctgtgcatcctgatccggggcgtgggcaagtctgtgctggtgggcaacatcaacatctggatctgccgcctggagaccatcctggcctggcagcagcagctgcaggacctgcagatgaccaagcaggtgaacaacggcctgaccctgagtgacctgcccctgctgtctgaggaccggcagctgtggaagaagctgtgccagtaccactttgctgagaagcagttctgccgccacctgatcctgtctgagaagggccacatcgagtggaagctgatgtactttgccctgcagaagcactacccagccaaggagcagtatggagacaccctgcacttctgccgccactgcagcatcctcttctggaaggacagcggccacccctgcacagctgctgaccctgacagctgcttcacccctgtgagcccccagcacttcatcgacctcttcaagttctag

SEQ ID NO: 152214 - DNA, 378 bp, Artificial Sequence
  Description of Artificial Sequence: Synthetic coding sequence
atgcccttcctgggccaggactggaggagccctggctggagctggatcaagacagaagatggctggaagagatgtgagagctgcagccagaagctggagcgggagaacaaccgctgcaacatcagccacagcatcatcctgaacagtgaagatggagagatcttcaacaatgaggagcacgagtatgccagcaagaagaggaagaaggaccacttcagaaatgacaccaacacccagagcttctaccgggagaagtggatctacgtgcacaaggagagcaccaaggagcggcacggctactgcaccctgggggaggccttcaaccggctggacttcagcagcgccatccaggacatccgccgcttcaactacgtgtag

SEQ ID NO: 152215 - DNA, 852 bp, Artificial Sequence
  Description of Artificial Sequence: Synthetic coding sequence
atgggcgcctctgtgtcccggggccgggccgcccgggtgcctgcccctgagcctgagcctgaggaggccctggacctgagccagctgcccccagagctgctgctggtggtgctgagccacgtgccccccaggaccctgctgggccgctgccggcaggtgtgccggggctggagggccctggtggatggccaggccctgtggctgctgatcctggcccgggaccatggagccaccggccgggccctgctgcacctggcccggagctgccagagccctgccagaaatgcccggccctgccccctgggccgcttctgtgcccggcggcccatcggcaggaacctgatccggaacccctgtggccaggagggcctgaggaagtggatggtgcagcacggcggagatggctgggtggtggaggagaacagaaccaccgtgcctggggcccccagccagacctgctttgtgaccagcttctcctggtgctgcaagaagcaggtgctggacctggaggaggagggcctgtggccagagctgctggacagcggccgcatcgagatctgtgtgtctgactggtggggcgcccggcatgacagcggctgcatgtaccgcctgctggtgcagctgctggatgccaaccagacagtgctggacaagttctctgctgtgcctgaccccatcccccagtggaacaacaatgcctgcctgcacgtgacccacgtgttcagcaacatcaagatgggcgtgcgctttgtgtcctttgagcaccggggccaggacacccagttctgggccggccactatggagcccgggtgaccaacagctctgtgattgtgcgggtgcggctgtcctag

SEQ ID NO: 152216 - DNA, 852 bp, Artificial Sequence; identical to SEQ ID NO: 152215
  Description of Artificial Sequence: Synthetic coding sequence

SEQ ID NO: 152217 - DNA, 1107 bp, Artificial Sequence
  Description of Artificial Sequence: Synthetic coding sequence
atggctgctgctgctgaggagaggatggccgaggagggcggcggcggccagggagatggcggcagcagcctggccagcggcagcacccagaggcagcccccacctccagccccccagcacccccagcccggcagccaggccctgcctgccccagccctggccccagaccagctgccccagaacaacaccctggtggccctgcccatcgtggccatcgagaacatcctgtccttcatgtcctatgatgagatcagccagctgcggctggtgtgcaagaggatggacctggtgtgccagaggatgctgaaccagggcttcctgaaggtggagcgctaccacaacctgtgccagaagcaggtgaaggcccagctgccccggcgggagagcgagaggaggaaccacagcctggcccggcatgctgacatcctggccgctgtggagacccggctgagcctgctgaacatgaccttcatgaagtatgtggacagcaacctgtgctgcttcatccctgggaaggtgattgatgagatctacagagtgctgcgctacgtgaacagcacccgggccccccagagggcccacgaggtgctgcaggagctgcgggacatcagctccatggccatggagtactttgatgagaagatcgtgcccatcctgaagaggaagctgcccggcagtgatgtgtctggccgcctgatgggcagcccccctgtgcccggccccagcgctgccctgaccaccatgcagctgttcagcaagcagaaccccagccggcaggaggtgaccaagctgcagcagcaggtgaagaccaatggagctggggtgacagtgctgcggcgggagatcagcgagctgcggaccaaggtgcaggagcagcagaagcagctgcaggaccaggaccagaagctgctggagcagacccagatcatcggggagcagaatgcccggctggccgagctggagaggaagctgcgggaggtgatggagagcgctgtgggcaacagcagcggcagcggccagaatgaggagagccccaggaagaggaagaaggccacagaggccatcgacagcctgaggaagagcaagaggctgaggaacaggaagtag

SEQ ID NO: 152218 - DNA, 540 bp, Artificial Sequence
  Description of Artificial Sequence: Synthetic coding sequence
atggctgctgctgctgaggagaggatggccgaggagggcggcggcggccagggagatggcggcagcagcctggccagcggcagcacccagaggcagcccccacctccagccccccagcacccccagcccggcagccaggccctgcctgccccagccctggccccagaccagctgccccagaacaacaccctggtggccctgcccatcgtggccatcgagaacatcctgtccttcatgtcctatgatgagatcagccagctgcggctggtgtgcaagaggatggacctggtgtgccagaggatgctgaaccagggcttcctgaaggtggagcgctaccacaacctgtgccagaagcaggtgaaggcccagctgccccggcgggagagcgagaggaggaaccacagcctggcccggcatgctgacatcctggccgctgtggagacccggctgagcctgctgaacatgaccttcatgaagtatgtggacagcaacctgtgctgcttcatccctgggaagttccaggaccggctgcagccctag

SEQ ID NO: 152219 - DNA, 1416 bp, Artificial Sequence
  Description of Artificial Sequence: Synthetic coding sequence
atggccgccatggagacagaaacagcccccctgaccctggagagcctgcccacagaccccctgctgctgatcctgtccttcctggactacagagacctgatcaactgctgctacgtgtcccggcggctgagccagctgagcagccatgaccccctgtggaggaggcactgcaagaagtactggctgatcagcgaggaggagaagacccagaagaaccagtgctggaagagcctcttcatcgacacctacagtgatgtgggccgctacatcgaccactacgccgccatcaagaaggcctgggatgacctgaagaagtacctggagccccgctgccccaggatggtgctgagcctgaaggagggcgcccgggaggaggacctggatgctgtggaggcccagatcggctgcaagctgcctgatgactaccgctgcagctaccgcatccacaacggccagaagctggtggtgcccggcctgctgggctccatggccctgagcaaccactacagaagtgaggacctgctggatgtggacacagctgctgggggcttccagcagaggcagggcctgaagtactgcctgcccctgaccttctgcatccacacaggcctgagccagtacatcgctgtggaggccgctgagggcaggaacaagaatgaggtgttctaccagtgcccagaccagatggccagaaatcctgctgccatcgacatgttcatcattggagccaccttcacagactggttcaccagctatgtgaagaatgtggtgtctgggggcttccccatcatccgggaccagatcttccgctacgtgcatgaccctgaatgtgtggccaccactggagacatcaccgtgtctgtgtccaccagcttcctgcctgagctgagctctgtgcaccccccccactacttcttcacctaccgcatccgcatcgagatgagcaaggatgccctgcctgagaaggcctgccagctggacagccgctactggaggatcaccaatgccaagggagatgtggaggaggtgcagggccctggggtggtgggggagttccccatcatcagccctggccgggtgtatgagtacaccagctgcaccaccttcagcaccaccagcggctacatggagggctactacaccttccacttcctgtacttcaaggacaagatcttcaacgtggccatcccccgcttccacatggcctgccccaccttccgggtgtccatcgcccggctggagatgggcccagatgaatatgaggagatggaggaggaggaggaggaggaggaggaggaggatgaagatgatgattctgctgacatggatgaaagtgatgaagatgatgaggaggagaggagaagaagagtgtttgatgtgcccatcagaagaagacgctgcagccgcctcttctag

SEQ ID NO: 152220 - DNA, 519 bp, Artificial Sequence
  Description of Artificial Sequence: Synthetic coding sequence
atggagacagaaacagcccccctgaccctggagagcctgcccacagaccccctgctgctgatcctgtccttcctggactacagagacctgatcaactgctgctacgtgtcccggcggctgagccagctgagcagccatgaccccctgtggaggaggcactgcaagaagtactggctgatcagcgaggaggagaagacccagaagaaccagtgctggaagagcctcttcatcgacacctacagtgatgtgggccgctacatcgaccactatgctgccatcaagaaggccggcatgatcagcaggaacatctggagccctggggtgctgggctggtttgtgtccatcaacagaggctgcagccggggccggccccgctgctgcggcagcgctgactggtgcaagctgcctgatgactaccgctgcagctaccgcatccacaacggccagaagctggtggtgcccggcagctactgggaggcctggcactgcctgatcaccatcgtgctgaagatctgctag

SEQ ID NO: 152221 - DNA, 1248 bp, Artificial Sequence
  Description of Artificial Sequence: Synthetic coding sequence
atggccgccatggagacagaaacagcccccctgaccctggagagcctgcccacagaccccctgctgctgatcctgtccttcctggactacagagacctgatcaactgctgctacgtgtcccggcggctgagccagctgagcagccatgaccccctgtggaggaggcactgcaagaagtactggctgatcagcgaggaggagaagacccagaagaaccagtgctggaagagcctcttcatcgacacctacagtgatgtgggccgctacatcgaccactacgccgccatcaagaaggcctgggatgacctgaagaagtacctggagccccgctgccccaggatggtgctgagcctgaaggagggcgcccgggaggaggacctggatgctgtggaggcccagatcggctgcaagctgcctgatgactaccgctgcagctaccgcatccacaacggccagaagctggtggtgcccggcctgctgggctccatggccctgagcaaccactacagaagtgaggacctgctggatgtggacacagctgctgggggcttccagcagaggcagggcctgaagtactgcctgcccctgaccttctgcatccacacaggcctgagccagtacatcgctgtggaggccgctgagggcaggaacaagaatgaggtgttctaccagtgcccagaccagatggccagaaatcctgctgccatcgacatgttcatcattggagccaccttcacagactggttcaccagctatgtgaagaatgtggtgtctgggggcttccccatcatccgggaccagatcttccgctacgtgcatgaccctgaatgtgtggccaccactggagacatcaccgtgtctgtgtccaccagcttcctgcctgagctgagctctgtgcaccccccccactacttcttcacctaccgcatccgcatcgagatgagcaaggatgccctgcctgagaaggcctgccagctggacagccgctactggaggatcaccaatgccaagggagatgtggaggaggtgcagggccctggggtggtgggggagttccccatcatcagccctggccgggtgtatgagtacaccagctgcaccaccttcagcaccaccagcggctacatggagggctactacaccttccacttcctgtacttcaaggacaagatcttcaacgtggccatcccccgcttccacatggcctgccccaccttccgggtgtccatcgcccggctggtgtcctag

SEQ ID NO: 152222 - DNA, 2238 bp, Artificial Sequence
  Description of Artificial Sequence: Synthetic coding sequence
atggaggaggagctgcagcacagccactgtgtgaactgtgtgagccgccgctgcatgaccaggcctgagcccggcatcagctgtgacctgattggctgccccctggtgtgtggggctgtgttccacagctgcaaggcagatgagcaccggctgctgtgcccctttgagcgggtgccctgcctgaacagcgactttggctgccccttcaccatggccaggaacaaggtggccgagcacctggagatgtgcccagcctctgtggtgtgctgcaccatggagtggaaccgctggcctgtgtcctatgctgacaggaagagctatgagaacctgagcagagatgtggatgaggtggcccagctggacatggccctggccctgcaggaccagaggatgctgctggagagcctgaaggtggccaccatgatgagcaaggccacagacaaggtgtccaagccccgggagcagatctctgtgaagagctctgtgcctgagatcccccacgccaacggcctggtgtctgtggatgaggagagctatggagccctgtaccaggccaccgtggagaccaccaggagcctggccgccgccctggacatcctgaacacagccacccgggacatcggcatgctgaacacctctgtgcccaatgacatggatgagcagcagaatgcccgggagagcctggaggaccagaacctgaaggaccaggaccacctgtatgaggaggagatcggggctgtgggcggcatcgactacaatgacaccaaccagaatgcccagagcgagcagaatggcagcagtgacctgctgtgtgacctgaacaccagcagctatgacaccagcgccctgtgcaatggcttccccctggagaacatctgcacccaggtgattgaccagaaccagaacctgcacggggacagcaagcagagcaacctgaccaacggggactgtgtggccagcagtgatggcaccagcaagcccagcagcagcctggccgtggccgcccagctgcgggagatcatccccagcagcgccctgcccaacggcaccgtgcagcacatcctgatgccagatgatgaaggagagggggagctgtgctggaagaaggtggacctgggagatgtgaagaatgtggatgtgctgtccttcagccacgcccccagcttcaacttcctgagcaacagctgctggagcaagcccaaggaggacaaggctgtggacaccagtgacctggaggtggccgaggaccccatgggcctgcagggcatcgacctgatcacagctgccctgctcttctgcctgggggacagccctgggggccggggcatcagtgacagcaggatggctgacatctaccacattgatgtgggcacccagaccttcagcctgcccagcgccatcctggccaccagcaccatggtgggggagatcgccagcgccagcgcctgtgaccacgccaacccccagctgagcaaccccagccccttccagaccctgggcctggacctggtgctggagtgtgtggcccgctaccagcccaagcagaggtccatgttcacctttgtgtgtggccagctgttccggaggaaggagttcagcagccacttcaagaatgtgcacggggacatccatgctggcctgaatggctggatggagcagcgctgccccctggcctactacggctgcacctacagccagaggcgcttctgccccagcatccagggcgccaagatcatccatgacagacacctgcggagctttggagtgcagccctgtgtgtccacagtgctggtggagcccgccaggaactgtgtgctgggcctgcacaatgaccacctgagcagcctgccctttgaggtgctgcagcacatcgccggcttcctggatggcttcagcctgtgccagctgagctgtgtgtccaagctgatgagagatgtgtgtggcagcctgctgcagagccggggcatggtgatcctgcagtggggcaagaggaagtacccagagggcaacagctcctggcagatcaaggagaaggtgtggaggttcagcacagccttctgcagcgtgaatgagtggaagtttgctgacatcctgtccatggctgaccacctgaagaagtgcagctacaacgtggtggagaagcgggaggaggccatccccctgccctgcatgtgtgtgacccgggagctgaccaaggagggccgcagcctgcggtctgtgctgaagcctgtgctgtag

SEQ ID NO: 152223 - DNA, 1620 bp, Artificial Sequence
  Description of Artificial Sequence: Synthetic coding sequence
atggctgtgtgtgcccggctgtgtggggtgggccccagccggggctgcagaagacggcagcagaggcggggccctgctgagacagctgctgctgacagcgagccagacacagatcctgaggaggagcgcatcgaggccagcgctggggtgggcggcggcctgtgtgccggccccagccccccaccaccccgctgcagcctgctggagctgcccccagagctgctggtggagatctttgccagcctgcctggaacagacctgcccagcctggcccaggtgtgcaccaagttccgccgcatcctgcacacagacaccatctggaggcggcgctgccgggaggagtatggagtgtgtgagaacctgaggaagctggagatcactggagtgtcctgcagagatgtgtatgccaagctgctgcaccgctaccgccacatcctgggcctgtggcagcctgacatcggcccctacggcggcctgctgaatgtggtggtggatggcctcttcatcatcggctggatgtacctgccccctcatgacccccacgtggatgaccccatgaggttcaagcccctcttccgcatccacctgatggagaggaaggccgccaccgtggagtgcatgtatggccacaagggcccccaccacggccacatccagatcgtgaagaaggatgagttcagcaccaagtgcaaccagacagaccaccacaggatgtctgggggccggcaggaggagttccgcacctggctgcgggaggagtggggccgcaccctggaggacatcttccacgagcacatgcaggagctgatcctgatgaagttcatctacaccagccagtatgacaactgcctgacctaccgccgcatctacctgccccccagcaggccagatgacctgatcaagccaggcctcttcaagggcacctacggcagccacggcctggagatcgtgatgctgtccttccacggccggcgggcccggggcaccaagatcaccggggaccccaacatcccagctggccagcagacagtggagattgacctgcggcaccgcatccagctgcctgacctggagaaccagaggaacttcaatgagctgagcagaattgtgctggaggtgcgggagcgggtgcggcaggagcagcaggagggcggccacgaggccggggagggccggggccggcagggcccccgggagagccagcccagccctgcccagcccagggctgaggcccccagcaagggcccagatggcaccccaggagaagatggaggagagcctggagatgctgtggccgctgctgagcagcctgcccagtgtggccagggccagccctttgtgctgcctgtgggcgtgagcagcagaaatgaagactaccccaggacctgcaggatgtgcttctacggcaccggcctgattgctggccacggcttcaccagccctgagaggaccccaggagtcttcatcctgtttgatgaagatcgcttcggctttgtgtggctggagctgaagagcttcagcctgtacagccgggtgcaggccaccttcagaaatgctgatgcccccagcccccaggcctttgatgagatgctgaagaacatccagagcctgaccagctag

SEQ ID NO: 152224 - DNA, 1068 bp, Artificial Sequence
  Description of Artificial Sequence: Synthetic coding sequence
atgcccttcctgggccaggactggaggagccctggccagaactgggtgaagacagcagatggctggaagcgcttcctggatgagaagagcggcagctttgtgtctgacctgagcagctactgcaacaaggaggtgtacaacaaggaaaatctcttcaacagcctgaactatgatgtggccgccaagaagaggaagaaggacatgctgaacagcaagaccaagacccagtacttccaccaggagaagtggatctacgtgcacaagggcagcaccaaggagagacatggctactgcaccctgggggaggccttcaaccggctggacttcagcacagccatcctggacagccgccgcttcaactacgtggtgcggctgctggagctgattgccaagagccagctgaccagcctgagcggcatcgcccagaagaacttcatgaacatcctggagaaggtggtgctgaaggtgctggaggaccagcagaacatccgcctcatccgggagctgctgcagaccctgtacaccagcctgtgcaccctggtgcagagggtgggcaagtctgtgctggtgggcaacatcaacatgtgggtgtacaggatggagaccatcctgcactggcagcagcagctgaacaacatccagatcaccaggcctgccttcaagggcctgaccttcacagacctgcccctgtgcctgcagctgaacatcatgcagaggctgagtgatggccgggacctggtgtccctgggccaggccgccccagacctgcacgtgctgtctgaagatcggctgctgtggaagaagctgtgccagtaccacttcagcgagcggcagatcaggaagaggctcatcctgagtgacaagggccagctggactggaagaagatgtacttcaagctggtgcgctgctaccccaggaaggagcagtacggggacaccctgcagctgtgcaagcactgccacatcctgtcctggaagggcacagaccacccctgcacagccaacaaccctgagagctgcagcgtgtccctgagcccccaggacttcatcaacctcttcaagttctag

SEQ ID NO: 152225 - DNA, 789 bp, Artificial Sequence
  Description of Artificial Sequence: Synthetic coding sequence
atgcccttcctgggccaggactggaggagccctggccagaactgggtgaagacagcagatggctggaagcgcttcctggatgagaagagcggcagctttgtgtctgacctgagcagctactgcaacaaggaggtgtacaacaaggaaaatctcttcaacagcctgaactatgatgtggccgccaagaagaggaagaaggacatgctgaacagcaagaccaagacccagtacttccaccaggagaagtggatctacgtgcacaagggcagcaccaaggagagacatggctactgcaccctgggggaggccttcaaccggctggacttcagcacagccatcctggacagccgccgcttcaactacgtggtgcggcctgccttcaagggcctgaccttcacagacctgcccctgtgcctgcagctgaacatcatgcagaggctgagtgatggccgggacctggtgtccctgggccaggccgccccagacctgcacgtgctgtctgaggaccggctgctgtggaagaagctgtgccagtaccacttcagcgagcggcagatcaggaagaggctcatcctgagtgacaagggccagctggactggaagaagatgtacttcaagctggtgcgctgctaccccaggaaggagcagtatggagacaccctgcagctgtgcaagcactgccacatcctgtcctggaagggcacagaccacccctgcacagccaacaaccctgagagctgcagcgtgtccctgagcccccaggacttcatcaacctcttcaagttctag

SEQ ID NO: 152226 - DNA, 1668 bp, Artificial Sequence
  Description of Artificial Sequence: Synthetic coding sequence
atgctgctcttcctgtctgtgccccagccccggcccccaggggcccggaccagggctggagctgcccgggtggcccgctggaggcggctgcggctgcagcagctgcggcggctgcggggcctgctgcgggtgctgcggggccggcctggagctggcagcagaagaagaggccgcatggccctgtgtggccaggccgccggggccgccagcctgcccagcgagctgattgtgcacatcttctccttcctgcctgccccagaccggctgcgggccagcgccagctgcagccactggagggagtgcctcttctacccagccctgtggccccagctgcgcatctgcctgcgggtgtccccagctgagcagccccggctggagttcctgatgaggaaatgtggctggtttgtgcgggagctgcgggtggagtttgctgctgagaactacctgagcggcggcggccctggagatggcggcggcgctgacaccggcaccggcggggaggaggtggaggccctgcagctgagcgcccgctggctggaggtgctgcggacctacctggagctggtgctgtgtgtgctggtgtccatccggaacaacagaaacctgcagaagttcagcctgtttggagacatctctgtgctgcagcagcagggcagcctgagcaacacctacctgagcaaggtggaccctgatggcaagaagatcaagcagatccagcagctgtttgaggagatcctgagcaacagccggcagctgaagtggctgagctgtggcttcatgctggagatcgtgacccccaccagcctgagcagcctgagcaatgctgtggccaacaccatggagcacctgagcctgctggacaacaacatccctggcaacagcaccctcatcacagctgtggagctggagagatttgtgaacctgcacagcctggccctggacttctgtgacttcaccgctgagatggcccgggtgctgacagacagcaaccacgtgcccctgcagaggctgagcctgctggtgcacaacgtgtctgtgatgcacaagagcctggacaacatgcccaatgatgagcactggaaggccctgagcaggaagagcaccagcttccgggtgtacatcatggcctttgacatcaagtctgaggacatgctgaagatcctgaagcccagcatccccctggagcgcatccactttgacagctacatcacctgtgtgtctggggccatcgtggacctgatcagccggcagtatgacaagttcctgacccacttcatcctgatgaatgatgtgattgacaccagcggcttcccagacctgagtgacaacagaaatgaagaccccctggtgctgctggcctggcgctgcaccaagctgagcctgctggccatccacggctacacagtgtgggcccacaacctgattgccatcgcccggctgcggggcagtgacctgaaggtgctggaggtgacagaggagagcattgactttgaccagggcgagctggccgaccaggatgtggaccctgtgcacaacctgattgagcaggtgtccctgggcctgggccagccctggcatgctgtgatggacatcgagagcctgtctgtgttcacagagcccaacagacacttctaccgggagatgcagagcttcagcgaggacatctag

SEQ ID NO: 152227 - DNA, 9 bp, Artificial Sequence
  Description of Artificial Sequence: Synthetic coding sequence
atgaggtag

SEQ ID NO: 152228 - DNA, 2136 bp, Artificial Sequence
  Description of Artificial Sequence: Synthetic coding sequence
atgcacctgaagccctactggaagctgcagaagaaggagcaccccccagaggtgtcccgggagacccagaggacccccatgaaccaccagaaggctgtgaatgatgagacctgcaaggccagccacatcaccagcagcgtcttccccagcgccagcctgggcaaggccagcagcaggaagcccttcggcatcctgagccccaacgtgctgtgcagcatgtctgggaagagccctgtggagagcagcctgaatgtgaagaccaagaagaatgcccccagcgccaccatccaccagggcgaggaggagggccccctggacatctgggccgtggtgaagccaggcaacaccaaggagaagatcgccttctttgccagccaccagtgcagcaaccgcatcggctccatgaagatcaagagctcctgggacattgatggccgggccaccaagaggaggaagaagagcggggacctgaagaaggccaaggtgcaggtggagaggatgagggaggtgaacagccgctgctaccagcctgagccctttgcctgtggcatcgagcactgcagcgtgcactacgtgtctgattctggagatggagtgtatgccggccggcccctgagcgtcatccagatggtggccttcctggagcagagggccagcgccctgctggccagctgcagcaagaactgcaccaacagccctgccatcgtgcgcttcagcggccagagccggggcgtgcctgctgtgtctgagagctacagcgcccctggggcctgtgaggagcccacagagcggggcaacctggaggtgggggagccccagagcgagcctgtgcgggtgctggacatggtggccaagctggagagtgaatgtctgaagaggcagggccagcgggagcccggcagcctgagcaggaacaacagcttcagaagaaatgtgggccgggtgctgctggccaacagcacccaggctgatgagggcaagaccaagaagggcgtgctggaggccccagacacccaggtgaaccctgtgggctctgtgtctgtggactgtggccccagcagagctgaccgctgcagccccaaggaggaccaggcctgggatggagccagccaggactgcccccccctgcctgctggggtgtccttccacatcgacagcgctgagctggagcccggcagccagacagctgtgaagaacagcaacagatatgatgtggagatgacagatgagctggtgggcctgcccttcagcagccacacctacagccaggccagcgagctgcccacagatgctgtggactgcatgagccgggagctggtgtccctgaccagcagaaatccagaccagaggaaggagagcctgtgcatcagcatcaccgtgtccaaggtggacaaggaccagcccagcatcctgaacagctgtgaagatcctgtgcccggcatgctgttcttcctgcccccaggccagcacctgagtgactacagccagctgaatgaaagcaccaccaaggagagcagcgaggccagccagctggaggatgctgctggaggagacagcgccagcgaggagaagagcggcagcgctgagccctttgtgctgcctgccagctctgtggagagcaccctgcctgtgctggaggccagctcctggaagaagcaggtgtcccatgacttcctggagacccgcttcaagatccagcagctgctggagccccagcagtacatggccttcctgccccaccacatcatggtgaagatcttccggctgctgcccaccaagagcctggtggccctgaagtgcacctgctgctacttcaagttcatcatcgagtactacaacatccggcctgctgacagccgctgggtgcgggacccccgctaccgggaggacccctgcaagcagtgcaagaagaagtatgtgaagggagatgtgtccctgtgccgctggcaccccaagccctactgccaggccctgccctacggccctggctactggatgtgctgccacaggagccagaagggcttccctggctgcaagctgggcctgcatgacaaccactgggtgcctgcctgccacagcttcaacagagccatccacaagaaggccaagggcacagaagctgaggaggagtactag

SEQ ID NO: 152229 - DNA, 2136 bp, Artificial Sequence; identical to SEQ ID NO: 152228
  Description of Artificial Sequence: Synthetic coding sequence

SEQ ID NO: 152230 - DNA, 567 bp, Artificial Sequence
  Description of Artificial Sequence: Synthetic coding sequence
atggcctcctggctgcctgagaccctgtttgagaccgtgggccagggccccccacccagcaaggactactaccagctgctggtgaccaggagccaggtgatcttccgctggtggaagatcagcctgcggtctgagtaccgcagcaccaagccaggagaggccaaggagacccatgaggacttcctggagaacagccacctgcagggccagacagccctgatctttggagcccgcatcctggactatgtgatcaacctgtgcaagggcaagtttgacttcctggagcggctgagtgatgacctgctgctgaccatcatctcctacctggacctggaggacatcgcccggctgtgccagaccagccacagatttgccaagctgtgcatgtctgacaagctgtgggagcagatcgtgcagagcacctgtgacaccatcaccccagatgtgcgggccctggccgaggacaccggctggaggcagctgttcttcaccaacaagctgcagctgcagaggcagctgaggaagaggaagcagaagtatggcaacctgcgggagaagcagccctag

SEQ ID NO: 152231 - DNA, 2832 bp, Artificial Sequence
  Description of Artificial Sequence: Synthetic coding sequence
atgggccccaggaagaagtctgtgaagacctgcatcatgaacaatgagatccctgaggagatgacagcagatgagaccaaggactacatgaaccagctgagccatgaggtgctgtgccacatcttccgctacctgcccctgcaggacatcatgtgcatggagtgcctgagcaggaagctgaaggaggccgtgaccctgtacctgcgggtggtgcgggtggtggacctgtgtgccggccgctggtgggagtacatgcccagcggcttcacagatgccagcttcctgaccctgctgaagaagatgccagatgtggagcagctgtatggcctgcacccccgctacctggagcggcggcgggtgcggggccacgaggccttcagcatccctggggtgctggaggccctgcaggcctgccccaacctggtgggcgtggagaccagccacctggagctggtggagagcatctggacctacatgcctcatgtgcacatcctgggcaagttcaggaacagaaatggagccttccccatccccccagagaacaagctgaagatccccatcggggccaagatccagaccctgcacctggtgggcgtgaatgtgcctgagatcccctgcatccccatgctgcggcacctgtacatgaagtgggtgcggctgaccaagccccagcccttcaaggacttcctgtgcatcagcctgcggacctttgtgatgaggaactgtgccggccccaccaacagcctgaagtatgtgcccctggtgacaggcctggccagcgccaggaacctggagcacctggagatggtgcgggtgcccttcctgggcggcctcatccagcacgtggtggaggacagctggaggtctgggggcttcaggaacctgcacaccatcgtgctgggcgcctgcaagaatgccctggaggtggacctgggctacctgatcatcacagctgcccggcggctgcacgaggtgcgcatccagcccagcctgaccaaggatggagtcttcagcgccctgaagatggccgagctggagttcccccagtttgagaccctgcacctgggctacgtggatgagttcctgctgcagagcaggatggccaatgctgacctggtgaagtatggcctggctgatgtggtggagaaccctggcatcatcacagacatcggcatgaaggctgtgaatgaggtgttcagctgcatcaagtacctggccatctacaactgcccccacctgcacaacccctacaactggatcagtgaccacagccgctggacccggctggtggacatcaacctggtgcgctgccacgccctgaagctggacagctttggccagttcatcgagctgctgcccagcctggagttcatcagcctggaccagatgttccgggagccccccaagggctgtgcccgggtgggcctgtctgctggcaccggcatcggcgtgagcagcgccctggtgagcaaccagaacagcaacaatgatgacaacaatgcccagaacaacaatgccaacatccatgacaacaaccaccaccacccagatgacagtgatgaggagaatgacttccggcaggacctgcagcctggagagcagcagtttgctgctgatgccctgaatgagatggaggacatcgtgcaggaggatggagaggtggtggccgagagcggcaacaacaccccagcccacagccaggccatcatccctgtggatgtggatgaggagcaggccggccccagcggcctgcagagggtggtgaagcccaccagcatcaccgtgcatgacagcgagagtgatgatgaggaggacagcctggagctgcaggaggtgtggatccccaagaatggcacccggcgctacagcgagcgggaggagaagacaggagagagcgtgcagagccgggagctgtctgaggtggccaagaccaagcccaggcatgccatgaagaggaagaggacagctgacaagagcaccagcaccagtgaccctgtgattgaagatgaccacgtgcaggtgctggtgctgaagagcaagaacctggtgggcgtgaccatgaccaactgtggcatcacagacctggtgctgaaggactgccccaagatgatgttcatccacgccacccgctgccgggtgctgaagcacctgaaggtggagaatgcccccatcgtgaacagatttgattatgcccagtgcaagaagctgaacatggaccaggtgctggaccagatcctgaggatgcctcctgagaggaaccgcatcatctacctgcggcccatgcagcaggtggacaccctgaccctggagcagaagctgttcagcggcccctacccctaccacatctgcatcatccacgagttcagcaaccccccaaatgtgaggaacaaggtgcgcatccgctcctggatggacaccatcgccaacatcaaccaggagctgatcaagtatgagttcttccctgaggccaccaggtctgaggaggacctgaagaagtaccccaagtacccctggggccgggagatctacaccctggagggcgtggtggatggagccccctacagcatgatcagtgacttcccctggctgcggagcctgcgggctgctgagcccaacagctttgcccgctatgactttgaagatgatgaggagagcaccatctatgcccccaggaggaagggccagctgtctgctgacatctgcatggagaccatcggggaggagatcagcgagatgaggcagatgaagaagggcgtcttccagagggtggtggccatcttcatccactactgtgatgtgaatggagagcctgtggaggatgactacatctag

SEQ ID NO: 152232 - DNA, 3567 bp, Artificial Sequence
  Description of Artificial Sequence: Synthetic coding sequence
atgggccccaggaagaagtctgtgaagacctgcatcatgaacaatgagatccctgaggagatgacagcagatgagaccaaggactacatgaaccagctgagccatgaggtgctgtgccacatcttccgctacctgcccctgcaggacatcatgtgcatggagtgcctgagcaggaagctgaaggaggccgtgaccctgtacctgcgggtggtgcgggtggtggacctgtgtgccggccgctggtgggagtacatgcccagcggcttcacagatgccagcttcctgaccctgctgaagaagatgccagatgtggagcagctgtatggcctgcacccccgctacctggagcggcggcgggtgcggggccacgaggccttcagcatccctggggtgctggaggccctgcaggcctgccccaacctggtgggcgtggagaccagccacctggagctggtggagagcatctggacctacatgcctcatgtgcacatcctgggcaagttcaggaacagaaatggagccttccccatccccccagagaacaagctgaagatccccatcggggccaagatccagaccctgcacctggtgggcgtgaatgtgcctgagatcccctgcatccccatgctgcggcacctgtacatgaagtgggtgcggctgaccaagccccagcccttcaaggacttcctgtgcatcagcctgcggacctttgtgatgaggaactgtgccggccccaccaacagcctgaagtatgtgcccctggtgacaggcctggccagcgccaggaacctggagcacctggagatggtgcgggtgcccttcctgggcggcctcatccagcacgtggtggaggacagctggaggtctgggggcttcaggaacctgcacaccatcgtgctgggcgcctgcaagaatgccctggaggtggacctgggctacctgatcatcacagctgcccggcggctgcacgaggtgcgcatccagcccagcctgaccaaggatggagtcttcagcgccctgaagatggccgagctggagttcccccagtttgagaccctgcacctgggctacgtggatgagttcctgctgcagagcaggatggccaatgctgacctggtgaagtatggcctggctgatgtggtggagaaccctggcatcatcacagacatcggcatgaaggctgtgaatgaggtgttcagctgcatcaagtacctggccatctacaactgcccccacctgcacaacccctacaactggatcagtgaccacagccgctggacccggctggtggacatcaacctggtgcgctgccacgccctgaagctggacagctttggccagttcatcgagctgctgcccagcctggagttcatcagcctggaccagatgttccgggagccccccaagggctgtgcccgggtgggcctgtctgctggcaccggcatcggcgtgagcagcgccctggtgagcaaccagaacagcaacaatgatgacaacaatgcccagaacaacaatgccaacatccatgacaacaaccaccaccacccagatgacagtgatgaggagaatgacttccggcaggacctgcagcctggagagcagcagtttgctgctgatgccctgaatgagatggaggacatcgtgcaggaggatggagaggtggtggccgagagcggcaacaacaccccagcccacagccaggccatcatccctgtggatgtggatgaggagcaggccggccccagcggcctgcagagggtggtgaagcccaccagcatcaccgtgcatgacagcgagagtgatgatgaggaggacagcctggagctgcaggaggtgtggatccccaagaatggcacccggcgctacagcgagcgggaggagaagacaggagagagcgtgcagagccgggagctgtctgtgtctgggaagggcaagacccccctgaggaagcgctacaacagccaccagatgggccagagcaagcagttccccctggaggagagcagctgtgagaagggctgccaggtgaccagcgagcagatcaaggctgacatgaaggccgcccgggacatccctgagaagaagaagaacaaggatgtgtaccccagctgcagcagcaccacagccagcacagtgggcaacagcagcagccacaacacagccagccagagcccagactttgtgaggacagtgaacagcggcggcagcagcgagcccagccccacagaggtggatgtgtcccggcagtgtgcctgcagccctgggggcagcgaggacagcgaggccatggaggagggagatgctgagagctctgtgtgcccccgctgctgctgccaccggccccaggagagccagaggaggaccagccgctgcagtgatgaggagcggcccagcaccagccgggcctgtgtggtgaatggaccagatggcaccaggtctgccttctccttccgcaccctgccccagggcggcagcagcggccctgcccatgatgagaggaccaatggaagtggcagcggggccaccggggaggaccggcggggcagcagccagcctgagagctgtgatgtgcagagcaatgaagactacccccggcggcccctgacccgggcccggagccggctgagccacgtgctgctggtgtctgagagcgaggtggccaagaccaagcccaggcatgccatgaagaggaagaggacagctgacaagagcaccagcaccagtgaccctgtgattgaagatgaccacgtgcaggtgctggtgctgaagagcaagaacctggtgggcgtgaccatgaccaactgtggcatcacagacctggtgctgaaggactgccccaagatgatgttcatccacgccacccgctgccgggtgctgaagcacctgaaggtggagaatgcccccatcgtgaacagatttgattatgcccagtgcaagaagctgaacatggaccaggtgctggaccagatcctgaggatgcctcctgagaggaaccgcatcatctacctgcggcccatgcagcaggtggacaccctgaccctggagcagaagctgttcagcggcccctacccctaccacatctgcatcatccacgagttcagcaacccccccaacgtgaggaacaaggtgcgcatccgctcctggatggacaccatcgccaacatcaaccaggagctgatcaagtatgagttcttccctgaggccaccaggtctgaggaggacctgaagaagtaccccaagtacccctggggccgggagatctacaccctggagggcgtggtggatggagccccctacagcatgatcagtgacttcccctggctgcggagcctgcgggctgctgagcccaacagctttgcccgctatgactttgaagatgatgaggagagcaccatctatgcccccaggaggaagggccagctgtctgctgacatctgcatggagaccatcggggaggagatcagcgagatgaggcagatgaagaagggcgtcttccagagggtggtggccatcttcatccactactgtgatgtgaatggagagcctgtggaggatgactacatctag

SEQ ID NO: 152233 - DNA, 3342 bp, Artificial Sequence
  Description of Artificial Sequence: Synthetic coding sequence
atgggccccaggaagaagtctgtgaagacctgcatcatgaacaatgagatccctgaggagatgacagcagatgagaccaaggactacatgaaccagctgagccatgaggtgctgtgccacatcttccgctacctgcccctgcaggacatcatgtgcatggagtgcctgagcaggaagctgaaggaggccgtgaccctgtacctgcgggtggtgcgggtggtggacctgtgtgccggccgctggtgggagtacatgcccagcggcttcacagatgccagcttcctgaccctgctgaagaagatgccagatgtggagcagctgtatggcctgcacccccgctacctggagcggcggcgggtgcggggccacgaggccttcagcatccctggggtgctggaggccctgcaggcctgccccaacctggtgggcgtggagaccagccacctggagctggtggagagcatctggacctacatgcctcatgtgcacatcctgggcaagttcaggaacagaaatggagccttccccatccccccagagaacaagctgaagatccccatcggggccaagatccagaccctgcacctggtgggcgtgaatgtgcctgagatcccctgcatccccatgctgcggcacctgtacatgaagtgggtgcggctgaccaagccccagcccttcaaggacttcctgtgcatcagcctgcggacctttgtgatgaggaactgtgccggccccaccaacagcctgaagtatgtgcccctggtgacaggcctggccagcgccaggaacctggagcacctggagatggtgcgggtgcccttcctgggcggcctcatccagcacgtggtggaggacagctggaggtctgggggcttcaggaacctgcacaccatcgtgctgggcgcctgcaagaatgccctggaggtggacctgggctacctgatcatcacagctgcccggcggctgcacgaggtgcgcatccagcccagcctgaccaaggatggagtcttcagcgccctgaagatggccgagctggagttcccccagtttgagaccctgcacctgggctacgtggatgagttcctgctgcagagcaggatggccaatgctgacctggtgaagtatggcctggctgatgtggtggagaaccctggcatcatcacagacatcggcatgaaggctgtgaatgaggtgttcagctgcatcaagtacctggccatctacaactgcccccacctgcacaacccctacaactggatcagtgaccacagccgctggacccggctggtggacatcaacctggtgcgctgccacgccctgaagctggacagctttggccagttcatcgagctgctgcccagcctggagttcatcagcctggaccagatgttccgggagccccccaagggctgtgcccgggtgggcctgtctgctggcaccggcatcggcgtgagcagcgccctggtgagcaaccagaacagcaacaatgatgacaacaatgcccagaacaacaatgccaacatccatgacaacaaccaccaccacccagatgacagtgatgaggagaatgacttccggcaggacctgcagcctggagagcagcagtttgctgctgatgccctgaatgagatggaggacatcgtgcaggaggatggagaggtggtggccgagagcggcaacaacaccccagcccacagccaggccatcatccctgtggatgtggatgaggagcaggccggccccagcggcctgcagagggtggtgaagcccaccagcatcaccgtgcatgacagcgagagtgatgatgaggaggacagcctggagctgcaggaggtgtggatccccaagaatggcacccggcgctacagcgagcgggaggagaagacaggagagagcgtgcagagccgggagctgtctgtgtctgggaagggcaagacccccctgaggaagcgctacaacagccaccagatgggccagagcaagcagttccccctggaggagagcagctgtgagaagggctgccaggtgaccagcgagcagatcaaggctgacatgaaggccgcccgggacatccctgagaagaagaagaacaaggatgtgtaccccagctgcagcagcaccacagccagcacagtgggcaacagcagcagccacaacacagccagccagagcccagactttgtgaggacagtgaacagcggcggcagcagcgagcccagccccacagaggtggatgtgtcccggcagtgtgcctgcagccctgggggcagcgaggacagcgaggccatggaggagggagatgctgagagctctgtgtgcccccgctgctgctgccaccggccccaggagagccagaggaggaccagccgctgcagtgatgaggagcggcccagcaccagccgggcctgtgtggtgaatggaccagatgaggtggccaagaccaagcccaggcatgccatgaagaggaagaggacagctgacaagagcaccagcaccagtgaccctgtgattgaagatgaccacgtgcaggtgctggtgctgaagagcaagaacctggtgggcgtgaccatgaccaactgtggcatcacagacctggtgctgaaggactgccccaagatgatgttcatccacgccacccgctgccgggtgctgaagcacctgaaggtggagaatgcccccatcgtgaacagatttgattatgcccagtgcaagaagctgaacatggaccaggtgctggaccagatcctgaggatgcctcctgagaggaaccgcatcatctacctgcggcccatgcagcaggtggacaccctgaccctggagcagaagctgttcagcggcccctacccctaccacatctgcatcatccacgagttcagcaaccccccaaatgtgaggaacaaggtgcgcatccgctcctggatggacaccatcgccaacatcaaccaggagctgatcaagtatgagttcttccctgaggccaccaggtctgaggaggacctgaagaagtaccccaagtacccctggggccgggagatctacaccctggagggcgtggtggatggagccccctacagcatgatcagtgacttcccctggctgcggagcctgcgggctgctgagcccaacagctttgcccgctatgactttgaagatgatgaggagagcaccatctatgcccccaggaggaagggccagctgtctgctgacatctgcatggagaccatcggggaggagatcagcgagatgaggcagatgaagaagggcgtcttccagagggtggtggccatcttcatccactactgtgatgtgaatggagagcctgtggaggatgactacatctag

SEQ ID NO: 152234 - DNA, 2832 bp, Artificial Sequence; identical to SEQ ID NO: 152231
  Description of Artificial Sequence: Synthetic coding sequence

SEQ ID NO: 152235 - DNA, 1329 bp, Artificial Sequence
  Description of Artificial Sequence: Synthetic coding sequence
atggatgaggagagcgagctgatccagccccaggaccagagctgctgggccttcctgcctgacctgtgcctgtgcagggtcttctggtggctgggggaccgggacaggagcagagctgccctggtgtgcaggaagtggaaccagatgatgtacagcgctgagctgtggagataccgcaccatcaccttcagcggccggcccagccgggtgcacgccagcgaggtggagagcgctgtgtggtacgtgaagaagtttggccgctacctggagcacctggaggtgaagttcatgaacccctacaatgctgtgctgaccaagaagttccaggtgaccatgaggggcctgctgagctgcctgagcaagagcaacaaccggctgaagagcctgagcatccagtacctggagctggaccggctggtgtggaggaacagcatccgcagcagcttcatcagcagcctgtccttcttcctgaagaagatgggcaagaggctggactacctgaacctgaagggggcccggctgactgtggagcagggctgccagatcctggacagcctgagctacatgagaaatgaaaatgtcatcagcgagctgaacatcgaggactacttcagccaccacctggccgtgtacaacagcccccagttcaagaagaccatgagcaccttccacaacctggtgtccctgaacctgaactacaactgcatcagtgatgagctgctggagaacctgtgtgaaaatgccagcaccctgcggaccatcaacatcaagtgccacgtgcatgacccccacggccaggtgatctggggcatgtcctgggccaagctggcccggcaggccaccaacctgaaggtgaacttcttctttgagcgcatcatgaagtatgagcggctggcccgcatcctgctgcaggagatccccatccgcagcatcagcctgcggagctgctacttcagtgaccctgactgcagcatgaggcccaccctgattgacctgctgcccaccttccgccacaccctgcagaagctgacctgtgagttcaacaacaaccacgagagcctggatgaggagctgcacctgctgatcatcagctgcaggaagctgttctacttcaagatctgggccttcctggatgtgtcctttgtggagcgcatcctgaagagccagaaggagcggcagtgtgccctgcgggtcttcaaggcccgcatctacaccaacagatatgagaccaatgaggaggacaagaccctgcaggagatctacaggaagtacaggaagctgattgagagcgagctgagctactttgtgattgtgtacagcgtgatgtag

SEQ ID NO: 152236 - DNA, 1164 bp, Artificial Sequence
  Description of Artificial Sequence: Synthetic coding sequence
atggccggcagcgagcccaggagcggcaccaacagccccccaccacccttcagtgactggggccgcctggaggccgccatcctgagcggctggaagaccttctggcagagcgtgtccaaggagcgggtggcccggaccaccagccgggaggaggtggatgaagctgccagcaccctgacccggctgcccattgatgtgcagctgtacatcctgtccttcctgagcccccatgacctgtgccagctgggcagcaccaaccactactggaatgagaccgtgcgggaccccatcctgtggagatacttcctgctgcgggacctgcccagctggagctctgtggactggaagagcctgcctgacctggagatcctgaagaagcccatcagcgaggtgacagatggagccttctttgactacatggctgtgtacaggatgtgctgcccctacacccggcgggccagcaagagcagccggcccatgtatggagctgtgaccagcttcctgcacagcctcatcatccagaatgagcccaggtttgccatgtttggacctggcctggaggagctgaacaccagcctggtgctgagcctgatgagcagcgaggagctgtgccccacagctggcctgccccagaggcagattgatggcatcggcagcggcgtgaacttccagctgaacaaccagcacaagttcaacatcctgatcctgtacagcaccaccaggaaggagcgggaccgggcccgggaggagcacaccagcgctgtgaacaagatgttcagccgccacaatgaaggagatgaccagcagggcagccgctacagcgtcatcccccagatccagaaggtgtgtgaggtggtggatggcttcatctacgtggccaatgctgaggcccacaagagacatgagtggcaggatgagttcagccacatcatggccatgacagatcctgccttcggcagcagcggccggcccctgctggtgctgagctgcatcagccagggagatgtgaagaggatgccctgcttctacctggcccacgagctgcacctgaacctgctgaaccacccctggctggtgcaggacacagaggccgagaccctgaccggcttcctgaatggcatcgagtggatcctggaggaggtggagagcaagagggccaggtag

SEQ ID NO: 152237 - DNA, 924 bp, Artificial Sequence
  Description of Artificial Sequence: Synthetic coding sequence
atggccggcagcgagcccaggagcggcaccaacagccccccaccacccttcagtgactggggccgcctggaggccgccatcctgagcggctggaagaccttctggcagagcgtgtccaaggagcgggtggcccggaccaccagccgggaggaggtggatgaagctgccagcaccctgacccggctgcccattgatgtgcagctgtacatcctgtccttcctgagcccccatgacctgtgccagctgggcagcaccaaccactactggaatgagaccgtgcgggaccccatcctgtggagatacttcctgctgcgggacctgcccagctggagctctgtggactggaagagcctgcctgacctggagatcctgaagaagcccatcagcgaggtgacagatggagccttctttgactacatggctgtgtacaggatgtgctgcccctacacccggcgggccagcaagagcagccggcccatgtatggagctgtgaccagcttcctgcacagcctcatcatccagaatgagcccaggtttgccatgtttggacctggcctggaggagctgaacaccagcctggtgctgagcctgatgagcagcgaggagctgtgccccacagctggcctgccccagaggcagattgatggcatcggcagcggcgtgaacttccagctgaacaaccagcacaagttcaacatcctgatcctgtacagcaccaccaggaaggagcgggaccgggcccgggaggagcacaccagcgctgtgaacaagatgttcagccgccacaatgaaggagatgaccagcagggcagccgctacagcgtcatcccccagatccagaaggtgtgtgaggtggtggatggcttcatctacgtggccaatgctgaggcccacaagagcaagtacagctatgtgcacttctag

SEQ ID NO: 152238 - DNA, 2130 bp, Artificial Sequence
  Description of Artificial Sequence: Synthetic coding sequence
atgggcaaggcccggcgcagccccccaggccaccaccgccactgtgagggctgcttcaacagacactgccacatccctgtggagcccaacaccagctgcctggtgatcagctgccacctgctgtgtggggccaccttccacatgtgcaaggaggccgagcaccagctgctgtgccccctggagcaggtgccctgcctgaacagtgaatatggctgccccctgtccatgagccgccacaagctggccaagcacctgcaggtgtgcccagcctctgtggtgtgctgcagcatggagtggaaccgctggcccaacgtggacagcgagaccaccctgcacgagaacatcatgaaggagaccccatctgaagaatgtctggacacagccctggccctgcaggaccagaaggtgctcttccgcagcctgaagatggtggagctgtttcctgagacccgggaggccacagaggaggagcccaccatgaatggagagacctctgtggaggagatgggcggcgctgtgggcggcgtggacatcggcctggtgccccacggcctgagcgccaccaatggagagatggccgagctgagccaggaggagcgggaggtgctggccaagaccaaggagggcatggacctggtgaagtttggccagtgggagaacatcttcagcaaggagcacgccgccagcgccctgaccaacagcagcgccagctgtgagagcaagaacaagaatgacagcgagaaggagcagatcagcagcggccacaacatggtggagggggagggcgcccccaagaagaaggagccccaggagaaccagaagcagcaggatgtgaggacagccatggagaccaccggcctggccccctggcaggatggagtgctggagcggctgaagacagctgtggatgccaaggactacaacatgtacctggtgcacaacggccgcatgctgatccacttcggccagatgcctgcctgcacccccaaggagcgggactttgtgtatggcaagctggaggcccaggaggtgaagacagtgtacaccttcaaggtgcctgtgtcctactgcggcaagagggcccggctgggagatgccatgctgagctgcaagcccagcgagcacaaggctgtggacaccagtgacctgggcatcaccgtggaggacctgcccaagagtgacctgatcaagaccaccctgcagtgtgccctggagcgggagctgaagggccacgtgatcagcgagagccgcagcattgatggcctcttcatggactttgccacccagacctacaactttgagcctgagcagttcagcagcggcaccgtgctggccgacctgacagctgccacccctgggggcctgcacgtggagctgcacagtgaatgtgtgacccggcggcacaacaagagcagcagcgccttcaccttcacctgcaacaagttcttcagaagagatgagttccccctgcacttcaagaatgtgcacacagacatccagagctgcctgaatggctggttccagcaccgctgccccctggcctacctgggctgcacctttgtgcagaaccacttccggcccccaggccagaaggccaaggtgatctacagccaggagctgaagacctttgccatcaagccagaggtggcccctgagctgtctgagggcaggaagaacaaccacctgctgggccatggaggcaagagccagaacagcctgaccagcctgcccctggagatcctgaagtacatcgccggcttcctggacagcgtgtccctggcccagctgagccaggtgtctgtgctgatgaggaacatctgtgccaccctgctgcaggagcggggcatggtgctgctgcagtggaagaagaagcgctacagccacggcggcacctcctggagggtgcaccgggagatctggcagttcagcagcctcttcagcaagatcaagtcctgggagttcaatgaggtgacctccatgtctgagcacctgaagagctgccccttcaacatcgtggagcacaagacagaccccatcctgctgacctccatgtgccagccccgggagcaggcccgggagagcctggtgtccaccttccgcatccggccccggggccgctacgtgtcctag

SEQ ID NO: 152239 - DNA, 2811 bp, Artificial Sequence
  Description of Artificial Sequence: Synthetic coding sequence
atgaccaccggcctgagtgaccagcaggtggtgtgtgacctggaccacagagctgtggaggccctgctgcaggccgtgaggaagaggatggccggggccagccctgctgtgccccatgagcgggcccggctgactggaggagctgctgctgtggagcccgcctgccggggcggcggcggggccatggccagcctggacctgccctaccgctgcccccgctgtggggagcacaagcgcttccgcagcctgagcagcctgcgggcccacctggagtacagccacacctatgagaccctgtacatcctgagcaagaccaacagcatctgtgatggagctgctgctgctgctgctgctgctgctgctgccagcggcttccccctggcccctgagcctgctgccctgctggccgtgcctggggcccggcgggaggtgtttgagagcaccagcttccagggcaaggagcaggccgccggccccagccctgctgccccccacctgctgcaccaccaccaccaccacgcccccctggcccacttccctggggacctggtgcctgccagcctgccctgtgaggagctggccgagcccggcctggtgcctgctgctgctgcccgctatgccctgcgggagattgagatccccctgggggagctgtttgccaggaagtctgtggccagcagcgcctgcagcaccccacctcctggccctggccctggcccctgccccggccctgccagcgccagccctgccagccccagccctgcagatgtggcctatgaggagggcctggcccggctgaagatccgggccctggagaagctggaggtggaccggcggctggagcggctgtctgaggaggtggagcagaagattgctggccaggtgggccgcctgcaggccgagctggagaggaaggctgctgagctggagacagcccggcaggagagcgcccggctgggccgggagaaggaggagctggaggagcgggccagcgagctgagccggcaggtggatgtgtctgtggagctgctggccagcctgaagcaggacctggtgcacaaggagcaggagctgagcaggaagcagcaggaggtggtgcagattgaccagttcctgaaggagacagctgcccgggaggccagcgccaagctgcggctgcagcagttcatcgaggagctgctggagagagctgacagagctgagcggcagctgcaggtgatcagcagcagctgtggcagcacccccagcgccagcctgggccggggcggcggcggcggcggggccggccccaatgcccggggccctggccgcatgagggagcaccacgtgggccctgctgtgcccaacacctatgctgtgagccgccacggcagcagccccagcactggagccagcagccgggtgcctgctgccagccagagcagcggctgctatgacagcgacagcctggagctgcccaggcctgaggagggcgcccctgaggacagcggccctgggggcctgggcacccgggcccaggccgccaatggaggcagcgagaggagccagcccccaagaagcagcggcctgcggcggcaggccatccagaactggcagaggcggccccggcggcacagcacagaaggagaggagggagatgtgtctgatgtgggcagcaggaccacagaaagtgaagctgagggccccctggatgccccccggcccggccctgccatggccggccccctgagcagctgccgcctgagcgcccggcctgagggcggcagcggccggggcagaagagctgagcgggtgagccccagccgcagcaatgaggtgatcagccctgagatcctgaagatgagagctgccctcttctgcatcttcacctacctggacaccaggaccctgctgcatgctgctgaggtgtgccgggactggaggtttgtggcccggcaccctgctgtgtggaccagggtgctgctggagaatgcccgggtgtgcagcaagttcctggccatgctggcccagtggtgcacccaggcccacagcctgaccctgcagaacctgaagccccggcagaggggcaagaaggagagcaaggaggagtatgcccggagcacccggggctgcctggaggccggcctggagagcctgctgaaggccgccggcggcaacctgctgatcctgcgcatcagccactgccccaacatcctgacagacaggagcctgtggctggccagctgctactgccgggccctgcaggccgtgacctaccgcagcgccacagatcctgtgggccatgaagtcatctgggccctgggcgccggctgccgggagatcgtgtccctgcaggtggcccccctgcacccctgccagcagcccacccgcttcagcaaccgctgcctgcagatgattggccgctgctggccccacctgcgggccctgggcgtgggcggggccggctgcggcgtgcagggcctggccagcctggccaggaactgcatgaggctgcaggtgctggagctggaccacgtgtctgagatcacccaggaggtggccgctgaggtgtgccgggagggcctgaagggcctggagatgctggtgctgacagccacccctgtgacccccaaggccctgctgcacttcaacagcatctgcaggaacctgaagagcatcgtggtgcagatcggcattgctgactacttcaaggagcccagcagccctgaggcccagaagctgtttgaggacatggtgaccaagctgcaggccctgcggcggcggcccggcttcagcaagatcctgcacatcaaggtggagggcggctgctag

SEQ ID NO: 152240 - DNA, 2628 bp, Artificial Sequence
  Description of Artificial Sequence: Synthetic coding sequence
atggccagcctggacctgccctaccgctgcccccgctgtggggagcacaagcgcttccgcagcctgagcagcctgcgggcccacctggagtacagccacacctatgagaccctgtacatcctgagcaagaccaacagcatctgtgatggagctgctgctgctgctgctgctgctgctgctgccagcggcttccccctggcccctgagcctgctgccctgctggccgtgcctggggcccggcgggaggtgtttgagagcaccagcttccagggcaaggagcaggccgccggccccagccctgctgccccccacctgctgcaccaccaccaccaccacgcccccctggcccacttccctggggacctggtgcctgccagcctgccctgtgaggagctggccgagcccggcctggtgcctgctgctgctgcccgctatgccctgcgggagattgagatccccctgggggagctgtttgccaggaagtctgtggccagcagcgcctgcagcaccccacctcctggccctggccctggcccctgccccggccctgccagcgccagccctgccagccccagccctgcagatgtggcctatgaggagggcctggcccggctgaagatccgggccctggagaagctggaggtggaccggcggctggagcggctgtctgaggaggtggagcagaagattgctggccaggtgggccgcctgcaggccgagctggagaggaaggctgctgagctggagacagcccggcaggagagcgcccggctgggccgggagaaggaggagctggaggagcgggccagcgagctgagccggcaggtggatgtgtctgtggagctgctggccagcctgaagcaggacctggtgcacaaggagcaggagctgagcaggaagcagcaggaggtggtgcagattgaccagttcctgaaggagacagctgcccgggaggccagcgccaagctgcggctgcagcagttcatcgaggagctgctggagagagctgacagagctgagcggcagctgcaggtgatcagcagcagctgtggcagcaccccatctgccagcctgggccggggcggcggcggcggcggggccggccccaatgcccggggccctggccgcatgagggagcaccacgtgggccctgctgtgcccaacacctatgctgtgtccagacatggcagcagccccagcactggagccagcagccgggtgcctgctgccagccagagcagcggctgctatgacagcgacagcctggagctgcccaggcctgaggagggcgccccagaagattctggccctgggggcctgggcacccgggcccaggccgccaacggcggcagcgagaggagccagccccccaggagcagcggcctgcggcggcaggccatccagaactggcagaggcggcccaggaggcacagcacagaaggagaggagggagatgtgtctgatgtgggcagcaggaccacagagagcgaggccgagggccccctggatgcccccaggcctggccctgccatggccggccccctgagcagctgccgcctgagcgcccggcctgagggcggcagcggccggggccggcgggcagagcgggtgagccccagccgcagcaatgaagtcatcagccctgagatcctgaagatgagagctgccctcttctgcatcttcacctacctggacaccaggaccctgctgcacgccgctgaggtgtgccgggactggaggtttgtggcccggcaccctgctgtgtggaccagggtgctgctggagaatgcccgggtgtgcagcaagttcctggccatgctggcccagtggtgcacccaggcccacagcctgaccctgcagaacctgaagccccggcagaggggcaagaaggagagcaaggaggagtatgcccggagcacccggggctgcctggaggccggcctggagagcctgctgaaggctgctgggggcaacctgctgatcctgcgcatcagccactgccccaacatcctgacagacaggagcctgtggctggccagctgctactgccgggccctgcaggccgtgacctacagaagtgccacagatcctgtgggccacgaggtgatctgggccctgggcgccggctgccgggagatcgtgtccctgcaggtggcccccctgcacccctgccagcagcccacccgcttcagcaaccgctgcctgcagatgattggccgctgctggccccacctgcgggccctgggcgtgggcggggccggctgcggcgtgcagggcctggccagcctggccaggaactgcatgaggctgcaggtgctggagctggaccacgtgtctgagatcacccaggaggtggccgctgaggtgtgccgggagggcctgaagggcctggagatgctggtgctgacagccacccctgtgacccccaaggccctgctgcacttcaacagcatctgcaggaacctgaagagcatcgtggtgcagattggaattgctgactacttcaaggagcccagcagccctgaggcccagaagctgtttgaggacatggtgaccaagctgcaggccctgcggcggcggcccggcttcagcaagatcctgcacatcaaggtggagggcggctgctag

SEQ ID NO: 152241 - DNA, 2154 bp, Artificial Sequence
  Description of Artificial Sequence: Synthetic coding sequence
atggccagcagcagtgacagtgaagatgacagcttcatggctgtggaccaggaggagaccgtgctggagggcaccatggaccaggatgaggagccccaccctgtgctggaggccgaggagaccaggcacaacagatccatgtctgagctgcctgaggaggtgctggagtacatcctgtccttcctgagcccctaccaggagcacaagacagctgccctggtgtgcaagcagtggtaccgcctcatcaagggcgtggcccaccagtgctaccacggcttcatgaaggctgtgcaggagggcaacatccagtgggagagcaggacctacccctacccaggcacccccatcacccagcgcttcagccacagcgcctgctactatgatgccaaccagagcatgtatgtgtttggaggctgcacccagagcagctgcaatgctgccttcaatgacctgtggaggctggacctgaacagcaaggagtggatccggcccctggccagcggcagctaccccagccccaaggccggggccaccctggtggtgtacaaggacctgctggtgctgtttggaggctggacccggcccagcccctaccccctgcaccagcctgagcgcttctttgatgagatccacacctacagccccagcaagaactggtggaactgcatcgtgaccacccacggccccccacccatggccggccacagcagctgtgtgattgatgacaagatgattgtgtttggaggcagcctgggcagccggcagatgagcaatgatgtgtgggtgctggacctggagcagtgggcctggagcaagcccaacatcagcggccccagcccccacccccggggcggccagagccagatcgtgattgatgatgccaccatcctgatcctgggcggctgcggcggccccaatgccctcttcaaggatgcctggctgctgcacatgcacagcggcccctgggcctggcagcccctgaaggtggagaatgaggagcacggggcccctgagctgtggtgccacccagcctgccgggtgggccagtgtgtggtggtgttcagccaggcccccagcggccgggcccccctgagccccagcctgaacagccggcccagccccatcagcgccaccccaccagccctggtgcctgagacccgggagtaccgcagccagagccctgtgcgctccatggatgaggccccctgtgtgaatggccgctggggcaccctgcggccccgggcccagaggcagaccccatctggcagccgggagggcagcctgagccctgcccggggagatggcagccccatcctgaatggaggcagcctgagccctggaacagctgctgtgggcggcagcagcctggacagccctgtgcaggccatcagccccagcaccccatctgcccctgagggctatgacctgaagattggcctgagcctggccccccggcggggcagcctgcctgaccagaaggacctgcggctgggcagcattgacctgaactgggacctgaagccagccagcagcagcaaccccatggatggcatggacaacagaacagtgggcggctccatgaggcaccccccagagcagaccaatggagtgcacaccccaccccacgtggccagcgccctggccggggctgtgtcccctggggccctgcggcgcagcctggaggccatcaaggccatgagcagcaagggccccagcgccagcgctgccctgagcccccccctgggcagcagccctggcagccctggcagccagagcctgagcagtggagagaccgtgcccatcccccggcccggccctgcccagggagatggccacagcctgccccccatcgcccggcggctgggccaccaccccccccagagcctgaatgtgggcaagcccctgtaccagagcatgaactgcaagcccatgcagatgtatgtgctggacatcaaggacaccaaggagaagggccgggtgaagtggaaggtgttcaacagcagctctgtggtgggccccccagagaccagcctgcacacagtggtgcagggccgcggggagctgatcatctttggaggcctgatggacaagaagcagaatgtgaagtactaccccaagaccaatgccctgtactttgtgcgggccaagaggtag

SEQ ID NO: 152242 - DNA, 900 bp, Artificial Sequence
  Description of Artificial Sequence: Synthetic coding sequence
atgagcagccccccccagatcgtgattgatgatgccaccatcctgatcctgggcggctgcggcggccccaatgccctcttcaaggatgcctggctgctgcacatgcacagcggcccctgggcctggcagcccctgaaggtggagaatgaggagcacggggcccctgagctgtggtgccacccagcctgccgggtgggccagtgtgtggtggtgttcagccaggcccccagcggccgggcccccctgagccccagcctgaacagccggcccagccccatcagcgccaccccaccagccctggtgcctgagacccgggagtaccgcagccagagccctgtgcgctccatggatgaggccccctgtgtgaatggccgctggggcaccctgcggccccgggcccagaggcagaccccatctggcagccgggagggcagcctgagccctgcccggggagatggcagccccatcctgaatggaggcagcctgagccctggaacagctgctgtgggcggcagcagcctggacagccctgtgcaggccatcagccccagcaccccatctgcccctgagggctatgacctgaagattggcctgagcctggccccccggcggggcagcctgcctgaccagaaggacctgcggctgggcagcattgacctgaactgggacctgaagccagccagcagcagcaaccccatggatggcatggacaacagaacagtgggcggctccatgaggcaccccccagagcagaccaatggagtgcacaccccaccccacgtggccagcgccctggccggggctgtgtcccctggggccctgcggcgcagcctggaggccatcaaggccatgagcagcaagggccccagcgccagcgctgccctgagcccccccctgtag

SEQ ID NO: 152243 - DNA, 900 bp, Artificial Sequence; identical to SEQ ID NO: 152242
  Description of Artificial Sequence: Synthetic coding sequence

SEQ ID NO: 152244 - DNA, 2127 bp, Artificial Sequence
  Description of Artificial Sequence: Synthetic coding sequence
atgtccttcaaggacaaggatgagcgcatcagctgcctggaggcctacgtgaccctgaccagcaagagcagccgcttcacagatgaaacagagatcctgaagatgagccagaggcacagcggccaggccggcacagaagctggaaatggagctgacagcccccccatcgtgaacagcaagtacagcaccttccgggacttctgcagcaccagcagcttccaggacagcggctacaatgagctgaagagctgcagctttgacaacatcgacaaggagtacctgggcaagaaggagaagggccccaccctgctgtatgagcaccctgagaccagcggcctgggcctgacccaccccctggagagccccacccagaagaagaagtgcatcctgcccaggaaggagaaggacaagaccccagagctgtgtgagacccccaagatcagcggcaagaagtgcctgccccggcggcggctgaatgtgtcctttgccctgctgaagggggactttgagagccagaacagcagcctggagagcagcatcagccaggtgatcaacctggagaagaacatccccagcagcgccagcggcttcagccgggccaacaacttcagccccctggtgaccagcaccctgaagacagaggaggtgaccagctgcagccagaagctgcggctgaacttcagccagcagaagaccagcaccattgatgacagcaaggatgactgcagcctgtttgaggtggagtgcatcagccccatccagggcaacaacttcaaggacagcatcacccatgacttcagtgacagcagcctgtgcatcaatgatgaaaatgcctgcccagagctgctgggcagctctgtgtctggcaccacctgtggcacagatgaggacatctttgtgacccccatcagcaacctggtggccaacatccgcttcaatgccagccagatcctgagccccagccctgaggtgcggggcagcatcagcaccccagaggacagcggcttcaacagcctgagcctggagaagtctgaggacagcctgagtgaccaggagggcagcttccaggagctgctgcagaagcacaagggcacccccaaggtgggggacaccatcaggaagaccaggcacctgggccgcagccggcggctgagcaccctgcgggagcagagcagccagagcgagacagaggaggagaagcagatcgtgcacccagattctgagaagagagctgctgctgccagcgccatcagcgagggccagctgagcagtgatgaaagtggggacctgaccttcagcctgaagaacctgagcaagaccccagccctgcagctggtgcatgagctgttcatgaagagcaagaggaagaggctgcaggagaacagcggccacgagttcctggagcagggagatggagagaagattgctgtgctgcagtgcatcctggccggcctcatcggcaagaagatgggcatcgagaagctggacatcctgacagagctgaagtacagaaacctgaagcacatcctggccatggtgctggagagcctgacagctgagagcctgtgcagcgtgtggaaggtgtccaggaactggagagaaattgtggtgcaggacaagaatgccaacagaagaaggaagttctacatcacccagctgaagacagattctgagggcgctgtgctgaatgtggaggatgctgccacccggctgcagctgctgaacagaagtgccctgcggtctgtgcaggcccaggcccgcatccctggcagccagcgggagcagggcagcaccctgagcccctggggcgaggtgctgacccccctggccagcagctctgtgacccacctgagcagcaagcaggaggagtatgtgaaggtggccaagaccctcttcacagatgaggccctgaagccctgcccccgctgccagagccctgccaagtaccagccctacaagaagaggggcctgtgcagcaggacagcctgtggctttgacttctgtgtgctgtgcctgtgtgcctaccacggcagcgaggagtgcagcagaggagctgccaagcccaggaacaggaaggatgccctgcccggcagcgcccagagcaagaggaacctgaagaggctgtag

SEQ ID NO: 152245 - DNA, 675 bp, Artificial Sequence
  Description of Artificial Sequence: Synthetic coding sequence
atggctgtgggcaacatcaatgagctgcctgagaacatcctgctggagctgttcacccacgtgcctgcccggcagctgctgctgaactgccgcctggtgtgcagcctgtggagggacctgattgacctggtgaccctgtggaagaggaagtgcctgcgggagggcttcatcacagaggactgggaccagcctgtggccgactggaagatcttctacttcctgcggagcctgcacaggaacctgctgcacaacccctgtgccgaggagggctttgagttctggagcctggatgtgaatggaggagatgagtggaaggtggaggacctgagccgggaccagaggaaggagttccccaatgaccaggtgcgcagccaggcccggctgcgggtgcaggtgcctgctgtgcgcagcgcccctgtggtgcgggcccgggccagcggggacctgcctgcccggcctggggaccaccctgctgaggagcgctgccaggtggagggcggcctgccccacatcctgcagctgcctgcccggcggcccctgcacctggtgtctgccaggagaagaggccacagcctgctgggccgcctggtgcggcctgagggccaccagcagcagcaccaccaccgggccccagctgccctgaccccacctgagcccccatctgctgagccctag

SEQ ID NO: 152246 - DNA, 768 bp, Artificial Sequence
  Description of Artificial Sequence: Synthetic coding sequence
atggctgtgggcaacatcaatgagctgcctgagaacatcctgctggagctgttcacccacgtgcctgcccggcagctgctgctgaactgccgcctggtgtgcagcctgtggagggacctgattgacctggtgaccctgtggaagaggaagtgcctgcgggagggcttcatcacagaggactgggaccagcctgtggccgactggaagatcttctacttcctgcggagcctgcacaggaacctgctgcacaacccctgtgccgaggagggctttgagttctggagcctggatgtgaatggaggagatgagtggaaggtggaggacctgagccgggaccagaggaaggagttccccaatgaccaggtgaagaagtactttgtgaccagctactacacctgcctgaagagccaggtggtggacctgaaggccgagggctactgggaggagctgatggacaccaccaggccagacatcgaggtgaaggactggtttgctgcccggccagactgtggcagcaagtaccagctgtgtgtgcagctgctgagcagcgcccacgcccccctgggcaccttccagcctgaccctgccaccatccagcagaagagtgatgccaagtggagggaggtgagccacaccttcagcaactacccacctggggtgcgctacatctggttccagcacggcggcgtggacacccactactgggccggctggtacggcccccgggtgaccaacagcagcatcaccatcggcccccccctgccctag

SEQ ID NO: 152247 - DNA, 675 bp, Artificial Sequence; identical to SEQ ID NO: 152245
  Description of Artificial Sequence: Synthetic coding sequence

SEQ ID NO: 152248 - DNA, 675 bp, Artificial Sequence; identical to SEQ ID NO: 152245
  Description of Artificial Sequence: Synthetic coding sequence

SEQ ID NO: 152249 - DNA, 771 bp, Artificial Sequence
  Description of Artificial Sequence: Synthetic coding sequence
atggctgtgggcaacatcaatgagctgcctgagaacatcctgctggagctgttcacccacgtgcctgcccggcagctgctgctgaactgccgcctggtgtgcagcctgtggagggacctgattgacctggtgaccctgtggaagaggaagtgcctgcgggagggcttcatcacagaggactgggaccagcctgtggccgactggaagatcttctacttcctgcggagcctgcacaggaacctgctgcacaacccctgtgccgaggagggctttgagttctggagcctggatgtgaatggaggagatgagtggaaggtggaggacctgagccgggaccagaggaaggagttccccaatgaccagcacctgccccaggtgcctgggggcggcccccagggccggcgggtgctgggcggcgcagatggctaccacacagctggccaccggggccagggcctggtgcgcagccaggcccggctgcgggtgcaggtgcctgctgtgcgcagcgcccctgtggtgcgggcccgggccagcggggacctgcctgcccggcctggggaccaccctgctgaggagcgctgccaggtggagggcggcctgccccacatcctgcagctgcctgcccggcggcccctgcacctggtgtctgccaggagaagaggccacagcctgctgggccgcctggtgcggcctgagggccaccagcagcagcaccaccaccgggccccagctgccctgaccccacctgagcccccatctgctgagccctag

SEQ ID NO: 152250 - DNA, 768 bp, Artificial Sequence; identical to SEQ ID NO: 152246
  Description of Artificial Sequence: Synthetic coding sequence

SEQ ID NO: 152251 - DNA, 498 bp, Artificial Sequence
  Description of Artificial Sequence: Synthetic coding sequence
atggctgtgggcaacatcaatgagctgcctgagaacatcctgctggagctgttcacccacgtgcctgcccggcagctgctgctgaactgccgcctggtgtgcagcctgtggagggacctgattgacctggtgaccctgtggaagaggaagtgcctgcgggagggcttcatcacagaggactgggaccagcctgtggccgactggaagatcttctacttcctgcggagcctgcacaggaacctgctgcacaacccctgtgccgaggagggctttgagttctggagcctggatgtgaatggaggagatgagtggaaggtggaggacctgagccgggaccagaggaaggagttccccaatgaccaggtgcgcagccaggcccggctgcgggtgcaggtgcctgctgtgcgcagcgcccctgtggtgcgggcccgggccagcggggacctgcctgcccggcctggggaccaccctgctgaggagcgctgccaggtggagtag

SEQ ID NO: 152252 - DNA, 861 bp, Artificial Sequence
  Description of Artificial Sequence: Synthetic coding sequence
atggccgccccagcccctggggccggggccgccagcggcggggccggctgcagcggcggcggggccggggccggggccggcagcggcagcggggctgctggagctgggggccgcctgcccagccgggtgctggagctggtgttctcctacctggagctgtctgagctgcggagctgtgccctggtgtgcaagcactggtaccgctgcctgcatggagatgagaacagcgaggtgtggaggagcctgtgtgcccggagcctggccgaggaggccctgaggacagacatcctgtgcaacctgcccagctacaaggccaagatccgggccttccagcacgccttcagcaccaatgactgcagcagaaatgtgtacatcaagaagaatggcttcaccctgcacaggaaccccatcgcccagagcacagatggagcccggaccaagattggcttcagcgagggcagacatgcctgggaggtgtggtgggagggccccctgggcaccgtggccgtgattggaattgccaccaagagggcccccatgcagtgccagggctacgtggccctgctgggcagtgatgaccagagctggggctggaacctggtggacaacaacctgctgcacaacggggaggtgaatggcagcttcccccagtgcaacaatgcccccaagtaccagatcggggagcgcatccgggtcatcctggacatggaggacaagaccctggcctttgagcggggctatgagttcctgggcgtggccttccggggcctgcccaaggtgtgcctgtacccagctgtgtctgctgtgtatggcaacacagaggtgaccctggtgtacctgggcaagcccctggatggatag

SEQ ID NO: 152253 - DNA, 1812 bp, Artificial Sequence
  Description of Artificial Sequence: Synthetic coding sequence
atggaccggggcagcctgctgcccttccagctgtggtgcccccggcccttcggcacctacagccagaaccagcccaggcctccttctgctgccctgaagcccagcgcctgcccagagcccggcggcggcgctgagccagaccacggccctgcccacagcgagaacaccccaccagccctggccacagaggtgcctgccagccagcctgcccccctgctgtctgctgctgctgctggagatgagggccgggtgctgctggacacctggtacgtgatcaagccaggcaacaccaaggagaaggtggccttctttgtggcccaccagtgtggcggcggcagccgggccagctccatgaaggtgaagggccactggggcagtgacagcagcaaggccaagagaagaagacgctgcctggaccccaccaaggcccccccagaccccggcggccgggagggccccccagctgctgaggagggccctgccagcgctggagaagatgtggacctgctgtctgtggccgagatggtggccctggtggagcagagagctgccctggccctgcagagctacccccggcccaccaccccagcccctgtggtgtttgtgtctgctgagcagggcggccctgccaagggcgtgggcagcgagaggagaagtggcggcggggactgcagccgggtggccgaggccgtggcccactttgaggcccagagggacagcccccccaccaagggcctgaggaaggaggagcggcccggccctggccctggagaggtgagaattgccttccgcatcagcaatggccgggagccccgggccccagacagcggcctgcccagcggcggcggcggccggcccggctgtgcctacccaggcagccctggccctggggcccgggccaaggacaagatcacctgtgacctgtaccagctgatcagccccagcagagatgccctgcccagcaatgtggagttcctgctggcccgggcagatgaggccagcgagggggacagccctgccccagcccggcctgaggacaccccaccagcccctcctcctcctccagcccgggactgtggggccagcggcttccacgtggatgtggtggtgactggagtggtggatgagtgcatcttcttcggcaaggatggcaccaagaatgtgaaggaggagaccgtgtgcctgactgtgtccccagaggagcccccacctcctggccagctgttcttcctgcagaacagaggaccagatggccccccagagcccccacctgctgacagccctgccacagcccctggcccagatgatgctgagggcacagctgacaccagcctgtgccgcctgtacagacatgtgtcccatgacttcctggagatccgcttcaagatccagaggctgctggagccccggcagtacatgctgctgctgcctgagcacgtgctggtgaagatcttctccttcctgcccacccgggccctggccgccctgaagtgcacctgccaccacttcaagggcatcatcgaggccttcggcgtgcgggccacagacagccgctggagccgggaccccctgtacagagatgacccctgcaagcagtgcaggaagagatatgaaaaaggagatgtgtccctgtgccgctggcaccccaagccctaccaccacgacctgccctacggccgcagctactggatgtgctgcagaagagctgaccgggagaccccaggctgccgcctgggcctgcatgacaacaactgggtgctgccctgcaatggacctgggggcggccgggccggccgggaggagggccgctag

SEQ ID NO: 152254 - DNA, 609 bp, Artificial Sequence
  Description of Artificial Sequence: Synthetic coding sequence
atgacctgcctgacagatgtgcccaccggctgtgccgctgtggagcccacagcccggctgcctgctgctgcctgggccagcaccatcaccaccggctgctgcccagccatgggccaggccggggccggccctgctggaagaagaggaggagaggccggcggcggggagggccgggcccaccacgcccaccccagccccctgccccgggagccccgggtgaggactggacctccagcccacagccccaccccaggcagcattgaccccagccctgagctgtcctggggcagcgctggggtgacccaggagagccccctgctggaccctgtggacttcctgctcttccgcaccagggctgtggaccccctgcggcgggtcttcttcttcttctaccagcacctgaccttcttcagcatccagccccagcccccaccctgccacgccttccaccccaaggaccccccagctggcagccggcggcagctgatcctggtgcccctgaagggcccccccatcctggcccccatcctgagcctgacccccatcctgagccgctggagctgctacttccccaggagcagaattgcccagggctggcacctgtcctag

SEQ ID NO: 152255 - DNA, 1359 bp, Artificial Sequence
  Description of Artificial Sequence: Synthetic coding sequence
atggccagccgcatcaacaccaacttcaccctcatccccaaccagaagctgcggcgcagcaaccggcagaccagctgctacagcaagaccctgggcagcggcttccagcccatcagcacctttggaaacttcaaggccctgcccctggagatcttccagatcatcctgaagtacctgtctgtgaaggacatctccatgctgtccatggtgtccaagacagtgtcccagcacatcatcaactacatcagcaccagcagcggcagcaagaggctgctgctgcaggacttccacaacctggagctgcctgaccggcggcaggacagcgccatcctggagcactaccgcagcctgggcctgctcttcaagcgctgcaccctgctgctgcccaccaaggagcggctgaagtacatccacaagatcctgacagaggtgtcctgcttcaagttcaacggctgtgccgcccccatgcagtgcctgggcctgacctgctacggcatgttcctgcagaccctgacagctggctgggatgagctggagtgccaccgggtgtacaacttcctgtgtgagctgaccaacctgtgcaggaagatccagatggctgtgtgcagcaagccaggcagcgcccagaagctggagctgcgcatccgcctcttctgcagaaatgtgctgctggaccactggacccacagaagtgacagcgccttctggctgacccgcatcctgaagccctggcccatggtgaaccaggcccggctgctgtacatcatcttcggccccatcagcccccaggacggccaggtggtgtggcaggagatgattgaggagcccacagatgagttcagcctgaagggcctggctgatgccatcaagctgctgtatgatgccagcaccaaggagtggacagcagatgatgtgatcagcctggtggatgagctgtctgtggtgccccgggagtggctgctggagaacaatgcccggctgctgatgctgagcggcaacaacatctgcttctccttcatggccagcaaggctgtgaatggccgcaccatcgagctggcccggctggtggtgttcctggccctggtgtgtgagaaggagctgtactgcatggactggacagtgaagatgatgcagaaggtgtgcaaggtgttcagcacccctgtggagaggaagaacttcctgcagaatgtggccaatgcctttgcctgtgtgatcatggagatgctgcagagcatcatgtctggggacagagatgaagatgaccgctccttcctgaacctcttccacctggtgcacgcccaggccaacttccacaaggaggtgctgtacctgaccatgaacacccccctgagcacctag

SEQ ID NO: 152256 - DNA, 2133 bp, Artificial Sequence
  Description of Artificial Sequence: Synthetic coding sequence
atgggcggcaagcagagagatgaagatgatgaggcctacggcaagcctgtgaagtatgaccccagcttccggggccccatcaagaacagaagctgcacagatgtgatctgctgcgtgctcttcctgctcttcatcctgggctacatcgtggtgggcatcgtggcctggctgtatggagacccccggcaggtgctgtaccccaggaacagcactggagcctactgcggcatgggagagaacaaggacaagccctacctgctgtacttcaacatcttcagctgcatcctgagcagcaacatcatctctgtggctgaaaatggcctgcagtgccccaccccccaggtgtgtgtgagcagctgcccagaggacccctggacagtgggcaagaatgagttcagccagacagtgggggaggtgttctacaccaagaacagaaacttctgcctgcccggggtgccctggaacatgaccgtcatcaccagcctgcagcaggagctgtgccccagcttcctgctgcccagcgccccagccctgggccgctgcttcccctggaccaacgtgaccccaccagccctgcccggcatcaccaatgacaccaccatccagcagggcatcagcggcctgattgacagcctgaatgcccgggacatctctgtgaagatctttgaagattttgcccagagctggtactggatcctggtggccctgggcgtggccctggtgctgagcctgctcttcatcctgctgctgcggctggtggccggccccctggtgctggtgctgatcctgggcgtgctgggcgtgctggcctacggcatctactactgctgggaggagtacagagtgctgcgggacaagggggccagcatcagccagctgggcttcaccaccaacctgagcgcctaccagagcgtgcaggagacctggctggccgccctgattgtgctggccgtgctggaggccatcctgctgctgatgctgatcttcctgcggcagaggatccgcatcgccatcgccctgctgaaggaggccagcaaggctgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgcggggcgtgcagaaccctgtggcccgctgcatcatgtgctgcttcaagtgctgcctgtggtgcctggagaagttcatcaagttcctgaacagaaatgcctacatcatgattgccatctacggcaagaacttctgtgtgtctgccaagaatgccttcatgctgctgatgagaaatattgtgcgggtggtggtgctggacaaggtgacagacctgctgctcttcttcggcaagctgctggtggtgggcggcgtgggcgtgctgtccttcttcttcttcagcggccgcatccctggcctgggcaaggacttcaagagcccccacctgaactactactggctgcccatcatgaccagcatcctgggcgcctacgtgattgccagcggcttcttctctgtgtttggcatgtgtgtggacaccctcttcctgtgcttcctggaggacctggagaggaacaacggcagcctggaccggccctactacatgagcaagagcctgctgaagatcctgggcaagaagaatgaggcccccccagacaacaagaagaggaagaagtag

SEQ ID NO: 152257 - DNA, 1206 bp, Artificial Sequence
  Description of Artificial Sequence: Synthetic coding sequence
atgaagtgtgacttcaactgcaaccacgtgcacagcggcctgaagctggtgaagccagatgacatcggccgcctggtgtcctacaccccagcctacctggagggcagctgcaaggactgcatcaaggactatgaaaggctgagctgcatcggcagccccatcgtgagccccagaattgtgcagctggagacagagagcaagaggctgcacaacaaggagaaccagcacgtgcagcagaccctgaacagcaccaatgaaattgaggccctggagaccagccggctgtatgaagattctggctacagcagcttcagcctgcagagcggcctgtctgaacatgaggagggcagcctgctggaggagaactttggagacagcctgcagagctgcctgctgcagatccagagcccagaccagtaccccaacaagaacctgctgcctgtgctgcactttgagaaggtggtgtgcagcaccctgaagaagaatgccaagaggaaccccaaggtggaccgggagatgctgaaggagatcatcgcccggggcaacttccggctgcagaacatcattggaaggaagatgggcctggagtgtgtggacatcctgtctgagctgttccggcggggcctgcggcacgtgctggccaccatcctggcccagctgagtgacatggacctgatcaacgtgtccaaggtgtccaccacctggaagaagatcctggaggatgacaagggggccttccagctgtacagcaaggccatccagagggtgacagagaacaacaacaagttcagcccccacgccagcacccgggagtatgtgatgttccgcacccccctggcctctgtgcagaagtctgctgcccagaccagcctgaagaaggatgcccagaccaagctgagcaaccagggcgaccagaagggcagcacctacagccgccacaatgagttcagcgaggtggccaagaccctgaagaagaatgaaagcctgaaggcctgcatccgctgcaacagccctgccaagtatgactgctacctgcagagggccacctgcaagcgggagggctgcggctttgactactgcaccaagtgcctgtgcaactaccacaccaccaaggactgcagtgatggcaagctgctgaaggccagctgcaagattggccccctgcccggcaccaagaagagcaagaagaacctgcggcggctgtag

SEQ ID NO: 152258 - DNA, 882 bp, Artificial Sequence
  Description of Artificial Sequence: Synthetic coding sequence
atggatgccccccacagcaaggccgccctggacagcatcaatgagctgcctgagaacatcctgctggagctgttcacccacgtgcctgcccggcagctgctgctgaactgccgcctggtgtgcagcctgtggagggacctgattgacctgatgaccctgtggaagaggaagtgcctgcgggagggcttcatcaccaaggactgggaccagcctgtggccgactggaagatcttctacttcctgcggagcctgcacaggaacctgctgaggaacccctgtgccgaggaggacatgtttgcctggcagattgacttcaacggcggggaccgctggaaggtggagagcctgcccggggcccacggcacagacttcccagaccccaaggtgaagaagtactttgtgaccagctatgagatgtgcctgaagagccagctggtggacctggtggccgagggctactgggaggagctgctggacaccttccggccagacatcgtggtgaaggactggtttgctgcccgggctgactgtggctgcacctaccagctgaaggtgcagctggccagcgctgactactttgtgctggccagctttgagcccccacctgtgaccatccagcagtggaacaatgccacctggacagaggtgtcctacaccttcagtgactacccccggggcgtgcgctacatcctcttccagcacggcggccgggacacccagtactgggccggctggtacggcccccgggtgaccaacagcagcatcgtggtgagccccaagatgaccaggaaccaggccagcagcgaggcccagcccggccagaagcacggccaggaggaggccgcccagagcccctacagagctgtggtgcagatcttctag

SEQ ID NO: 152259 - DNA, 750 bp, Artificial Sequence
  Description of Artificial Sequence: Synthetic coding sequence
tgaaatgagctgcctgagaacatcctgctggagctgttcacccacgtgcctgcccggcagctgctgctgaactgccgcctggtgtgcagcctgtggagggacctgattgacctgatgaccctgtggaagaggaagtgcctgcgggagggcttcatcaccaaggactgggaccagcctgtggccgactggaagatcttctacttcctgcggagcctgcacaggaacctgctgaggaacccctgtgccgaggaggacatgtttgcctggcagattgacttcaacggcggggaccgctggaaggtggagagcctgcccggggcccacggcacagacttcccagaccccaaggtgaagaagtactttgtgaccagctatgaatttgctgcccgggctgactgtggctgcacctaccagctgaaggtgcagctggccagcgctgactactttgtgctggccagctttgagcccccacctgtgaccatccagcagtggaacaatgccacctggacagaggtgtcctacaccttcagtgactacccccggggcgtgcgctacatcctcttccagcacggcggccgggacacccagtactgggccggctggtacggcccccgggtgaccaacagcagcatcgtggtgagccccaagatgaccaggaaccaggccagcagcgaggcccagcccggccagaagcacggccaggaggaggccgcccagagcccctacagagctgtggtgcagatcttctag

SEQ ID NO: 152260 - DNA, 1569 bp, Artificial Sequence
  Description of Artificial Sequence: Synthetic coding sequence
atgaggctgcgggtgcggctgctgaagaggacctggcccctggaggtgcctgagacagagcccaccctgggccacctgcggagccacctgcggcagagcctgctgtgcacctggggctacagcagcaacacccgcttcaccatcaccctgaactacaaggaccccctgactggagatgaggagaccctggccagctatggcatcgtgtctggggacctgatctgcctgatcctgcaggatgacatcccagcccccaacatccccagcagcacagattctgagcacagcagcctgcagaacaatgagcagcccagcctggccaccagcagcaaccagacctccatgcaggatgagcagcccagcgacagcttccagggccaggccgcccagagcggcgtgtggaatgatgacagcatgctgggccccagccagaactttgaggccgagagcatccaggacaatgcccacatggccgagggcaccggcttctaccccagcgagcccatgctgtgcagcgagagcgtggagggccaggtgccccacagcctggagaccctgtaccagagcgctgactgcagtgatgccaatgatgccctgattgtgctgatccacctgctgatgctggagagcggctacatcccccagggcacagaggccaaggccctgtccatgcctgagaagtggaagctgtctggagtgtacaagctgcagtacatgcaccccctgtgtgagggcagcagcgccaccctgacctgtgtgcccctgggcaacctgattgtggtgaatgccaccctgaagatcaacaatgagatccgctctgtgaagaggctgcagctgctgcctgagagcttcatctgcaaggagaagctgggggagaatgtggccaacatctacaaggacctgcagaagctgagccgcctcttcaaggaccagctggtgtaccccctgctggccttcacccggcaggccctgaacctgcctgatgtgtttggcctggtggtgctgcccctggagctgaagctgcgcatcttccggctgctggatgtgcgctctgtgctgagcctgtctgctgtgtgccgggacctcttcaccgccagcaatgaccccctgctgtggaggttcctgtacctgcgggacttccgggacaacacagtgcgggtgcaggacacagactggaaggagctgtacaggaagaggcacatccagaggaaggagagccccaagggccgctttgtgatgctgctgcccagcagcacccacaccatccccttctaccccaaccccctgcacccccggcccttccccagcagccggctgcccccaggcatcatcggcggggagtatgaccagaggcccaccctgccctacgtgggggaccccatcagcagcctcatccctggccctggagagacccccagccagttcccccccctgcggcccaggtttgatcctgtgggccccctgcccggccccaaccccatcctgcccggccggggcggccccaatgaccgcttccccttccggcccagccggggccggcccacagatggccgcctgtccttcatgtag

SEQ ID NO: 152261 - DNA, 1332 bp, Artificial Sequence
  Description of Artificial Sequence: Synthetic coding sequence
atggcccggcccccaggcggcagcggccccctgctggacagcgagcacagcagcctgcagaacaatgagcagcccagcctggccaccagcagcaaccagacctccatgcaggatgagcagcccagcgacagcttccagggccaggccgcccagagcggcgtgtggaatgatgacagcatgctgggccccagccagaactttgaagctgagagcatccaggacaatgcccacatggccgagggcaccggcttctaccccagcgagcccatgctgtgcagcgagagcgtggagggccaggtgccccacagcctggagaccctgtaccagagcgctgactgcagtgatgccaatgatgccctgattgtgctgatccacctgctgatgctggagagcggctacatcccccagggcacagaggccaaggccctgtccatgcctgagaagtggaagctgagcggcgtgtacaagctgcagtacatgcaccccctgtgtgagggcagcagcgccaccctgacctgtgtgcccctgggcaacctgattgtggtgaatgccaccctgaagatcaacaatgagatccgctctgtgaagaggctgcagctgctgcctgagagcttcatctgcaaggagaagctgggagaaaatgtggccaacatctacaaggacctgcagaagctgagccgcctcttcaaggaccagctggtgtaccccctgctggccttcacccggcaggccctgaacctgcctgatgtgtttggcctggtggtgctgcccctggagctgaagctgcgcatcttccggctgctggatgtgcgctctgtgctgagcctgtctgctgtgtgccgggacctcttcaccgccagcaatgaccccctgctgtggaggttcctgtacctgcgggacttccgggacaacacagtgcgggtgcaggacacagactggaaggagctgtacaggaagaggcacatccagaggaaggagagccccaagggccgctttgtgatgctgctgcccagcagcacccacaccatccccttctaccccaaccccctgcacccccggcccttccccagcagccggctgcccccaggcatcattggaggagaatatgaccagaggcccaccctgccctacgtgggggaccccatcagcagcctcatccctggccctggagagacccccagccagtttcctcccctgcggcccaggtttgatcctgtgggccccctgcccggccccaaccccatcctgcccggccggggcggccccaatgaccgcttccccttccggcccagccggggccggcccacagatggccgcctgtccttcatgtag

SEQ ID NO: 152262 - DNA, 1227 bp, Artificial Sequence
  Description of Artificial Sequence: Synthetic coding sequence
atgcaggatgagcagcccagcgacagcttccagggccaggccgcccagagcggcgtgtggaatgatgacagcatgctgggccccagccagaactttgaggccgagagcatccaggacaatgcccacatggccgagggcaccggcttctaccccagcgagcccatgctgtgcagcgagagcgtggagggccaggtgccccacagcctggagaccctgtaccagagcgctgactgcagtgatgccaatgatgccctgattgtgctgatccacctgctgatgctggagagcggctacatcccccagggcacagaggccaaggccctgtccatgcctgagaagtggaagctgtctggagtgtacaagctgcagtacatgcaccccctgtgtgagggcagcagcgccaccctgacctgtgtgcccctgggcaacctgattgtggtgaatgccaccctgaagatcaacaatgagatccgctctgtgaagaggctgcagctgctgcctgagagcttcatctgcaaggagaagctgggggagaatgtggccaacatctacaaggacctgcagaagctgagccgcctcttcaaggaccagctggtgtaccccctgctggccttcacccggcaggccctgaacctgcctgatgtgtttggcctggtggtgctgcccctggagctgaagctgcgcatcttccggctgctggatgtgcgctctgtgctgagcctgtctgctgtgtgccgggacctcttcaccgccagcaatgaccccctgctgtggaggttcctgtacctgcgggacttccgggacaacacagtgcgggtgcaggacacagactggaaggagctgtacaggaagaggcacatccagaggaaggagagccccaagggccgctttgtgatgctgctgcccagcagcacccacaccatccccttctaccccaaccccctgcacccccggcccttccccagcagccggctgcccccaggcatcatcggcggggagtatgaccagaggcccaccctgccctacgtgggggaccccatcagcagcctcatccctggccctggagagacccccagccagttcccccccctgcggcccaggtttgatcctgtgggccccctgcccggccccaaccccatcctgcccggccggggcggccccaatgaccgcttccccttccggcccagccggggccggcccacagatggccgcctgtccttcatgtag

SEQ ID NO: 152263 - DNA, 699 bp, Artificial Sequence
  Description of Artificial Sequence: Synthetic coding sequence
atgcagctgacctttgcctggctgcacgtgtttggaagaaccctgaggatgatgaacttcagcggcaagggctgtgccaacccctggggccactgcagcatctacaacaagaacccccccctgggcttctccttcaggaagctgtacatgcagctggatgagggcagcctgaccttcaatgccaacccagatgagggcgtgaactacttcatgagcaagggcatcctggatgacagccccaaggagatcgccaagttcatcttctgcaccaggaccctgaactggaagaagctgcgcatctacctggatgaaagaagagatgtgctggatgacctggtgaccctgcacaacttcaggaaccagttcctgcccaatgccctgcgggagttcttccgccacatccacgcccctgaggagcggggggagtacctggagaccctcatcaccaagttcagccaccgcttctgtgcctgcaacccagacctgatgagggagctgggcctgagcccagatgctgtgtatgtgctgtgctacagcctcatcctgctgagcattgacctgaccagcccccacgtgaagaacaagatgagcaagcgggagttcatccggaacacccggcgggccgcccagaacatcagcgaggactttgtgggccacctgtatgacaacatctacctgattggacatgtggccgcctag

SEQ ID NO: 152264 - DNA, 960 bp, Artificial Sequence
  Description of Artificial Sequence: Synthetic coding sequence
atgggccagggcctgtggagggtggtgaggaaccagcagctgcagcaggagggctacagcgagcagggctacctgacccgggagcagagcaggaggatggccgccagcaacatcagcaacaccaaccacaggaagcaggtgcagggcggcatcgacatctaccacctgctgaaggccaggaagagcaaggagcaggagggcttcatcaacctggagatgctgcccccagagctgtccttcaccatcctgagctacctgaatgccacagacctgtgcctggccagctgtgtgtggcaggacctggccaatgatgagctgctgtggcagggcctgtgcaagagcacctggggccactgcagcatctacaacaagaacccccccctgggcttctccttcaggaagctgtacatgcagctggatgagggcagcctgaccttcaatgccaacccagatgaaggagtgaactacttcatgagcaagggcatcctggatgacagccccaaggagatcgccaagttcatcttctgcaccaggaccctgaactggaagaagctgcgcatctacctggatgagaggagagatgtgctggatgacctggtgaccctgcacaacttcaggaaccagttcctgcccaatgccctgcgggagttcttccgccacatccacgcccctgaggagcggggggagtacctggagaccctcatcaccaagttcagccaccgcttctgtgcctgcaacccagacctgatgagggagctgggcctgagcccagatgctgtgtatgtgctgtgctacagcctcatcctgctgagcattgacctgaccagcccccacgtgaagaacaagatgagcaagcgggagttcatccggaacaccaggagagctgcccagaacatcagtgaagattttgtgggccacctgtatgacaacatctacctgattggccacgtggccgcctag

SEQ ID NO: 152265 - DNA, 555 bp, Artificial Sequence
  Description of Artificial Sequence: Synthetic coding sequence
atgggccagggcctgtggagggtggtgaggaaccagcagctgcagcaggagggctacagcgagcagggctacctgacccgggagcagagcaggaggatggccgccagcaacatcagcaacaccaaccacaggaagcaggtgcagggcggcatcgacatctaccacctgctgaaggccaggaagagcaaggagcaggagggcttcatcaacctggagatgctgcccccagagctgtccttcaccatcctgagctacctgaatgccacagacctgtgcctggccagctgtgtgtggcaggacctggccaatgatgagctgctgtggcagggcctgtgcaagagcacctggggccactgcagcatctacaacaagaacccccccctgggcttctccttcaggaagctgtacatgcagctggatgagggcagcctgaccttcaatgccaacccagatgaaggagtgaactacttcatgagcaagggcatcctggatgacagccccaaggagatcgccaagttcatcttctgcaccaggaccctgaactggaagaagtag

SEQ ID NO: 152266 - DNA, 1344 bp, Artificial Sequence
  Description of Artificial Sequence: Synthetic coding sequence
atgccagacatcatctgggtgtttcctccccaggccgaggccgaggaggactgccacagcgacacagtgcgggcagatgatgatgaggagaatgaaagccctgctgagacagacctgcaggcccagctgcagatgttccgggcccagtggatgtttgagctggcccctggggtgagcagcagcaacctggagaaccggccctgccgggccgcccggggcagcctgcagaagaccagcgctgacaccaagggcaagcaggagcaggccaaggaggagaaggcccgggagctgttcctgaaggctgtggaggaggagcagaatggagccctgtatgaggccatcaagttctaccgccgggccatgcagctggtgcctgacatcgagttcaagatcacctacaccaggagcccagatggagatggagtgggcaacagctacatcgaggacaatgatgatgacagcaagatggctgacctgctgagctacttccagcagcagctgaccttccaggagagcgtgctgaagctgtgccagcctgagctggagagcagccagatccacatctctgtgctgcccatggaggtgctgatgtacatcttccgctgggtggtgtccagtgacctggacctgcggagcctggagcagctgagcctggtgtgccggggcttctacatctgtgcccgggaccctgagatctggaggctggcctgcctgaaggtgtggggccgcagctgcatcaagctggtgccctacacctcctggagggagatgttcctggagcggccccgggtgcgctttgatggagtgtacatcagcaagaccacctacatccggcagggcgagcagagcctggatggcttctaccgggcctggcaccaggtggagtactaccgctacatccgcttcttcccagatggccacgtgatgatgctgaccaccccagaggagccccagagcatcgtgccccggctgcggaccaggaacaccaggacagatgccatcctgctgggccactaccgcctgagccaggacacagacaaccagaccaaggtgtttgctgtgatcaccaagaagaaggaggagaagcccctggactacaagtaccgctacttccggcgggtgcctgtgcaggaggccgaccagagcttccacgtgggcctgcagctgtgcagcagcggccaccagcgcttcaacaagctgatctggatccaccacagctgccacatcacctacaagagcactggagaaacagctgtgtctgcctttgaaattgacaagatgtacacccccctcttctttgcccgggtgcgcagctacacagccttcagcgagcggcccctgtag

SEQ ID NO: 152267 - DNA, 1314 bp, Artificial Sequence
  Description of Artificial Sequence: Synthetic coding sequence
atggccgaggccgaggaggactgccacagcgacacagtgcgggcagatgatgatgaggagaatgaaagccctgctgagacagacctgcaggcccagctgcagatgttccgggcccagtggatgtttgagctggcccctggggtgagcagcagcaacctggagaaccggccctgccgggccgcccggggcagcctgcagaagaccagcgctgacaccaagggcaagcaggagcaggccaaggaggagaaggcccgggagctgttcctgaaggctgtggaggaggagcagaatggagccctgtatgaggccatcaagttctaccgccgggccatgcagctggtgcctgacatcgagttcaagatcacctacaccaggagcccagatggagatggagtgggcaacagctacatcgaggacaatgatgatgacagcaagatggctgacctgctgagctacttccagcagcagctgaccttccaggagagcgtgctgaagctgtgccagcctgagctggagagcagccagatccacatctctgtgctgcccatggaggtgctgatgtacatcttccgctgggtggtgtccagtgacctggacctgcggagcctggagcagctgagcctggtgtgccggggcttctacatctgtgcccgggaccctgagatctggaggctggcctgcctgaaggtgtggggccgcagctgcatcaagctggtgccctacacctcctggagggagatgttcctggagcggccccgggtgcgctttgatggagtgtacatcagcaagaccacctacatccggcagggcgagcagagcctggatggcttctaccgggcctggcaccaggtggagtactaccgctacatccgcttcttcccagatggccacgtgatgatgctgaccaccccagaggagccccagagcatcgtgccccggctgcggaccaggaacaccaggacagatgccatcctgctgggccactaccgcctgagccaggacacagacaaccagaccaaggtgtttgctgtgatcaccaagaagaaggaggagaagcccctggactacaagtaccgctacttccggcgggtgcctgtgcaggaggccgaccagagcttccacgtgggcctgcagctgtgcagcagcggccaccagcgcttcaacaagctgatctggatccaccacagctgccacatcacctacaagagcactggagaaacagctgtgtctgcctttgaaattgacaagatgtacacccccctcttctttgcccgggtgcgcagctacacagccttcagcgagcggcccctgtag

SEQ ID NO: 152268 - DNA, 1212 bp, Artificial Sequence
  Description of Artificial Sequence: Synthetic coding sequence
atgttccgggcccagtggatgtttgagctggcccctggggtgagcagcagcaacctggagaaccggccctgccgggccgcccggggcagcctgcagaagaccagcgctgacaccaagggcaagcaggagcaggccaaggaggagaaggcccgggagctgttcctgaaggctgtggaggaggagcagaatggagccctgtatgaggccatcaagttctaccgccgggccatgcagctggtgcctgacatcgagttcaagatcacctacaccaggagcccagatggagatggagtgggcaacagctacatcgaggacaatgatgatgacagcaagatggctgacctgctgagctacttccagcagcagctgaccttccaggagagcgtgctgaagctgtgccagcctgagctggagagcagccagatccacatctctgtgctgcccatggaggtgctgatgtacatcttccgctgggtggtgtccagtgacctggacctgcggagcctggagcagctgagcctggtgtgccggggcttctacatctgtgcccgggaccctgagatctggaggctggcctgcctgaaggtgtggggccgcagctgcatcaagctggtgccctacacctcctggagggagatgttcctggagcggccccgggtgcgctttgatggagtgtacatcagcaagaccacctacatccggcagggcgagcagagcctggatggcttctaccgggcctggcaccaggtggagtactaccgctacatccgcttcttcccagatggccacgtgatgatgctgaccaccccagaggagccccagagcatcgtgccccggctgcggaccaggaacaccaggacagatgccatcctgctgggccactaccgcctgagccaggacacagacaaccagaccaaggtgtttgctgtgatcaccaagaagaaggaggagaagcccctggactacaagtaccgctacttccggcgggtgcctgtgcaggaggccgaccagagcttccacgtgggcctgcagctgtgcagcagcggccaccagcgcttcaacaagctgatctggatccaccacagctgccacatcacctacaagagcactggagaaacagctgtgtctgcctttgaaattgacaagatgtacacccccctcttctttgcccgggtgcgcagctacacagccttcagcgagcggcccctgtag

SEQ ID NO: 152269 - DNA, 147 bp, Artificial Sequence
  Description of Artificial Sequence: Synthetic coding sequence
atgttccgggcccagtggatgtttgagctggcccctggggtgagcagcagcaacctggagaaccggccctgccgggccgcccggggcagcctgcagaagaccagcgctgacaccaagggcaagcaggagcaggccaaggaggagtag

SEQ ID NO: 152270 - DNA, 357 bp, Artificial Sequence
  Description of Artificial Sequence: Synthetic coding sequence
atgttccgggcccagtggatgtttgagctggcccctggggtgagcagcagcaacctggagaaccggccctgccgggccgcccggggcagcctgcagaagaccagcgctgacaccaagggcaagcaggagcaggccaaggaggagaaggcccgggagctgttcctgaaggctgtggaggaggagcagaatggagccctgtatgaggccatcaagttctaccgccgggccatgcagctggtgcctgacatcgagttcaagatcacctacaccaggagcccagatggagatggagtgggcaacagctacatcgaggacaatgatgatgacagcaagatggctgacctgctgagctactag

SEQ ID NO: 152271 - DNA, 438 bp, Artificial Sequence
  Description of Artificial Sequence: Synthetic coding sequence
atgttccgggcccagtggatgtttgagctggcccctggggtgagcagcagcaacctggagaaccggccctgccgggccgcccggggcagcctgcagaagaccagcgctgacaccaagggcaagcaggagcaggccaaggaggagaaggcccgggagctgttcctgaaggctgtggaggaggagcagaatggagccctgtatgaggccatcaagttctaccgccgggccatgcagctggtgcctgacatcgagttcaagatcacctacaccaggagcccagatggagatggagtgggcaacagctacatcgaggacaatgatgatgacagcaagatggctgacctgctgagctacttccagcagcagctgaccttccaggagagcgtgctgaagctgtgccagcctgagctggagagcagccagatccacatctcctag

SEQ ID NO: 152272 - DNA, 3132 bp, Artificial Sequence
  Description of Artificial Sequence: Synthetic coding sequence
atgaggcgcttcaagaggaagcacctgacagccatcgactgccagcacctggcccggagccacctggccgtgacccagcccttcggccagcgctggaccaacagagaccccaaccacggcctgtaccccaagcccaggaccaagaggggcagccggggccagggcagccagcgctgcatccctgagttcttcctggccggcaagcagccctgcaccaatgacatggccaagagcaacagcgtgggccaggacagctgccaggacagcgagggggacatgatcttccctgctgagagcagctgtgccctgccccaggagggcagcgctggccctggcagccctggcagcgccccacccagcaggaagaggtcctggagcagcgaggaggagagcaaccaggccaccggcaccagccgctgggatggagtgtccaagaaggcccccaggcaccacctgtctgtgccctgcacccggccccgggaggcccggcaggaggccgaggacagcaccagccggctgtctgctgagagcggggagacagaccaggatgctggagatgtgggccctgaccccatcccagacagctactacggcctgctgggcaccctgccctgccaggaggccctgagccacatctgcagcctgcccagcgaggtgctgcggcacgtgtttgccttcctgcctgtggaggacctgtactggaacctgagcctggtgtgccacctgtggagggagatcatcagtgaccccctcttcatcccctggaagaagctgtaccaccgctacctgatgaatgaggagcaggccgtgtccaaggtggatggcatcctgagcaactgtggcatcgagaaggagagtgacctgtgtgtgctgaacctgatccgctacacagccaccaccaagtgcagccccagcgtggaccctgagcgggtgctgtggagcctgcgggaccaccccctgctgcctgaggccgaggcctgtgtgcggcagcacctgcctgacctgtatgctgctgctggaggagtgaacatctgggccctggtggccgctgtggtgctgctgagcagctctgtgaatgacatccagaggctgctcttctgcctgcggcggcccagcagcacagtgaccatgccagatgtgacagagaccctgtactgcatcgctgtgctgctgtatgccatgagggagaagggcatcaacatcagcaaccgcatccactacaacatcttctactgcctgtacctgcaggagaacagctgcacccaggccaccaaggtgaaggaggagcccagcgtgtggccaggcaagaagaccatccagctgacccatgagcagcagctgatcctgaaccacaagatggagcccctgcaggtggtgaagatcatggcctttgctggcaccgggaagaccagcaccctggtgaagtatgcagagaagtggagccagagccgcttcctgtatgtgaccttcaacaagagcatcgccaagcaggccgagagggtcttccccagcaatgtcatctgcaagaccttccacagcatggcctacggccacatcggcaggaagtaccagagcaagaagaagctgaacctcttcaagctgacccccttcatggtgaacagcgtgctggccgagggcaaaggaggcttcatccgggccaagctggtgtgcaagaccctggagaacttctttgccagcgcagatgaggagctgaccatcgaccacgtgcccatctggtgcaagaacagccagggccagagggtgatggtggagcagagcgagaagctgaatggagtgctggaggccagccggctgtgggacaacatgaggaagctgggggagtgcacagaggaggcccaccagatgacccatgatggctacctgaagctgtggcagctgagcaagcccagcctggccagctttgatgccatctttgtggatgaggcccaggactgcaccccagccatcatgaacatcgtgctgagccagccctgtgggaagatctttgtgggggacccccaccagcagatctacaccttcagaggagctgtgaatgccctcttcaccgtgccccacacccacgtgttctacctgacccagagcttccgcttcggcgtggagatcgcctacgtgggcgccaccatcctggatgtgtgcaagagggtgaggaagaagaccctggtgggcggcaaccaccagagcggcatcagaggagatgccaagggccaggtggccctgctgagcaggaccaatgccaacgtgtttgatgaggccgtgcgggtgacagaaggagagttccccagccgcatccacctgattggaggcatcaagagctttggcctggaccgcatcatcgacatctggatcctgctgcagcctgaggaggagaggaggaagcagaacctggtgatcaaggacaagttcatccgccgctgggtgcacaaggagggcttcagcggcttcaagcgctacgtgacagctgctgaggacaaggagctggaggccaagattgctgtggtggagaagtacaacatccgcatccctgagctggtgcagagaattgagaagtgccacatcgaggacctggactttgctgagtacatcctgggcaccgtgcacaaggccaagggcctggagtttgacacagtgcacgtgctggatgactttgtgaaggtgccctgtgcccggcacaacctgccccagctgccccacttccgggtggagagcttctctgaagatgagtggaacctgctgtatgtggccgtgacccgggccaagaagaggctcatcatgaccaagagcctggagaacatcctgaccctggccggggagtacttcctgcaggccgagctgaccagcaatgtgctgaagacaggagtggtgcgctgctgcgtgggccagtgcaacaatgccatccctgtggacacagtgctgaccatgaagaagctgcccatcacctacagcaacaggaaggagaacaagggcggctacctgtgccacagctgtgccgagcagagaattggccccctggccttcctgacagccagccctgagcaggtgcgggccatggagaggacagtggagaacatcgtgctgcccaggcatgaggccctgctcttcctggtgttctag

SEQ ID NO: 152273 - DNA, 1215 bp, Artificial Sequence
  Description of Artificial Sequence: Synthetic coding sequence
atgaatgaggagcaggccgtgtccaaggtggatggcatcctgagcaactgtggcatcgagaaggagagtgacctgtgtgtgctgaacctgatccgctacacagccaccaccaagtgcagccccagcgtggaccctgagcgggtgctgtggagcctgcgggaccaccccctgctgcctgaggccgaggcctgtgtgcggcagcacctgcctgacctgtatgctgctgctgggggcgtgaacatctgggccctggtggccgctgtggtgctgctgagcagctctgtgaatgacatccagaggctgctcttctgcctgcggcggcccagcagcacagtgaccatgccagatgtgacagagaccctgtactgcatcgctgtgctgctgtatgccatgagggagaagggcatcaacatcagcaaccgcatccactacaacatcttctactgcctgtacctgcaggagaacagctgcacccaggccaccaaggtgaaggaggagcccagcgtgtggccaggcaagaagaccatccagctgacccatgagcagcagctgatcctgaaccacaagatggagcccctgcaggtggtgaagatcatggcctttgctggcaccgggaagaccagcaccctggtgaagtatgcagagaagtggagccagagccgcttcctgtatgtgaccttcaacaagagcatcgccaagcaggccgagagggtcttccccagcaatgtcatctgcaagaccttccacagcatggcctacggccacatcggcaggaagtaccagagcaagaagaagctgaacctcttcaagctgacccccttcatggtgaacagcgtgctggccgagggcaagggcggcttcatccgggccaagctggtgtgcaagaccctggagaacttctttgccagcgcagatgaggagctgaccatcgaccacgtgcccatctggtgcaagaacagccagggccagagggtgatggtggagcagagcgagaagctgaatggagtgctggaggccagccggctgtgggacaacatgaggaagctgggagaatgtacagaggaggcccaccagatgacccatgatggctacctgaagctgtggcagctgagcaagcccagcctggccagctttgatgccatctttgtggatgaggcccaggccggggcccggcacggggcccactgtggggagcacaggacagccccagcctag

SEQ ID NO: 152274 - DNA, 3285 bp, Artificial Sequence
  Description of Artificial Sequence: Synthetic coding sequence
atgtcctatgaggtgaccagcggctgccactggacctgccaggtgcctgagagctgtgacaatggcctgcactgtgccggccccctgggccacctgcaccggcgctgccagaggaccagcgcccacctgctggtgttcacagaacatgctgagatgaggcgcttcaagaggaagcacctgacagccatcgactgccagcacctggcccggagccacctggccgtgacccagcccttcggccagcgctggaccaacagagaccccaaccacggcctgtaccccaagcccaggaccaagaggggcagccggggccagggcagccagcgctgcatccctgagttcttcctggccggcaagcagccctgcaccaatgacatggccaagagcaacagcgtgggccaggacagctgccaggacagcgagggggacatgatcttccctgctgagagcagctgtgccctgccccaggagggcagcgctggccctggcagccctggcagcgccccacccagcaggaagaggtcctggagcagcgaggaggagagcaaccaggccaccggcaccagccgctgggatggagtgtccaagaaggcccccaggcaccacctgtctgtgccctgcacccggccccgggaggcccggcaggaggccgaggacagcaccagccggctgtctgctgagagcggggagacagaccaggatgctggagatgtgggccctgaccccatcccagacagctactacggcctgctgggcaccctgccctgccaggaggccctgagccacatctgcagcctgcccagcgaggtgctgcggcacgtgtttgccttcctgcctgtggaggacctgtactggaacctgagcctggtgtgccacctgtggagggagatcatcagtgaccccctcttcatcccctggaagaagctgtaccaccgctacctgatgaatgaggagcaggccgtgtccaaggtggatggcatcctgagcaactgtggcatcgagaaggagagtgacctgtgtgtgctgaacctgatccgctacacagccaccaccaagtgcagccccagcgtggaccctgagcgggtgctgtggagcctgcgggaccaccccctgctgcctgaggccgaggcctgtgtgcggcagcacctgcctgacctgtatgctgctgctgggggcgtgaacatctgggccctggtggccgctgtggtgctgctgagcagctctgtgaatgacatccagaggctgctcttctgcctgcggcggcccagcagcacagtgaccatgccagatgtgacagagaccctgtactgcatcgctgtgctgctgtatgccatgagggagaagggcatcaacatcagcaaccgcatccactacaacatcttctactgcctgtacctgcaggagaacagctgcacccaggccaccaaggtgaaggaggagcccagcgtgtggccaggcaagaagaccatccagctgacccatgagcagcagctgatcctgaaccacaagatggagcccctgcaggtggtgaagatcatggcctttgctggcaccgggaagaccagcaccctggtgaagtatgcagagaagtggagccagagccgcttcctgtatgtgaccttcaacaagagcatcgccaagcaggccgagagggtcttccccagcaatgtcatctgcaagaccttccacagcatggcctacggccacatcggcaggaagtaccagagcaagaagaagctgaacctcttcaagctgacccccttcatggtgaacagcgtgctggccgagggcaagggcggcttcatccgggccaagctggtgtgcaagaccctggagaacttctttgccagcgcagatgaggagctgaccatcgaccacgtgcccatctggtgcaagaacagccagggccagagggtgatggtggagcagagcgagaagctgaatggagtgctggaggccagccggctgtgggacaacatgaggaagctgggagaatgtacagaggaggcccaccagatgacccatgatggctacctgaagctgtggcagctgagcaagcccagcctggccagctttgatgccatctttgtggatgaggcccaggactgcaccccagccatcatgaacatcgtgctgagccagccctgtgggaagatctttgtgggggacccccaccagcagatctacaccttcagaggagctgtgaatgccctcttcaccgtgccccacacccacgtgttctacctgacccagagcttccgctttggagtggagatcgcctacgtgggcgccaccatcctggatgtgtgcaagagggtgaggaagaagaccctggtgggcggcaaccaccagagcggcatcagaggagatgccaagggccaggtggccctgctgagcaggaccaatgccaacgtgtttgatgaagctgtgcgggtgacagaaggagagttccccagccgcatccacctgattggaggcatcaagagctttggcctggaccgcatcatcgacatctggatcctgctgcagcctgaggaggagaggaggaagcagaacctggtgatcaaggacaagttcatccgccgctgggtgcacaaggagggcttcagcggcttcaagagatatgtgacagctgctgaggacaaggagctggaggccaagattgctgtggtggagaagtacaacatccgcatccctgagctggtgcagagaattgagaagtgccacatcgaggacctggactttgctgagtacatcctgggcaccgtgcacaaggccaagggcctggagtttgacacagtgcacgtgctggatgactttgtgaaggtgccctgtgcccggcacaacctgccccagctgccccacttccgggtggagagcttctctgaagatgagtggaacctgctgtatgtggccgtgacccgggccaagaagaggctcatcatgaccaagagcctggagaacatcctgaccctggccggggagtacttcctgcaggccgagctgaccagcaatgtgctgaagacaggagtggtgcgctgctgcgtgggccagtgcaacaatgccatccctgtggacacagtgctgaccatgaagaagctgcccatcacctacagcaacagaaaagaaaataaaggaggctacctgtgccacagctgtgccgagcagagaattggccccctggccttcctgacagccagccctgagcaggtgcgggccatggagaggacagtggagaacatcgtgctgcccaggcatgaggccctgctcttcctggtgttctag

SEQ ID NO: 152275 - DNA, 1644 bp, Artificial Sequence
  Description of Artificial Sequence: Synthetic coding sequence
atggcctacggccacatcggcaggaagtaccagagcaagaagaagctgaacctcttcaagctgacccccttcatggtgaacagcgtgctggccgagggcaagggcggcttcatccgggccaagctggtgtgcaagaccctggagaacttctttgccagcgcagatgaggagctgaccatcgaccacgtgcccatctggtgcaagaacagccagggccagagggtgatggtggagcagagcgagaagctgaatggagtgctggaggccagccggctgtgggacaacatgaggaagctgggagaatgtacagaggaggcccaccagatgacccatgatggctacctgaagctgtggcagctgagcaagcccagcctggccagctttgatgccatctttgtggatgaggcccaggactgcaccccagccatcatgaacatcgtgctgagccagccctgtgggaagatctttgtgggggacccccaccagcagatctacaccttcagaggagctgtgaatgccctcttcaccgtgccccacacccacgtgttctacctgacccagagcttccgctttggagtggagatcgcctacgtgggcgccaccatcctggatgtgtgcaagagggtgaggaagaagaccctggtgggcggcaaccaccagagcggcatcagaggagatgccaagggccaggtggccctgctgagcaggaccaatgccaacgtgtttgatgaagctgtgcgggtgacagaaggagagttccccagccgcatccacctgattggaggcatcaagagctttggcctggaccgcatcatcgacatctggatcctgctgcagcctgaggaggagaggaggaagcagaacctggtgatcaaggacaagttcatccgccgctgggtgcacaaggagggcttcagcggcttcaagagatatgtgacagctgctgaggacaaggagctggaggccaagattgctgtggtggagaagtacaacatccgcatccctgagctggtgcagagaattgagaagtgccacatcgaggacctggactttgctgagatggagagccaccacgtgggccaggccggcctggagctgcccaccagcgagtacatcctgggcaccgtgcacaaggccaagggcctggagtttgacacagtgcacgtgctggatgactttgtgaaggtgccctgtgcccggcacaacctgccccagctgccccacttccgggtggagagcttctctgaagatgagtggaacctgctgtatgtggccgtgacccgggccaagaagaggctcatcatgaccaagagcctggagaacatcctgaccctggccggggagtacttcctgcaggccgagctgaccagcaatgtgctgaagacaggagtggtgcgctgctgcgtgggccagtgcaacaatgccatccctgtggacacagtgctgaccatgaagaagctgcccatcacctacagcaacaggaaggagaacaagggcggctacctgtgccacagctgtgccgagcagagaattggccccctggccttcctgacagccagccctgagcaggtgcgggccatggagaggacagtggagaacatcgtgctgcccaggcatgaggccctgctcttcctggtgttctag

SEQ ID NO: 152276 - DNA, 1215 bp, Artificial Sequence; identical to SEQ ID NO: 152273
  Description of Artificial Sequence: Synthetic coding sequence

SEQ ID NO: 152277 - DNA, 576 bp, Artificial Sequence
  Description of Artificial Sequence: Synthetic coding sequence
atggaccccaagcagaccaccctgctgtgcctggtgctgtgcctgggccagaggatccaggcccaggagggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacagacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggacccccagcgtgtgcaagtag

SEQ ID NO: 152278 - DNA, 537 bp, Artificial Sequence
  Description of Artificial Sequence: Synthetic coding sequence
atggaccccaagcagaccaccctgctgtgcctgggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgctgctacggctggtacaacagaagcccctacctgtggagcttccccagcaatgccctggagctggtggtgacagacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggaccccatctgtgtgcaagtag

SEQ ID NO: 152279 - DNA, 864 bp, Artificial Sequence
  Description of Artificial Sequence: Synthetic coding sequence
atggaccccaagcagaccaccctgctgtgcctggtgctgtgcctgggccagaggatccaggcccaggagggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacaggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgctgctacggctggtacaacagaagcccctacctgtggagcttccccagcaatgccctggagctggtggtgacagacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggacccccagcgtgtgcaagtag

SEQ ID NO: 152280 - DNA, 828 bp, Artificial Sequence
  Description of Artificial Sequence: Synthetic coding sequence
atggaccccaagcagaccaccctgctgtgcctgggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacaggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgctgctacggctggtacaacagaagcccctacctgtggagcttccccagcaatgccctggagctggtggtgacagacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggacccccagcgtgtgcaagtag

SEQ ID NO: 152281 - DNA, 630 bp, Artificial Sequence
  Description of Artificial Sequence: Synthetic coding sequence
atggaccccaagcagaccaccctgctgtgcctgggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacaggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgcctgcaccccccccggctgcatgatgctgagctggacccccacggccggggccgcacaggcccccggggcagcctgggccacactggatag

SEQ ID NO: 152282 - DNA, 762 bp, Artificial Sequence
  Description of Artificial Sequence: Synthetic coding sequence
atggaccccaagcagaccaccctgctgtgcctgggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacaggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgctgctatgacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggacccccagcgtgtgcaagtag

SEQ ID NO: 152283 - DNA, 798 bp, Artificial Sequence
  Description of Artificial Sequence: Synthetic coding sequence
atggaccccaagcagaccaccctgctgtgcctggtgctgtgcctgggccagaggatccaggcccaggagggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacaggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgctgctatgacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggacccccagcgtgtgcaagtag

SEQ ID NO: 152284 - DNA, 540 bp, Artificial Sequence
  Description of Artificial Sequence: Synthetic coding sequence
atggaccccaagcagaccaccctgctgtgcctgggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacagacagcatccaccaggactacaccacccagaacctgatccgcatggctgtggccggcctggtgctggtggccctgctggccatcctggtggagaactggcacagccacacagccctgaacaaggaggccagcgcagatgtggccgagcccagctggagccagcagatgtgccagcccggcctgacctttgcccggacccccagcgtgtgcaagtag

SEQ ID NO: 152285 - DNA, 720 bp, Artificial Sequence
  Description of Artificial Sequence: Synthetic coding sequence
atggaccccaagcagaccaccctgctgtgcctggtgctgtgcctgggccagaggatccaggcccaggagggggacttccccatgcccttcatcagcgccaagagcagccctgtgatccccctggatggctctgtgaagatccagtgccaggccatccgggaggcctacctgacccagctgatgatcatcaagaacagcacctaccgggagattggaagaaggctgaagttctggaatgaaacagatcctgagtttgtgattgaccacatggatgccaacaaggccggccgctaccagtgccagtaccgcatcggccactaccgcttccgctacagcgacaccctggagctggtggtgacaggcctgtatggcaagcccttcctgtctgctgaccggggcctggtgctgatgcctggagagaacatcagcctgacctgcagcagcgcccacatcccctttgaccgcttcagcctggccaaggagggggagctgagcctgccccagcaccagagcggggagcacccagccaacttcagcctgggccctgtggacctgaatgtgtctggcatctaccgctgctacggctggtacaacagaagcccctacctgtggagcttccccagcaatgccctggagctggtggtgacaggccgctacagacctgtgcagccctgtgtgtgggtgggctgccccggcccctgccacagagctggcatctag

SEQ ID NO: 152286 - DNA, 774 bp, Artificial Sequence
  Description of Artificial Sequence: Synthetic coding sequence
atggccccagccatggagagccccaccctgctgtgtgtggccctgctcttctttgccccagatggagtgctggccgtgccccagaagcccaaggtgtccctgaaccccccctggaaccgcatcttcaagggagaaaatgtgaccctgacctgcaatggaaacaacttctttgaggtgagcagcaccaagtggttccacaacggcagcctgtctgaggagaccaacagcagcctgaacatcgtgaatgccaagtttgaggacagcggggagtacaagtgccagcaccagcaggtgaatgaaagtgagcctgtgtacctggaggtgttcagtgactggctgctgctgcaggccagcgctgaggtggtgatggagggccagcccctcttcctgcgctgccacggctggaggaactgggatgtgtacaaggtgatctactacaaggatggagaggccctgaagtactggtatgagaaccacaacatcagcatcaccaatgccaccgtggaggacagcggcacctactactgcaccgggaaggtgtggcagctggactatgaaagtgagcccctgaacatcaccgtcatcaaggccccccgggagaagtactggctgcagttcttcatccccctgctggtggtgatcctgtttgctgtggacaccggcctcttcatcagcacccagcagcaggtgaccttcctgctgaagatcaagaggaccaggaagggcttccggctgctgaacccccaccccaagcccaaccccaagaacaactag

SEQ ID NO: 152287 - DNA, 261 bp, Artificial Sequence
  Description of Artificial Sequence: Synthetic coding sequence
atgatcccagctgtggtgctgctgctgctgctgctggtggagcaggccgccgccctgggggagccccagctgtgctacatcctggatgccatcctcttcctgtatggaattgtgctgaccctgctgtactgccgcctgaagatccaggtgaggaaggccgccatcaccagctatgagaagagtgatggagtgtacacaggcctgagcaccaggaaccaggagacctatgagaccctgaagcatgagaagccaccccagtag

SEQ ID NO: 152288 - DNA, 339 bp, Artificial Sequence
  Description of Artificial Sequence: Synthetic coding sequence
atgatcccagctgtggtgctgctgctgctgctgctggtggagcaggccgccgccctgggggagccccagctgtgctacatcctggatgccatcctcttcctgtatggaattgtgctgaccctgctgtactgccgcctgaagatccaggtgaggaaggccgccatcaccagctatgagaagagtgatggagtgtacaccatggagagccccagcatcacccggctggagtgcagcggcatgatctgggcccactgcaacctgtgcctgctgggcagccgggacagccgggccagccccagccgggtggccaagaccaccggcaccaccatgcccagctag

SEQ ID NO: 152289 - DNA, 792 bp, Artificial Sequence
  Description of Artificial Sequence: Synthetic coding sequence
tgatgcagctttggagtgcagctgatgggcaagtgggtgccctgggtgtctgtgttccaggaggagaccgtgaccctgcactgtgaggtgctgcacctgcccggcagcagcagcacccagtggttcctgaatggaacagccacccagaccagcacccccagctaccgcatcaccagcgcctctgtgaatgattctggagagtaccgctgccagaggggcctgagcggccgcagtgaccccatccagctggagatccaccggggctggctgctgctgcaggtgagcagcagggtcttcatggagggggagcccctggccctgcgctgccacgcctggaaggacaagctggtgtacaacgtgctgtactacagaaatggcaaggccttcaagttcttccactggaacagcaacctgaccatcctgaagaccaacatcagccacaacggcacctaccactgcagcggcatgggcaagcaccgctacaccagcgctggcatcagccagtacacagtgaagggcctgcagctgcccacccctgtgtggttccacgtgctcttctacctggccgtgggcatcatgttcctggtgaacacagtgctgtgggtgaccatcaggaaggagctgaagaggaagaagaagtggaacctggagatcagcctggacagcggccacgagaagaaggtgatcagcagcctgcaggaggacagacacctggaggaggagctgaagtgccaggagcagaaggaggagcagctgcaggagggcgtgcacaggaaggagccccagggctag

SEQ ID NO: 152290 - DNA, 567 bp, Artificial Sequence
  Description of Artificial Sequence: Synthetic coding sequence
atgtggttcctgaccaccctgctgctgtggggctggctgctgctgcaggtgagcagcagggtcttcatggagggggagcccctggccctgcgctgccacgcctggaaggacaagctggtgtacaacgtgctgtactacagaaatggcaaggccttcaagttcttccactggaacagcaacctgaccatcctgaagaccaacatcagccacaacggcacctaccactgcagcggcatgggcaagcaccgctacaccagcgctggcatcagccagtacacagtgaagggcctgcagctgcccacccctgtgtggttccacgtgctcttctacctggccgtgggcatcatgttcctggtgaacacagtgctgtgggtgaccatcaggaaggagctgaagaggaagaagaagtggaacctggagatcagcctggacagcggccacgagaagaaggtgatcagcagcctgcaggaggacagacacctggaggaggagctgaagtgccaggagcagaaggaggagcagctgcaggagggcgtgcacaggaaggagccccagggcgccacctag

SEQ ID NO: 152291 - DNA, 843 bp, Artificial Sequence
  Description of Artificial Sequence: Synthetic coding sequence
atgtggttcctgaccaccctgctgctgtgggtgcctgtggatggccaggtggacaccaccaaggccgtcatcaccctgcagcccccctgggtgtctgtgttccaggaggagaccgtgaccctgcactgtgaggtgctgcacctgcccggcagcagcagcacccagtggttcctgaatggaacagccacccagaccagcacccccagctaccgcatcaccagcgcctctgtgaatgacagcggggagtaccgctgccagaggggcctgagcggccgcagtgaccccatccagctggagatccaccggggctggctgctgctgcaggtgagcagcagggtcttcatggagggggagcccctggccctgcgctgccacgcctggaaggacaagctggtgtacaacgtgctgtactacagaaatggcaaggccttcaagttcttccactggaacagcaacctgaccatcctgaagaccaacatcagccacaacggcacctaccactgcagcggcatgggcaagcaccgctacaccagcgctggcatcagccagtacacagtgaagggcctgcagctgcccacccctgtgtggttccacgtgctcttctacctggccgtgggcatcatgttcctggtgaacacagtgctgtgggtgaccatcaggaaggagctgaagaggaagaagaagtggaacctggagatcagcctggacagcggccacgagaagaaggtgatcagcagcctgcaggaggacagacacctggaggaggagctgaagtgccaggagcagaaggaggagcagctgcaggagggcgtgcacaggaaggagccccagggcgccacctag

SEQ ID NO: 152292 - DNA, 954 bp, Artificial Sequence
  Description of Artificial Sequence: Synthetic coding sequence
atgaccatggagacccagatgagccagaatgtgtgccccaggaacctgtggctgctgcagcccctgactgtgctgctgctgctggccagcgctgacagccaggccgccgccccacccaaggctgtgctgaagctggagcccccctggatcaacgtgctgcaggaggacagcgtgaccctgacctgccagggcgcccggagccctgagagtgacagcatccagtggttccacaacggcaacctgatccccacccacacccagcccagctaccgcttcaaggccaacaacaatgattctggagagtacacctgccagacaggccagaccagcctgagtgaccctgtgcacctgactgtgctgtctgagtggctggtgctgcagaccccccacctggagttccaggagggggagaccatcatgctgcgctgccacagctggaaggacaagcccctggtgaaggtgaccttcttccagaatggcaagagccagaagttcagccacctggaccccaccttcagcatcccccaggccaaccacagccacagcggggactaccactgcaccggcaacatcggctacaccctcttcagcagcaagcctgtgaccatcaccgtgcaggtgcccagcatgggcagcagcagccccatgggcatcatcgtggccgtggtgattgccacagctgtggccgccatcgtggccgctgtggtggccctgatctactgcaggaagaagaggatcagcgccaacagcacagatcctgtgaaggccgcccagtttgagcccccaggccggcagatgattgccatcaggaagaggcagctggaggagaccaacaatgactatgaaacagcagatggcggctacatgaccctgaacccccgggcccccacagatgatgacaagaacatctacctgaccctgcccccaaatgaccacgtgaacagcaacaactag

SEQ ID NO: 152293 - DNA, 951 bp, Artificial Sequence
  Description of Artificial Sequence: Synthetic coding sequence
atgaccatggagacccagatgagccagaatgtgtgccccaggaacctgtggctgctgcagcccctgactgtgctgctgctgctggccagcgctgacagccaggccgccccacccaaggctgtgctgaagctggagcccccctggatcaacgtgctgcaggaggacagcgtgaccctgacctgccagggcgcccggagccctgagagtgacagcatccagtggttccacaatggaaacctgatccccacccacacccagcccagctaccgcttcaaggccaacaacaatgacagcggggagtacacctgccagacaggccagaccagcctgagtgaccctgtgcacctgactgtgctgtctgagtggctggtgctgcagaccccccacctggagttccaggagggggagaccatcatgctgcgctgccacagctggaaggacaagcccctggtgaaggtgaccttcttccagaatggcaagagccagaagttcagccacctggaccccaccttcagcatcccccaggccaaccacagccacagcggggactaccactgcaccggcaacatcggctacaccctcttcagcagcaagcctgtgaccatcaccgtgcaggtgcccagcatgggcagcagcagccccatgggcatcatcgtggccgtggtgattgccacagctgtggccgccatcgtggccgctgtggtggccctgatctactgcaggaagaagaggatcagcgccaacagcacagatcctgtgaaggccgcccagtttgagcccccaggccggcagatgattgccatcaggaagaggcagctggaggagaccaacaatgactatgaaacagcagatggcggctacatgaccctgaacccccgggcccccacagatgatgacaagaacatctacctgaccctgcccccaaatgaccacgtgaacagcaacaactag

SEQ ID NO: 152294 - DNA, 876 bp, Artificial Sequence
  Description of Artificial Sequence: Synthetic coding sequence
atgggcatcctgtccttcctgcctgtgctggccacagaaagtgactgggccgactgcaagagcccccagccctggggccacatgctgctgtggacagctgtgctcttcctggcccctgtggccggcaccccagctgccccacccaaggctgtgctgaagctggagccccagtggatcaacgtgctgcaggaggacagcgtgaccctgacctgccggggcacccacagccctgagagtgacagcatccagtggttccacaatggaaacctgatccccacccacacccagcccagctaccgcttcaaggccaacaacaatgacagcggggagtacacctgccagacaggccagaccagcctgagtgaccctgtgcacctgactgtgctgtctgagtggctggtgctgcagaccccccacctggagttccaggagggggagaccatcgtgctgcgctgccacagctggaaggacaagcccctggtgaaggtgaccttcttccagaatggcaagagcaagaagttcagcagaagtgaccccaacttcagcatcccccaggccaaccacagccacagcggggactaccactgcaccggcaacatcggctacaccctgtacagcagcaagcctgtgaccatcaccgtgcaggcccccagcagcagccccatgggcatcatcgtggccgtggtgactggaattgctgtggccgccatcgtggccgctgtggtggccctgatctactgcaggaagaagaggatcagcgccaaccccaccaacccagatgaggccgacaaggtgggcgctgagaacaccatcacctacagcctgctgatgcacccagatgccctggaggagccagatgaccagaaccgcatctag

SEQ ID NO: 152295 - DNA, 933 bp, Artificial Sequence
  Description of Artificial Sequence: Synthetic coding sequence
atgggcatcctgtccttcctgcctgtgctggccacagaaagtgactgggccgactgcaagagcccccagccctggggccacatgctgctgtggacagctgtgctcttcctggcccctgtggccggcaccccagctgccccacccaaggctgtgctgaagctggagccccagtggatcaacgtgctgcaggaggacagcgtgaccctgacctgccggggcacccacagccctgagagtgacagcatccagtggttccacaatggaaacctgatccccacccacacccagcccagctaccgcttcaaggccaacaacaatgacagcggggagtacacctgccagacaggccagaccagcctgagtgaccctgtgcacctgactgtgctgtctgagtggctggtgctgcagaccccccacctggagttccaggagggggagaccatcgtgctgcgctgccacagctggaaggacaagcccctggtgaaggtgaccttcttccagaatggcaagagcaagaagttcagcagaagtgaccccaacttcagcatcccccaggccaaccacagccacagcggggactaccactgcaccggcaacatcggctacaccctgtacagcagcaagcctgtgaccatcaccgtgcaggcccccagcagcagccccatgggcatcatcgtggccgtggtgactggaattgctgtggccgccatcgtggccgctgtggtggccctgatctactgcaggaagaagaggatcagcgccctgcccggctacccagagtgccgggagatgggagagaccctgcctgagaagccagccaaccccaccaacccagatgaagctgacaaggtgggcgctgagaacaccatcacctacagcctgctgatgcacccagatgccctggaggagccagatgaccagaaccgcatctag

SEQ ID NO: 152296 - DNA, 912 bp, Artificial Sequence
  Description of Artificial Sequence: Synthetic coding sequence
atgggcatcctgtccttcctgcctgtgctggccacagaaagtgactgggccgactgcaagagcccccagccctggggccacatgctgctgtggacagctgtgctcttcctggccgccccacccaaggctgtgctgaagctggagccccagtggatcaacgtgctgcaggaggacagcgtgaccctgacctgccggggcacccacagccctgagagtgacagcatccagtggttccacaacggcaacctgatccccacccacacccagcccagctaccgcttcaaggccaacaacaatgattctggagagtacacctgccagacaggccagaccagcctgagtgaccctgtgcacctgactgtgctgtctgagtggctggtgctgcagaccccccacctggagttccaggagggggagaccatcgtgctgcgctgccacagctggaaggacaagcccctggtgaaggtgaccttcttccagaatggcaagagcaagaagttcagcagaagtgaccccaacttcagcatcccccaggccaaccacagccacagcggggactaccactgcaccggcaacatcggctacaccctgtacagcagcaagcctgtgaccatcaccgtgcaggcccccagcagcagccccatgggcatcatcgtggccgtggtgactggaattgctgtggccgccatcgtggccgctgtggtggccctgatctactgcaggaagaagaggatcagcgccctgcccggctacccagaatgtcgggagatgggagagaccctgcctgagaagccagccaaccccaccaacccagatgaggccgacaaggtgggcgctgagaacaccatcacctacagcctgctgatgcacccagatgccctggaggagccagatgaccagaaccgcatctag

SEQ ID NO: 152297 - DNA, 912 bp, Artificial Sequence; identical to SEQ ID NO: 152296
  Description of Artificial Sequence: Synthetic coding sequence

SEQ ID NO: 152298 - DNA, 933 bp, Artificial Sequence; identical to SEQ ID NO: 152295
  Description of Artificial Sequence: Synthetic coding sequence

SEQ ID NO: 152299 - DNA, 876 bp, Artificial Sequence; identical to SEQ ID NO: 152294
  Description of Artificial Sequence: Synthetic coding sequence

SEQ ID NO: 152300 - DNA, 705 bp, Artificial Sequence
  Description of Artificial Sequence: Synthetic coding sequence
atgggcatcctgtccttcctgcctgtgctggccacagaaagtgactgggccgactgcaagagcccccagccctggggccacatgctgctgtggacagctgtgctcttcctggcccctgtggccggcaccccagctgccccacccaaggctgtgctgaagctggagccccagtggatcaacgtgctgcaggaggacagcgtgaccctgacctgccggggcacccacagccctgagagtgacagcatccagtggttccacaatggaaacctgatccccacccacacccagcccagctaccgcttcaaggccaacaacaatgacagcggggagtacacctgccagacaggccagaccagcctgagtgaccctgtgcacctgactgtgctgtctgagtggctggtgctgcagaccccccacctggagttccaggagggggagaccatcgtgctgcgctgccacagctggaaggacaagcccctggtgaaggtgaccttcttccagaatggcaagagcaagaagttcagcagaagtgaccccaacttcagcatcccccaggccaaccacagccacagcggggactaccactgcaccggcaacatcggctacaccctgtacagcagcaagcctgtgaccatcaccgtgcagggcccccggctgaggacagctgccaagcagagcagcctggtgggcgctgaggtgccctag

SEQ ID NO: 152301 - DNA, 771 bp, Artificial Sequence
  Description of Artificial Sequence: Synthetic coding sequence
atgggcatcctgtccttcctgcctgtgctggccacagaaagtgactgggccgactgcaagagcccccagccctggggccacatgctgctgtggacagctgtgctcttcctgggggagagcggccccccagctgccccacccaaggctgtgctgaagctggagccccagtggatcaacgtgctgcaggaggacagcgtgaccctgacctgccggggcacccacagccctgagagtgacagcatccagtggttccacaacggcaacctgatccccacccacacccagcccagctaccgcttcaaggccaacaacaatgattctggagagtacacctgccagacaggccagaccagcctgagtgaccctgtgcacctgactgtgctgtctgagtggctggtgctgcagaccccccacctggagttccaggagggggagaccatcgtgctgcgctgccacagctggaaggacaagcccctggtgaaggtgaccttcttccagaatggcaagagcaagaagttcagcagaagtgaccccaacttcagcatcccccaggccaaccacagccacagcggggactaccactgcaccggcaacatcggctacaccctgtacagcagcaagcctgtgaccatcaccgtgcaggcccccagcagcagccccatgggcatcatcgtggccgtggtgactggaattgctgtggccgccatcgtggccgctgtggtggccctgatctactgcaggaagaagaggatctctgtgtccacctggtag

SEQ ID NO: 152302 - DNA, 765 bp, Artificial Sequence
  Description of Artificial Sequence: Synthetic coding sequence
atgtggcagctgctgctgcccacagccctgctgctgctggtgtctgctggcatgaggacagaggacctgcccaaggctgtggtgttcctggagccccagtggtacagagtgctggagaaggacagcgtgaccctgaagtgccagggcgcctacagccctgaggacaacagcacccagtggttccacaatgaaagcctcatcagcagccaggccagcagctacttcattgatgctgccaccgtggatgacagcggggagtaccgctgccagaccaacctgagcaccctgagtgaccctgtgcagctggaggtgcacatcggctggctgctgctgcaggccccccgctgggtgttcaaggaggaggaccccatccacctgcgctgccacagctggaagaacacagccctgcacaaggtgacctacctgcagaatggcaagggcaggaagtacttccaccacaacagcgacttctacatccccaaggccaccctgaaggacagcggcagctacttctgccggggcctgtttggcagcaagaatgtgtccagtgaaacagtgaacatcaccatcacccagggcctggccgtgtccaccatcagcagcttcttccccccaggctaccaggtgtccttctgcctggtgatggtgctgctgtttgctgtggacaccggcctgtacttctctgtgaagaccaacatccgcagcagcacccgggactggaaggaccacaagttcaagtggaggaaggacccccaggacaagtag

SEQ ID NO: 152303 - DNA, 873 bp, Artificial Sequence
  Description of Artificial Sequence: Synthetic coding sequence
atgggcggcggggccggggagcggctcttcaccagcagctgcctggtgggcctggtgcccctgggcctgcgcatcagcctggtgacctgccccctgcagtgtggcatcatgtggcagctgctgctgcccacagccctgctgctgctggtgtctgctggcatgaggacagaggacctgcccaaggctgtggtgttcctggagccccagtggtacagagtgctggagaaggacagcgtgaccctgaagtgccagggcgcctacagccctgaggacaacagcacccagtggttccacaatgaaagcctcatcagcagccaggccagcagctacttcattgatgctgccaccgtggatgacagcggggagtaccgctgccagaccaacctgagcaccctgagtgaccctgtgcagctggaggtgcacatcggctggctgctgctgcaggccccccgctgggtgttcaaggaggaggaccccatccacctgcgctgccacagctggaagaacacagccctgcacaaggtgacctacctgcagaatggcaagggcaggaagtacttccaccacaacagcgacttctacatccccaaggccaccctgaaggacagcggcagctacttctgccggggcctgtttggcagcaagaatgtgtccagtgaaacagtgaacatcaccatcacccagggcctggccgtgtccaccatcagcagcttcttccccccaggctaccaggtgtccttctgcctggtgatggtgctgctgtttgctgtggacaccggcctgtacttctctgtgaagaccaacatccgcagcagcacccgggactggaaggaccacaagttcaagtggaggaaggacccccaggacaagtag

SEQ ID NO: 152304 - DNA, 816 bp, Artificial Sequence
  Description of Artificial Sequence: Synthetic coding sequence
tgacccctgggcctgcgcatcagcctggtgacctgccccctgcagtgtggcatcatgtggcagctgctgctgcccacagccctgctgctgctggtgtctgctggcatgaggacagacctgcccaaggctgtggtgttcctggagccccagtggtacagagtgctggagaaggacagcgtgaccctgaagtgccagggcgcctacagccctgaggacaacagcacccagtggttccacaatgaaagcctcatcagcagccaggccagcagctacttcattgatgctgccaccgtggatgattctggagagtaccgctgccagaccaacctgagcaccctgagtgaccctgtgcagctggaggtgcacatcggctggctgctgctgcaggccccccgctgggtgttcaaggaggaggaccccatccacctgcgctgccacagctggaagaacacagccctgcacaaggtgacctacctgcagaatggaaaaggaaggaagtacttccaccacaacagcgacttctacatccccaaggccaccctgaaggacagcggcagctacttctgccggggcctgtttggcagcaagaatgtgagcagcgagaccgtgaacatcaccatcacccagggcctggccgtgtccaccatcagcagcttcttccccccaggctaccaggtgtccttctgcctggtgatggtgctgctgtttgctgtggacaccggcctgtacttctctgtgaagaccaacatccgcagcagcacccgggactggaaggaccacaagttcaagtggaggaaggacccccaggacaagtag

SEQ ID NO: 152305 - DNA, 765 bp, Artificial Sequence; identical to SEQ ID NO: 152302
  Description of Artificial Sequence: Synthetic coding sequence

SEQ ID NO: 152306 - DNA, 318 bp, Artificial Sequence
  Description of Artificial Sequence: Synthetic coding sequence
atgtggcagctgctgctgcccacagccctgctgctgctggtgtctgctggcatgaggacagacctgcccaaggctgtggtgttcctggagccccagtggtacagagtgctggagaaggacagcgtgaccctgaagtgccagggcgcctacagccctgaggacaacagcacccagtggttccacaatgaaagcctcatcagcagccaggccagcagctacttcattgatgctgccaccgtggatgattctggagagtaccgctgccagaccaacctgagcaccctgagtgaccctgtgcagctggaggtgcacatctag

SEQ ID NO: 152307 - DNA, 870 bp, Artificial Sequence
  Description of Artificial Sequence: Synthetic coding sequence
atgggcggcggggccggggagcggctcttcaccagcagctgcctggtgggcctggtgcccctgggcctgcgcatcagcctggtgacctgccccctgcagtgtggcatcatgtggcagctgctgctgcccacagccctgctgctgctggtgtctgctggcatgaggacagacctgcccaaggctgtggtgttcctggagccccagtggtacagagtgctggagaaggacagcgtgaccctgaagtgccagggcgcctacagccctgaggacaacagcacccagtggttccacaatgaaagcctcatcagcagccaggccagcagctacttcattgatgctgccaccgtggatgattctggagagtaccgctgccagaccaacctgagcaccctgagtgaccctgtgcagctggaggtgcacatcggctggctgctgctgcaggccccccgctgggtgttcaaggaggaggaccccatccacctgcgctgccacagctggaagaacacagccctgcacaaggtgacctacctgcagaatggaaaaggaaggaagtacttccaccacaacagcgacttctacatccccaaggccaccctgaaggacagcggcagctacttctgccggggcctgtttggcagcaagaatgtgagcagcgagaccgtgaacatcaccatcacccagggcctggccgtgtccaccatcagcagcttcttccccccaggctaccaggtgtccttctgcctggtgatggtgctgctgtttgctgtggacaccggcctgtacttctctgtgaagaccaacatccgcagcagcacccgggactggaaggaccacaagttcaagtggaggaaggacccccaggacaagtag

SEQ ID NO: 152308 - DNA, 765 bp, Artificial Sequence; identical to SEQ ID NO: 152302
  Description of Artificial Sequence: Synthetic coding sequence

SEQ ID NO: 152309 - DNA, 702 bp, Artificial Sequence
  Description of Artificial Sequence: Synthetic coding sequence
atgtggcagctgctgctgcccacagccctgctgctgctggtgtctgctggcatgaggacagaggacctgcccaaggctgtggtgttcctggagccccagtggtacagcgtgctggagaaggacagcgtgaccctgaagtgccagggcgcctacagccctgaggacaacagcacccagtggttccacaatgaaaacctgatcagcagccaggccagcagctacttcattgatgctgccaccgtgaatgacagcggggagtaccgctgccagaccaacctgagcaccctgagtgaccctgtgcagctggaggtgcacatcggctggctgctgctgcaggccccccgctgggtgttcaaggaggaggaccccatccacctgcgctgccacagctggaagaacacagccctgcacaaggtgacctacctgcagaatggcaaggacaggaagtacttccaccacaacagcgacttccacatccccaaggccaccctgaaggacagcggcagctacttctgccggggcctggtgggcagcaagaatgtgtccagtgaaacagtgaacatcaccatcacccagggcctggccgtgtccaccatcagcagcttcagccccccaggctaccaggtgtccttctgcctggtgatggtgctgctgtttgctgtggacaccggcctgtacttctctgtgaagaccaacatctag

SEQ ID NO: 152310 - DNA, 702 bp, Artificial Sequence; identical to SEQ ID NO: 152309
  Description of Artificial Sequence: Synthetic coding sequence

SEQ ID NO: 152311 - DNA, 2076 bp, Artificial Sequence
  Description of Artificial Sequence: Synthetic coding sequence
atggagatcgccccccaggaggcccctcctgtgcctggagcagatggagacatcgaggaggccccagctgaggccggcagccccagccctgccagccccccagcagatggccgcctgaaggccgccgccaagagggtgaccttccccagtgatgaggacatcgtgtctggagctgtggagcccaaggacccctggaggcatgcccagaatgtgacagtggatgaggtgattggagcctacaagcaggcctgccagaagctgaactgccggcagatccccaagctgctgcggcagctgcaggagttcacagacctgggccaccggctggactgcctggacctgaagggggagaagctggactacaagacctgtgaggccctggaggaggtgttcaagaggctgcagttcaaggtggtggacctggagcagaccaacctggatgaagatggagccagcgccctgtttgacatgattgagtactatgaaagtgccacccacctgaacatctccttcaacaagcacatcggcacccggggctggcaggccgccgcccacatgatgaggaagaccagctgcctgcagtacctggatgccaggaacacccccctgctggaccacagcgccccctttgtggcccgggccctgcgcatccgcagcagcctggccgtgctgcacctggagaatgccagcctgagcggccggcccctgatgctgctggccacagccctgaagatgaacatgaacctgcgggagctgtacctggccgacaacaagctgaatggcctgcaggacagcgcccagctgggcaacctgctgaagttcaactgcagcctgcagatcctggacctgaggaacaaccacgtgctggacagcggcctggcctacatctgtgagggcctgaaggagcagaggaagggcctggtgaccctggtgctgtggaacaaccagctgacccacacaggcatggccttcctgggcatgaccctgccccacacccagagcctggagaccctgaacctgggccacaaccccatcggaaatgaaggagtgcgccacctgaagaatggcctcatcagcaacagatctgtgctgcggctgggcctggccagcaccaagctgacctgtgagggcgctgtggccgtggccgagttcatcgccgagagcccccggctgctgcggctggacctgcgggagaatgagatcaagacaggaggcctgatggccctgagcctggccctgaaggtgaaccacagcctgctgcggctggacctggaccgggagcccaagaaggaggccgtgaagagcttcatcgagacccagaaggccctgctggccgagatccagaatggctgcaagaggaacctggtgctggcccgggagcgggaggagaaggagcagcccccccagctgagcgcctccatgcctgagaccacagccacagagccccagccagatgatgagcctgctgctggggtgcagaatggagcccccagccctgcccccagcccagacagcgacagcgacagcgacagtgatggagaggaggaggaggaggaggagggggagagagatgagaccccctgcccagccctggtgcccccaacagacagcctgggccctggggacaggagccccccaggcagccccagcacccccacagagcagaggatctctgtgagcagccctggccggggccacaaggtgtttgtggtgaccagggtggagagccccccagagagagctgagcccccagccagccccaccccacccagccccccacctccacccagccccccagccagccccagcctgcccccagctggggccatcgacacccgggacaccggcagcagcgagccccagcccccacctgagccccccaggagcggcccccccctgcccaacggcctgaagccagagtttgccctggccctgcccccagagcccccacctggccctgaggtgaagggcggcagctgtggcctggagcacgagctgagctgcagcaagaatgagaaggagctggaggagctgctgctggaggccagccaggagagcggccaggagaccctgtag

SEQ ID NO: 152312 - DNA, 459 bp, Artificial Sequence
  Description of Artificial Sequence: Synthetic coding sequence
atgggcgtgccccggccccagccctgggccctgggcctgctgctcttcctgctgcccggcagcctgggcgctgagagccacctgagcctgctgtaccacctgacagctgtgagcagccctgcccctggcaccccagccttctgggtgtctggctggctgggcccccagcagtacctgagctacaacagcctgcggggggaggccgagccctgtggggcctgggtgtgggagaaccaggtgtcctggtactgggagaaggagaccacagacctgcgcatcaaggagaagctgttcctggaggccttcaaggccctgggcggcaagggcccctacaccctgcagggcctgctgggctgtgagctgggccctgacaacacctctgtgcccacagcctgtggcagcacctggagaggagctgctgagacctggagcggccgcagccccccaccctgtgcctag

SEQ ID NO: 152313 - DNA, 1098 bp, Artificial Sequence; identical to SEQ ID NO: 148549
  Description of Artificial Sequence: Synthetic coding sequence

SEQ ID NO: 152314 - DNA, 708 bp, Artificial Sequence
  Description of Artificial Sequence: Synthetic coding sequence
atgggcgtgccccggccccagccctgggccctgggcctgctgctcttcctgctgcccggcagcctgggcgctgagagccacctgagcctgctgtaccacctgacagctgtgagcagccctgcccctggcaccccagccttctgggtgtctggctggctgggcccccagcagtacctgagctacaacagcctgcggggggaggccgagccctgtggggcctgggtgtgggagaaccaggtgtcctggtactgggagaaggagaccacagacctgcgcatcaaggagaagctgttcctggaggccttcaaggccctgggcggcaagggcccctacaccctgcagggcctgctgggctgtgagctgggccctgacaacacctctgtgcccacagccaagtttgccctgaatggagaggagttcatgaactttgacctgaagcagggcacctggggcggggactggccagaggccctggccatcagccagcgctggcagcagcaggacaaggccgccaacaaggagctgaccttcctgctcttcagctgcccccaccggctgcgggagcacctggagcggggccggggcaacctggagtggaagggctgctggaccaagattgacacctcctggggctgtgcccagatcttcatccccagcgccaccaaggagaagctgcggctgaaccagagccccccaccctgtgcctag

SEQ ID NO: 152315 - DNA, 1734 bp, Artificial Sequence
  Description of Artificial Sequence: Synthetic coding sequence
atggatggagaggccaccgtgaagccaggagagcagaaggaggtggtgagaagaggccgggaggtggactacagccggctgattgctggcaccctgccccagagccacgtgaccagccggcgggccggctggaagatgcccctcttcctgatcctgtgcctgctgcagggcagcagctttgccctgccccagaagaggccccacccccgctggctgtgggagggcagcctgcccagcaggacccacctgcgggccatgggcaccctgcggcccagcagccccctgtgctggagggaggagagcagctttgctgcccccaacagcctgaagggcagccggctggtgtctggagagcctggaggagctgtgaccatccagtgccactacgcccccagctctgtgaacagacaccagaggaagtactggtgccgcctgggccccccacgctggatctgccagaccatcgtgtccaccaaccagtacacccaccaccgctacagagacagagtggccctgacagacttcccccagaggggcctgtttgtggtgcggctgagccagctgagcccagatgacatcggctgctacctgtgtggcatcggcagcgagaacaacatgctgttcctgtccatgaacctgaccatctctgctggccctgccagcaccctgcccacagccaccccagctgctggggagctgaccatgaggagctatggaacagccagccctgtggccaaccgctggaccccaggcaccacccagaccctgggccagggcacagcctgggacacagtggccagcaccccaggcaccagcaagaccacagccagcgctgagggccgccgcacccctggggccaccaggcctgctgcccctggcaccggctcctgggccgagggctctgtgaaggccccagcccccatccctgagagcccccccagcaagagccgctccatgagcaacaccacagaaggagtgtgggagggcaccaggagctctgtgaccaacagagcccgggccagcaaggaccggcgggagatgaccaccaccaaggctgaccggcccagagaagatattgaaggagtgcgcatcgccctggatgctgccaagaaggtgctgggcaccatcggccccccagccctggtgtctgagaccctggcctgggagatcctgccccaggccacccctgtgtccaagcagcagagccagggcagcatcggggagaccaccccagctgctggcatgtggaccctgggcaccccagctgctgatgtgtggatcctgggcaccccagctgctgatgtgtggacctccatggaggccgccagcggggagggcagcgctgctggggacctggatgctgccaccggggaccggggcccccaggccaccctgagccagaccccagctgtgggcccctggggccccccaggcaaggagagctctgtgaagaggaccttcccagaagatgagagcagcagcaggaccctggcccctgtgtccaccatgctggccctcttcatgctgatggccctggtgctgctgcagaggaagctgtggaggaggaggaccagccaggaggccgagcgggtgaccctcatccagatgacccacttcctggaggtgaacccccaggccgaccagctgccccacgtggagaggaagatgctgcaggatgacagcctgcctgctggggccagcctgacagcccctgagagaaatcctggcccctag

SEQ ID NO: 152316 - DNA, 1608 bp, Artificial Sequence
  Description of Artificial Sequence: Synthetic coding sequence
atggatggagaggccaccgtgaagccaggagagcagaaggtgcccctgtggacccacggctggcccccagatgaccccagccccagctttgctgctggcagcagctttgccctgccccagaagaggccccacccccgctggctgtgggagggcagcctgcccagcaggacccacctgcgggccatgggcaccctgcggcccagcagccccctgtgctggagggaggagagcagctttgctgcccccaacagcctgaagggcagccggctggtgtctggagagcctggaggagctgtgaccatccagtgccactacgcccccagctctgtgaacagacaccagaggaagtactggtgccgcctgggccccccacgctggatctgccagaccatcgtgtccaccaaccagtacacccaccaccgctacagagacagagtggccctgacagacttcccccagaggggcctgtttgtggtgcggctgagccagctgagcccagatgacatcggctgctacctgtgtggcatcggcagcgagaacaacatgctgttcctgtccatgaacctgaccatctctgctggccctgccagcaccctgcccacagccaccccagctgctggggagctgaccatgaggagctatggaacagccagccctgtggccaaccgctggaccccaggcaccacccagaccctgggccagggcacagcctgggacacagtggccagcaccccaggcaccagcaagaccacagccagcgctgagggccgccgcacccctggggccaccaggcctgctgcccctggcaccggctcctgggccgagggctctgtgaaggccccagcccccatccctgagagcccccccagcaagagccgctccatgagcaacaccacagaaggagtgtgggagggcaccaggagctctgtgaccaacagagcccgggccagcaaggaccggcgggagatgaccaccaccaaggctgaccggcccagagaagatattgaaggagtgcgcatcgccctggatgctgccaagaaggtgctgggcaccatcggccccccagccctggtgtctgagaccctggcctgggagatcctgccccaggccacccctgtgtccaagcagcagagccagggcagcatcggggagaccaccccagctgctggcatgtggaccctgggcaccccagctgctgatgtgtggatcacctccatggaggccgccagcggggagggcagcgctgctggggacctggatgctgccactggagaccggggcccccaggccaccctgagccagaccccagctgtgggcccctggggccccccaggcaaggagagctctgtgaagagggccacctgccccggcctgagcaccctgaaggagatcaaggtgtctgctgtgctgacccagaacccccacagcctgctgtgtgtgtctgctgcccaggaggccgagcgggtgaccctcatccagatgacccacttcctggaggtgaacccccaggccgaccagctgccccacgtggagaggaagatgctgcaggatgacagcctgcctgctggggccagcctgacagcccctgagagaaatcctggcccctag

SEQ ID NO: 152317 - DNA, 798 bp, Artificial Sequence
  Description of Artificial Sequence: Synthetic coding sequence
atggatggagaggccaccgtgaagccaggagagcagaaggaggtggtgagaagaggccgggaggtggactacagccggctgattgctggcaccctgccccagagccacgtgaccagccggcgggccggctggaagatgcccctcttcctgatcctgtgcctgctgcagggcagcagctttgccctgccccagaagaggccccacccccgctggctgtgggagggcagcctgcccagcaggacccacctgcgggccatgggcaccctgcggcccagcagccccctgtgctggagggaggagagcagctttgctgcccccaacagcctgaagggcagccggctggtgtctggagagcctggaggagctgtgaccatccagtgccactacgcccccagctctgtgaacagacaccagaggaagtactggtgccgcctgggccccccacgctggatctgccagaccatcgtgtccaccaaccagtacacccaccaccgctacagagacagagtggccctgacagacttcccccagaggggcctgtttgtggtgcggctgagccagctgagcccagatgacatcggctgctacctgtgtggcatcggcagcgagaacaacatgctgttcctgtccatgaacctgaccatctctgctgtgctcttccagaagatgaaggccgccctgggcccctggctgctgagcctgccctgctggccctgcctgtgcctgtggctgtggttctactgcaagggcagcagcggggagggcggccccctgcggcggcagaagggcagcccctag

SEQ ID NO: 152318 - DNA, 798 bp, Artificial Sequence; identical to SEQ ID NO: 152317
  Description of Artificial Sequence: Synthetic coding sequence

SEQ ID NO: 152319 - DNA, 1101 bp, Artificial Sequence
  Description of Artificial Sequence: Synthetic coding sequence
atgctgccccggctgctgctgctgatctgtgcccccctgtgtgagcctgctgagctgttcctgattgccagccccagccaccccacagagggcagccctgtgaccctgacctgcaagatgcccttcctgcagagcagtgatgcccagttccagttctgcttcttccgggacacccgggccctgggccctggctggagcagcagccccaagctgcagattgctgccatgtggaaggaggacaccggcagctactggtgtgaggcccagaccatggccagcaaggtgctgcggagcagaagaagccagatcaacgtgcaccgggtgcctgtggctgatgtgtccctggagacccagcccccaggcggccaggtgatggagggggaccggctggtgctgatctgcagcgtggccatgggcaccggggacatcaccttcctgtggtacaagggagctgtgggcctgaacctgcagagcaagacccagaggagcctgacagcagaatatgagatccccagcgtgcgggagagtgatgctgagcagtactactgtgtggccgagaatggctacggccccagccccagcggcctggtgtccatcaccgtgcgcatccctgtgtcccggcccatcctgatgctgcgggccccccgggcccaggccgctgtggaggatgtgctggagctgcactgtgaggccctgcggggcagcccccccatcctgtactggttctaccacgaggacatcaccctgggcagccgcagcgcccccagcggcggcggggccagcttcaacctgagcctgacagaggagcacagcggcaactacagctgtgaggccaacaacggcctgggcgcccagaggtctgaggccgtgaccctgaacttcaccggcagaagaagtgcccgggaccccctgcggagcctgcccagccccctgccccaggagttcacctacctgaacagccccaccccaggccagctgcagcccatctatgaaaatgagccccgggagcagagcgtggccgtgcacggccggcagcagcacagcagcgagcagaaggcccagaagccctggggccacatctggaggacccgcttcccctag

SEQ ID NO: 152320 - DNA, 1290 bp, Artificial Sequence
  Description of Artificial Sequence: Synthetic coding sequence
atgctgccccggctgctgctgctgatctgtgcccccctgtgtgagcctgctgagctgttcctgattgccagccccagccaccccacagagggcagccctgtgaccctgacctgcaagatgcccttcctgcagagcagtgatgcccagttccagttctgcttcttccgggacacccgggccctgggccctggctggagcagcagccccaagctgcagattgctgccatgtggaaggaggacaccggcagctactggtgtgaggcccagaccatggccagcaaggtgctgcggagcagaagaagccagatcaacgtgcaccgggtgcctgtggctgatgtgtccctggagacccagcccccaggcggccaggtgatggagggggaccggctggtgctgatctgcagcgtggccatgggcaccggggacatcaccttcctgtggtacaagggagctgtgggcctgaacctgcagagcaagacccagaggagcctgacagcagaatatgagatccccagcgtgcgggagagtgatgctgagcagtactactgtgtggccgagaatggctacggccccagccccagcggcctggtgtccatcaccgtgcgcatccctgtgtcccggcccatcctgatgctgcgggccccccgggcccaggccgctgtggaggatgtgctggagctgcactgtgaggccctgcggggcagcccccccatcctgtactggttctaccacgaggacatcaccctgggcagccgcagcgcccccagcggcggcggggccagcttcaacctgagcctgacagaggagcacagcggcaactacagctgtgaggccaacaacggcctgggcgcccagaggtctgaggccgtgaccctgaacttcaccgtgcccaccggggcccggagcaaccacctgaccagcggggtcatcgagggcctgctgagcaccctgggccctgccaccgtggccctgctcttctgctacggcctgaagaggaagattggccgccgcagcgcccgggaccccctgcggagcctgcccagccccctgccccaggagttcacctacctgaacagccccaccccaggccagctgcagcccatctatgaaaatgtgaatgtggtgtctggagatgaggtgtacagcctggcctactacaaccagcctgagcaggagagcgtggccgctgagaccctgggcacccacatggaggacaaggtgtccctggacatctacagccggctgaggaaggccaacatcacagatgtggactatgaagatgccatgtag

SEQ ID NO: 152321 - DNA, 1287 bp, Artificial Sequence
  Description of Artificial Sequence: Synthetic coding sequence
atgctgccccggctgctgctgctgatctgtgcccccctgtgtgagcctgctgagctgttcctgattgccagccccagccaccccacagagggcagccctgtgaccctgacctgcaagatgcccttcctgcagagcagtgatgcccagttccagttctgcttcttccgggacacccgggccctgggccctggctggagcagcagccccaagctgcagattgctgccatgtggaaggaggacaccggcagctactggtgtgaggcccagaccatggccagcaaggtgctgcggagcagaagaagccagatcaacgtgcaccgggtgcctgtggctgatgtgtccctggagacccagcccccaggcggccaggtgatggagggggaccggctggtgctgatctgcagcgtggccatgggcaccggggacatcaccttcctgtggtacaagggagctgtgggcctgaacctgcagagcaagacccagaggagcctgacagcagaatatgagatccccagcgtgcgggagagtgatgctgagcagtactactgtgtggccgagaatggctacggccccagccccagcggcctggtgtccatcaccgtgcgcatccctgtgtcccggcccatcctgatgctgcgggccccccgggcccaggccgctgtggaggatgtgctggagctgcactgtgaggccctgcggggcagcccccccatcctgtactggttctaccacgaggacatcaccctgggcagccgcagcgcccccagcggcggcggggccagcttcaacctgagcctgacagaggagcacagcggcaactacagctgtgaggccaacaacggcctgggcgcccagaggtctgaggccgtgaccctgaacttcaccgtgcccaccggggcccggagcaaccacctgaccagcggggtcatcgagggcctgctgagcaccctgggccctgccaccgtggccctgctcttctgctacggcctgaagaggaagattggccgccgcagcgcccgggaccccctgcggagcctgcccagccccctgccccaggagttcacctacctgaacagccccaccccaggccagctgcagcccatctatgaaaatgtgaatgtggtgtctggagatgaggtgtacagcctggcctactacaaccagcctgagcaggagagcgtggccgagaccctgggcacccacatggaggacaaggtgtccctggacatctacagccggctgaggaaggccaacatcacagatgtggactatgaagatgccatgtag

SEQ ID NO: 152322 - DNA, 2670 bp, Artificial Sequence
  Description of Artificial Sequence: Synthetic coding sequence
atgagctactttggagagcacttctggggcgagaagaaccacggctttgaggtgctgtaccacagcgtgaagcagggccccatcagcaccaaggagctggccgacttcatccgggagcgggccaccatcgaggagacctacagcaaggccatggccaagctgagcaagctggccagcaatggcacccccatgggcacctttgcccccctgtgggaggtgttccgggtgtccagtgacaagctggccctgtgccacctggagctgaccaggaagctgcaggacctgatcaaggatgtgctgcgctacggggaggagcagctgaagacccacaagaagtgcaaggaggaggtggtgtccaccctggatgctgtgcaggtgctgagcggcgtgtcccagctgctgcccaagagccgggagaactacctgaaccgctgcatggaccaggagcggctgcggcgggagagcaccagccagaaggagatggacaaggccgagaccaagaccaagaaggctgctgagagcctgcggcgctctgtggagaagtacaacagcgcccgggctgactttgagcagaagatgctggacagcgccctgcgcttccaggccatggaggagacccacctgcggcacatgaaggccctgctgggcagctatgcccacagcgtggaggacacccacgtgcagatcggccaggtgcatgaggagttcaagcagaacattgaaaatgtgtctgtggagatgctgctgaggaagtttgctgagagcaagggcaccggccgggagaagccaggccccctggactttgaggcctacagcgctgctgccctgcaggaggccatgaagaggctgcggggggccaaggccttccggctgcccggcctgagccggcgggagcgggagcctgagcccccagctgctgtggacttcctggagccagacagcggcacctgcccagaggtggatgaggagggcttcaccgtgcggccagatgtgacccagaacagcacagctgagcccagccgcttcagcagcagtgacagcgactttgatgatgaggagcccaggaagttctacgtgcacatcaagccagccccagcccgggccccagcctgcagccctgaggccgctgctgcccagctgcgggccacagctggcagcctcatcctgcccccaggccctgggggcaccatgaagaggcacagcagcagagatgctgctgggaagccccagaggcccaggtctgcccccaggaccagcagctgtgccgagcggctgcagagcgaggagcaggtgtccaagaacctgtttggcccccccctggagagcgcctttgaccacgaggacttcaccggcagcagcagcctgggcttcaccagcagccccagccccttcagcagcagcagcccagaaaatgtggaggacagcggcctggacagccccagccatgctgcccctggccccagcccagacagctgggtgccccggcccggcaccccccagagcccccccagctgccgggcccctcctcctgaggcccggggcatccgggccccacccctgcctgacagcccccagcccctggccagcagccctggcccctggggcctggaggccctggccggcggggacctgatgcctgccccagctgaccccacagcccgggagggcctggccgccccaccccggcggctgcggagcaggaaggtgtcctgccccctgaccaggagcaatggagacctgagccgcagcctgagccccagccccctgggcagcagcgctgccagcacagccctggagcggcccagcttcctgagccagacaggccatggagtgtcccggggccccagccctgtggtgctgggcagccaggatgccctgcccatcgccacagccttcacagaatatgtgcacgcctacttccggggccacagccccagctgcctggcccgggtgactggagagctgaccatgaccttccctgctggcatcgtgcgggtcttcagcggcaccccacctcctcctgtgctgtccttccggctggtgcacaccacagccatcgagcacttccagcccaatgctgacctgctcttcagtgaccccagccagagcgaccctgagaccaaggacttctggctgaacatggccgccctgacagaggccctgcagaggcaggccgagcagaaccccacagccagctactacaacgtggtgctgctgcgctaccagttcagccggcccggcccccagagcgtgcccctgcagctgagcgcccactggcagtgtggggccaccctgacccaggtgtctgtggagtatggctacagacctggggccacagctgtgcccacccccctgaccaacgtgcagatcctgctgcctgtgggggagcctgtgaccaacgtgcggctgcagcctgctgccacctggaacctggaggagaagaggctgacctggaggctgcctgatgtgtctgaggccggcggcagcggccgcctgagcgcctcctgggagcccctgagcggccccagcacccccagccctgtggccgcccagttcaccagcgagggcaccaccctgagcggcgtggacctggagctggtgggcagcggctacaggatgagcctggtgaagagaagatttgccaccggcatgtacctggtgtcctgctag

SEQ ID NO: 152323 - DNA, 2670 bp, Artificial Sequence; identical to SEQ ID NO: 152322
  Description of Artificial Sequence: Synthetic coding sequence

SEQ ID NO: 152324 - DNA, 2670 bp, Artificial Sequence; identical to SEQ ID NO: 152322
  Description of Artificial Sequence: Synthetic coding sequence

SEQ ID NO: 152325 - DNA, 2676 bp, Artificial Sequence
  Description of Artificial Sequence: Synthetic coding sequence
atgagctactttggagagcacttctggggcgagaagaaccacggctttgaggtgctgtaccacagcgtgaagcagggccccatcagcaccaaggagctggccgacttcatccgggagcgggccaccatcgaggagacctacagcaaggccatggccaagctgagcaagctggccagcaatggcacccccatgggcacctttgcccccctgtgggaggtgttccgggtgtccagtgacaagctggccctgtgccacctggagctgaccaggaagctgcaggacctgatcaaggatgtgctgcgctacggggaggagcagctgaagacccacaagaagtgcaaggaggaggtggtgtccaccctggatgctgtgcaggtgctgagcggcgtgtcccagctgctgcccaagagccgggagaactacctgaaccgctgcatggaccaggagcggctgcggcgggagagcaccagccagaaggagatggacaaggccgagaccaagaccaagaaggctgctgagagcctgcggcgctctgtggagaagtacaacagcgcccgggctgactttgagcagaagatgctggacagcgccctgcgcttccaggccatggaggagacccacctgcggcacatgaaggccctgctgggcagctatgcccacagcgtggaggacacccacgtgcagatcggccaggtgcatgaggagttcaagcagaacattgaaaatgtgtctgtggagatgctgctgaggaagtttgctgagagcaagggcaccggccgggagaagccaggccccctggactttgaggcctacagcgctgctgccctgcaggaggccatgaagaggctgcggggggccaaggccttccggctgcccggcctgagccggcgggagcgggagcctgagcccccagctgctgtggacttcctggagccagacagcggcacctgcccagaggtggatgaggagggcttcaccgtgcggccagatgtgacccagaacagcacagctgagcccagccgcttcagcagcagtgacagcgactttgatgatgaggagcccaggaagttctacgtgcacatcaagccagccccagcccgggccccagcctgcagccctgaggccgctgctgcccagctgcgggccacagctggcagcctcatcctgcccccaggccctgggggcaccatgaagaggcacagcagcagagatgctgctgggaagccccagaggcccaggtctgcccccaggaccagcagctgtgccgagcggctgcagagcgaggagcaggtgtccaagaacctgtttggcccccccctggagagcgcctttgaccacgaggacttcaccggcagcagcagcctgggcttcaccagcagccccagccccttcagcagcagcagcccagaaaatgtggaggacagcggcctggacagccccagccatgctgcccctggccccagcccagacagctgggtgccccggcccggcaccccccagagcccccccagctgccgggcccctcctcctgaggcccggggcatccgggccccacccctgcctgacagcccccagcccctggccagcagccctggcccctggggcctggaggccctggccggcggggacctgatgcctgccccagctgaccccacagcccgggagggcctggccgccccaccccggcggctgcggagcaggaaggtgtcctgccccctgaccaggagcaatggagacctgagccgcagcctgagccccagccccctgggcagcagcgctgccagcacagccctggagcggcccagcttcctgagccagacaggccatggagtgtcccggggccccagccctgtggtgctgggcagccaggatgccctgcccatcgccacagccttcacagaatatgtgcacgcctacttccggggccacagccccagctgcctggcccgggtgactggagagctgaccatgaccttccctgctggcatcgtgcgggtcttcagcggcaccccacctcctcctgtgctgtccttccggctggtgcacaccacagccatcgagcacttccagcccaatgctgacctgctcttcagtgaccccagccagagcgaccctgagaccaaggacttctggctgaacatggccgccctgacagaggccctgcagaggcaggccgagcagaaccccacagccagctactacaacgtggtgctgctgcgctaccagttcagccggcccggcccccagagcgtgcccctgcagctgagcgcccactggcagtgtggggccaccctgacccaggtgtctgtggagtatggctacagacctggggccacagctgtgcccacccccctgaccaacgtgcagatcctgctgcctgtgggggagcctgtgaccaacgtgcggctgcagcctgctgccacctggaacctggaggagaagaggctgacctggaggctgcctgatgtgtctgaggccggcggcagcggccgcctgagcgcctcctgggagcccctgagcggccccagcacccccagccctgtggccgcccagttcaccagcgagggcaccaccctgagcggcgtggacctggagctggtgggcagcggctacaggatgagcctggtgaagagaagatttgccacagctgccccaccccagggctgcacctggtag

SEQ ID NO: 152326 - DNA, 2520 bp, Artificial Sequence
  Description of Artificial Sequence: Synthetic coding sequence
atggccaagctgagcaagctggccagcaatggcacccccatgggcacctttgcccccctgtgggaggtgttccgggtgtccagtgacaagctggccctgtgccacctggagctgaccaggaagctgcaggacctgatcaaggatgtgctgcgctacggggaggagcagctgaagacccacaagaagtgcaaggaggaggtggtgtccaccctggatgctgtgcaggtgctgagcggcgtgtcccagctgctgcccaagagccgggagaactacctgaaccgctgcatggaccaggagcggctgcggcgggagagcaccagccagaaggagatggacaaggccgagaccaagaccaagaaggctgctgagagcctgcggcgctctgtggagaagtacaacagcgcccgggctgactttgagcagaagatgctggacagcgccctgcgcttccaggccatggaggagacccacctgcggcacatgaaggccctgctgggcagctatgcccacagcgtggaggacacccacgtgcagatcggccaggtgcatgaggagttcaagcagaacattgaaaatgtgtctgtggagatgctgctgaggaagtttgctgagagcaagggcaccggccgggagaagccaggccccctggactttgaggcctacagcgctgctgccctgcaggaggccatgaagaggctgcggggggccaaggccttccggctgcccggcctgagccggcgggagcgggagcctgagcccccagctgctgtggacttcctggagccagacagcggcacctgcccagaggtggatgaggagggcttcaccgtgcggccagatgtgacccagaacagcacagctgagcccagccgcttcagcagcagtgacagcgactttgatgatgaggagcccaggaagttctacgtgcacatcaagccagccccagcccgggccccagcctgcagccctgaggccgctgctgcccagctgcgggccacagctggcagcctcatcctgcccccaggccctgggggcaccatgaagaggcacagcagcagagatgctgctgggaagccccagaggcccaggtctgcccccaggaccagcagctgtgccgagcggctgcagagcgaggagcaggtgtccaagaacctgtttggcccccccctggagagcgcctttgaccacgaggacttcaccggcagcagcagcctgggcttcaccagcagccccagccccttcagcagcagcagcccagaaaatgtggaggacagcggcctggacagccccagccatgctgcccctggccccagcccagacagctgggtgccccggcccggcaccccccagagcccccccagctgccgggcccctcctcctgaggcccggggcatccgggccccacccctgcctgacagcccccagcccctggccagcagccctggcccctggggcctggaggccctggccggcggggacctgatgcctgccccagctgaccccacagcccgggagggcctggccgccccaccccggcggctgcggagcaggaaggtgtcctgccccctgaccaggagcaatggagacctgagccgcagcctgagccccagccccctgggcagcagcgctgccagcacagccctggagcggcccagcttcctgagccagacaggccatggagtgtcccggggccccagccctgtggtgctgggcagccaggatgccctgcccatcgccacagccttcacagaatatgtgcacgcctacttccggggccacagccccagctgcctggcccgggtgactggagagctgaccatgaccttccctgctggcatcgtgcgggtcttcagcggcaccccacctcctcctgtgctgtccttccggctggtgcacaccacagccatcgagcacttccagcccaatgctgacctgctcttcagtgaccccagccagagcgaccctgagaccaaggacttctggctgaacatggccgccctgacagaggccctgcagaggcaggccgagcagaaccccacagccagctactacaacgtggtgctgctgcgctaccagttcagccggcccggcccccagagcgtgcccctgcagctgagcgcccactggcagtgtggggccaccctgacccaggtgtctgtggagtatggctacagacctggggccacagctgtgcccacccccctgaccaacgtgcagatcctgctgcctgtgggggagcctgtgaccaacgtgcggctgcagcctgctgccacctggaacctggaggagaagaggctgacctggaggctgcctgatgtgtctgaggccggcggcagcggccgcctgagcgcctcctgggagcccctgagcggccccagcacccccagccctgtggccgcccagttcaccagcgagggcaccaccctgagcggcgtggacctggagctggtgggcagcggctacaggatgagcctggtgaagagaagatttgccaccggcatgtacctggtgtcctgctag

SEQ ID NO: 152327 - DNA, 2670 bp, Artificial Sequence; identical to SEQ ID NO: 152322
  Description of Artificial Sequence: Synthetic coding sequence

SEQ ID NO: 152328 - DNA, 2670 bp, Artificial Sequence; identical to SEQ ID NO: 152322
  Description of Artificial Sequence: Synthetic coding sequence

SEQ ID NO: 152329 - DNA, 1137 bp, Artificial Sequence
  Description of Artificial Sequence: Synthetic coding sequence
atggtgatggcctactttgtggagaacttctggggcgagaagaacagcggctttgatgtgctgtaccacaacatgaagcacggccagatcagcaccaaggagctggccgactttgtgcgggagcgggccaccatcgaggaggcctacagccgctccatgaccaagctggccaagagcgccagcaactacagccagctgggcacctttgcccctgtgtgggatgtgttcaagaccagcacagagaagctggccaactgccacctggacctggtgaggaagctgcaggagctgatcaaggaggtgcagaagtacggggaggagcaggtgaagagccacaagaagaccaaggaggaggtggccggcaccctggaggccgtgcagaccatccagagcatcacccaggccctgcagaagagcaaagaaaactacaatgccaagtgtgtggagcaggagcggctgaagaaggagggcgccacccagcgggagattgagaaggctgctgtgaagagcaagaaggccacagacacctacaagctgtatgtggagaagtatgccctggccaaggctgactttgagcagaagatgacagaaacagcccagaagttccaggacatcgaggagacccacctgatccacatcaaggagatcatcggcagcctgagcaatgccatcaaggagatccacctgcagatcggccaggtgcatgaggagttcatcaacaacatggccaacaccaccgtggagagcctcatccagaagtttgctgagagcaagggcaccgggaaggagaggcctggcctcatcgagtttgaggagtgtgacacagccagcgctgtggagggcatcaagcccaggaagaggaagacctttgccctgcccggcatcatcaagaaggagaaggatgctgagagcgtgtggagcttcaccgtggtggcccaggtgggcatgcagtggagggacctgggcctgctgcacagccccccaccccgcttcaagcgcttcagcagctacctgagcctgcccagctcctggaactacggggcccaccaccacatctggctgatcttctgcatcttcagccgggacagagtgagcccctactggccaggctggagcaggaccccagacctgaggtag

SEQ ID NO: 152330 - DNA, 2433 bp, Artificial Sequence
  Description of Artificial Sequence: Synthetic coding sequence
atggtgatggcctactttgtggagaacttctggggcgagaagaacagcggctttgatgtgctgtaccacaacatgaagcacggccagatcagcaccaaggagctggccgactttgtgcgggagcgggccaccatcgaggaggcctacagccgctccatgaccaagctggccaagagcgccagcaactacagccagctgggcacctttgcccctgtgtgggatgtgttcaagaccagcacagagaagctggccaactgccacctggacctggtgaggaagctgcaggagctgatcaaggaggtgcagaagtacggggaggagcaggtgaagagccacaagaagaccaaggaggaggtggccggcaccctggaggccgtgcagaccatccagagcatcacccaggccctgcagaagagcaaagaaaactacaatgccaagtgtgtggagcaggagcggctgaagaaggagggcgccacccagcgggagattgagaaggctgctgtgaagagcaagaaggccacagacacctacaagctgtatgtggagaagtatgccctggccaaggctgactttgagcagaagatgacagaaacagcccagaagttccaggacatcgaggagacccacctgatccacatcaaggagatcatcggcagcctgagcaatgccatcaaggagatccacctgcagatcggccaggtgcatgaggagttcatcaacaacatggccaacaccaccgtggagagcctcatccagaagtttgctgagagcaagggcaccgggaaggagaggcctggcctcatcgagtttgaggagtgtgacacagccagcgctgtggagggcatcaagcccaggaagaggaagacctttgccctgcccggcatcatcaagaaggagaaggatgctgagagcgtggagtgcccagatgctgacagcctgaacatcccagatgtggatgaggagggctacagcatcaagccagagaccaaccagaatgacaccaaggagaaccacttctacagcagcagtgacagcgacagtgaagatgaggagcccaagaagtacagaattgagatcaagcccatgcaccccaacaacagccaccacaccatggccagcctggatgagctgaaggtgtccatcggcaacatcaccctgagccctgccatctctgtgtccaccaacacccggctgaacagaaacttcaatgatgaggagctgaccaagagcaagcccagcgcccccccaaatgagaagggcaccagtgacctgctggcctgggaccccctgtttggccccagcctggacagcagcagcagcagcagcctgaccagcagcagcagcgcccggcccaccacccccctgtctgtgggcaccatcgtgcccccacccaggcctgccagccggcccaagctgaccagcggcaagctgagcggcatcaatgagatcccccggcccttcagcccccctgtgaccagcaacaccagccccccacctgctgcccccctggcccgggcagagagcagcagcagcatcagcagcagcgccagcctgtctgctgccaacacccccaccgtgggcgtgtcccggggccccagccctgtgtccctgggcaaccaggacaccctgcctgtggccgtggccctgacagagagcgtgaatgcctacttcaagggagctgaccccaccaagtgcatcgtgaagatcaccggggacatgaccatgtccttccccagcggcatcatcaaggtgttcaccagcaaccccaccccagctgtgctgtgcttccgggtgaagaacatcagccggctggagcagatcctgcccaatgcccagctggtgttcagtgaccccagccagtgtgacagcaacaccaaggacttctggatgaacatgcaggccgtgacagtgtacctgaagaagctgtctgagcagaacccagctgccagctactacaacgtggatgtgctgaagtaccaggtgagcagcaatggcatccagagcacccccctgaacctggccacctactggaagtgcagcgccagcaccacagacctgcgggtggactacaagtacaaccctgaggccatggtggcccccagcgtgctgagcaacatccaggtggtggtgcctgtggatggaggagtgaccaacatgcagagcctgcccccagccatctggaatgctgagcagatgaaggccttctggaagctgagcagcatcagcgagaagtcagaaaatggaggcagcggcagcctgcgggccaagtttgacctgtctgagggccccagcaagcccaccaccctggccgtgcagttcctgtctgagggcagcaccctgtctggagtggactttgagctggtgggcaccggctaccgcctgagcctcatcaagaagagatttgccaccggccgctacctggccgactgctag

SEQ ID NO: 152331 - DNA, 2433 bp, Artificial Sequence
  Description of Artificial Sequence: Synthetic coding sequence
atggtgatggcctactttgtggagaacttctggggcgagaagaacagcggctttgatgtgctgtaccacaacatgaagcacggccagatcagcaccaaggagctggccgactttgtgcgggagcgggccaccatcgaggaggcctacagccgctccatgaccaagctggccaagagcgccagcaactacagccagctgggcacctttgcccctgtgtgggatgtgttcaagaccagcacagagaagctggccaactgccacctggacctggtgaggaagctgcaggagctgatcaaggaggtgcagaagtacggggaggagcaggtgaagagccacaagaagaccaaggaggaggtggccggcaccctggaggccgtgcagaccatccagagcatcacccaggccctgcagaagagcaaagaaaactacaatgccaagtgtgtggagcaggagcggctgaagaaggagggcgccacccagcgggagattgagaaggctgctgtgaagagcaagaaggccacagacacctacaagctgtatgtggagaagtatgccctggccaaggctgactttgagcagaagatgacagaaacagcccagaagttccaggacatcgaggagacccacctgatccacatcaaggagatcatcggcagcctgagcaatgccatcaaggagatccacctgcagatcggccaggtgcatgaggagttcatcaacaacatggccaacaccaccgtggagagcctcatccagaagtttgctgagagcaagggcaccgggaaggagaggcctggcctcatcgagtttgaggagtgtgacacagccagcgctgtggagggcatcaagcccaggaagaggaagacctttgccctgcccggcatcatcaagaaggagaaggatgctgagagcgtggagtgcccagatgctgacagcctgaacatcccagatgtggatgaggagggctacagcatcaagccagagaccaaccagaatgacaccaaggagaaccacttctacagcagcagtgacagcgacagtgaagatgaggagcccaagaagtacagaattgagatcaagcccatgcaccccaacaacagccaccacaccatggccagcctggatgagctgaaggtgtccatcggcaacatcaccctgagccctgccatcagccgccacagccctgtgcagatgaacagaaacctgagcaatgaggagctgaccaagagcaagcccagcgcccccccaaatgagaagggcaccagtgacctgctggcctgggaccccctgtttggccccagcctggacagcagcagcagcagcagcctgaccagcagcagcagcgcccggcccaccacccccctgtctgtgggcaccatcgtgcccccacccaggcctgccagccggcccaagctgaccagcggcaagctgagcggcatcaatgagatcccccggcccttcagcccccctgtgaccagcaacaccagccccccacctgctgcccccctggcccgggcagagagcagcagcagcatcagcagcagcgccagcctgtctgctgccaacacccccaccgtgggcgtgtcccggggccccagccctgtgtccctgggcaaccaggacaccctgcctgtggccgtggccctgacagagagcgtgaatgcctacttcaagggagctgaccccaccaagtgcatcgtgaagatcaccggggacatgaccatgtccttccccagcggcatcatcaaggtgttcaccagcaaccccaccccagctgtgctgtgcttccgggtgaagaacatcagccggctggagcagatcctgcccaatgcccagctggtgttcagtgaccccagccagtgtgacagcaacaccaaggacttctggatgaacatgcaggccgtgacagtgtacctgaagaagctgtctgagcagaacccagctgccagctactacaacgtggatgtgctgaagtaccaggtgagcagcaatggcatccagagcacccccctgaacctggccacctactggaagtgcagcgccagcaccacagacctgcgggtggactacaagtacaaccctgaggccatggtggcccccagcgtgctgagcaacatccaggtggtggtgcctgtggatggaggagtgaccaacatgcagagcctgcccccagccatctggaatgctgagcagatgaaggccttctggaagctgagcagcatcagcgagaagtcagaaaatggaggcagcggcagcctgcgggccaagtttgacctgtctgagggccccagcaagcccaccaccctggccgtgcagttcctgtctgagggcagcaccctgtctggagtggactttgagctggtgggcaccggctaccgcctgagcctcatcaagaagagatttgccaccggccgctacctggccgactgctag

SEQ ID NO: 152332 - DNA, 2334 bp, Artificial Sequence
  Description of Artificial Sequence: Synthetic coding sequence
atggtgatggcctactttgtggagaacttctggggcgagaagaacagcggctttgatgtgctgtaccacaacatgaagcacggccagatcagcaccaaggagctggccgactttgtgcgggagcgggccaccatcgaggaggcctacagccgctccatgaccaagctggccaagagcgccagcaactacagccagctgggcacctttgcccctgtgtgggatgtgttcaagaccagcacagagaagctggccaactgccacctggacctggtgaggaagctgcaggagctgatcaaggaggtgcagaagtacggggaggagcaggtgaagagccacaagaagaccaaggaggaggtggccggcaccctggaggccgtgcagaccatccagagcatcacccaggccctgcagaagagcaaagaaaactacaatgccaagtgtgtggagcaggagcggctgaagaaggagggcgccacccagcgggagattgagaaggctgctgtgaagagcaagaaggccacagacacctacaagctgtatgtggagaagtatgccctggccaaggctgactttgagcagaagatgacagaaacagcccaggtgcatgaggagttcatcaacaacatggccaacaccaccgtggagagcctcatccagaagtttgctgagagcaaaggaacaggcaaggagcggcccggcctgattgaatttgaagaatgtgacacagccagcgctgtggagggcatcaagcccaggaagaggaagacctttgccctgcccggcatcatcaagaaggagaaggatgctgagagcgtggagtgcccagatgctgacagcctgaacatcccagatgtggatgaggagggctacagcatcaagccagagaccaaccagaatgacaccaaggagaaccacttctacagcagcagtgacagcgacagtgaagatgaggagcccaagaagtaccgcatcgagatcaagcccatgcaccccaacaacagccaccacaccatggccagcctggatgagctgaaggtgtccatcggcaacatcaccctgagccctgccatcagccgccacagccctgtgcagatgaacagaaacctgagcaatgaggagctgaccaagagcaagcccagcgcccccccaaatgagaagggcaccagtgacctgctggcctgggaccccctgtttggccccagcctggacagcagcagcagcagcagcctgaccagcagcagcagcgcccggcccaccacccccctgtctgtgggcaccatcgtgcccccacccaggcctgccagccggcccaagctgaccagcggcaagctgagcggcatcaatgagatcccccggcccttcagcccccctgtgaccagcaacaccagccccccacctgctgcccccctggcccgggcagagagcagcagcagcatcagcagcagcgccagcctgtctgctgccaacacccccaccgtgggcgtgtcccggggccccagccctgtgtccctgggcaaccaggacaccctgcctgtggccgtggccctgacagaatctgtgaatgcctacttcaagggagctgaccccaccaagtgcatcgtgaagatcactggagacatgaccatgtccttccccagcggcatcatcaaggtgttcaccagcaaccccaccccagctgtgctgtgcttccgggtgaagaacatcagccggctggagcagatcctgcccaatgcccagctggtgttcagtgaccccagccagtgtgacagcaacaccaaggacttctggatgaacatgcaggccgtgacagtgtacctgaagaagctgtctgagcagaacccagctgccagctactacaacgtggatgtgctgaagtaccaggtgagcagcaatggcatccagagcacccccctgaacctggccacctactggaagtgcagcgccagcaccacagacctgcgggtggactacaagtacaaccctgaggccatggtggcccccagcgtgctgagcaacatccaggtggtggtgcctgtggatggcggcgtgaccaacatgcagagcctgcccccagccatctggaatgctgagcagatgaaggccttctggaagctgagcagcatcagcgagaagtcagaaaatggaggcagcggcagcctgcgggccaagtttgacctgtctgagggccccagcaagcccaccaccctggccgtgcagttcctgtctgagggcagcaccctgagcggcgtggactttgagctggtgggcaccggctaccgcctgagcctcatcaagaagagatttgccaccggccgctacctggccgactgctag

SEQ ID NO: 152333 - DNA, 1668 bp, Artificial Sequence
  Description of Artificial Sequence: Synthetic coding sequence
atggcccggccagatgatgaggagggcgctgctgtggcccctggccaccccctggccaagggctacctgcccctgcccaggggggcccctgtgggcaaggagagcgtggagctgcagaatggccccaaggccggcaccttccctgtgaatggagccccccgggacagcctggccgccgccagcggcgtgctgggcggcccccagacccccctggcccctgaggaggagacccaggcccggctgctgcctgctggggccggggctgagaccccaggagctgagagcagccccctgcccctgacagccctgagccccaggagatttgtggtgctgctgatcttcagcctgtacagcctggtgaatgccttccagtggatccagtacagcatcatcagcaatgtgtttgagggcttctatggagtgaccctgctgcacatcgactggctgtccatggtgtacatgctggcctacgtgcccctcatcttccctgccacctggctgctggacacccggggcctgcggctgacagccctgctgggcagcggcctgaactgcctgggcgcctggatcaagtgtggctctgtgcagcagcacctgttctgggtgaccatgctgggccagtgcctgtgcagcgtggcccaggtgttcatcctgggcctgcccagccgcatcgcctctgtgtggtttggccccaaggaggtgtccacagcctgtgccacagctgtgctgggcaaccagctgggcacagctgtgggcttcctgctgccccctgtgctggtgcccaacacccagaatgacaccaacctgctggcctgcaacatcagcaccatgttttatggcaccagcgctgtggccaccctgctcttcatcctgacagccatcgccttcaaggagaagccccgctacccacccagccaggcccaggccgccctgcaggacagccccccagaggagtacagctacaagaagagcatccggaacctcttcaagaacatcccctttgtgctgctgctgatcacctacggcatcatgactggagccttctacagcgtgtccaccctgctgaaccagatgatcctgacctactatgaaggagaggaggtgaatgccggcagaattggcctgaccctggtggtggccggcatggtgggcagcatcctgtgtggcctgtggctggactacaccaagacctacaagcagaccaccctcatcgtgtacatcctgtccttcatcggcatggtgatcttcaccttcaccctggacctgcgctacatcatcatcgtgtttgtgactggaggagtgctgggcttcttcatgacaggctacctgcccctgggctttgaatttgctgtggagatcacctacccagagagcgagggcaccagcagcggcctgctgaatgccagcgcccagatcttcggcatcctcttcaccctggcccagggcaagctgaccagtgactatggccccaaggccggcaacatcttcctgtgtgtgtggatgtttattggcatcatcctgacagccctgatcaagagtgacctgcggcggcacaacatcaacatcggcatcaccaacgtggatgtgaaggccatcccagctgacagccccacagaccaggagcccaagacagtgatgctgagcaagcagagcgagagcgccatctag

SEQ ID NO: 152334 - DNA, 2469 bp, Artificial Sequence
  Description of Artificial Sequence: Synthetic coding sequence
atgggctttggaagtgacctgaagaacagccatgaagctgtgctgaagctgcaggactgggagctgcggctgctggagaccgtgaagaagttcatggccctgcgcatcaagagtgacaaggagtatgccagcaccctgcagaacctgtgcaaccaggtggacaaggagagcacagtgcagatgaactacgtgtccaatgtgtccaagtcctggctgctgatgatccagcagacagagcagctgagccgcatcatgaagacccatgctgaggacctgaacagcggccccctgcaccggctgaccatgatgatcaaggacaagcagcaggtgaagaagagctacatcggcgtgcaccagcagattgaagctgagatgatcaaggtgaccaagacagagctggagaagctgaagtgcagctaccggcagctgatcaaggagatgaacagcgccaaggagaagtacaaggaggccctggccaagggcaaggagacagagaaggccaaggagagatatgacaaggccaccatgaagctgcacatgctgcacaaccagtatgtgctggccctgaagggggcccagctgcaccagaaccagtactatgacatcaccctgcccctgctgctggacagcctgcagaagatgcaggaggagatgatcaaggccctgaagggcatctttgatgagtacagccagatcaccagcctggtgacagaggagatcgtgaatgtgcacaaggagatccagatgtctgtggagcagattgaccccagcacagagtacaacaacttcattgatgtgcacaggaccacagctgccaaggagcaggagattgaatttgacaccagcctgctggaggagaatgaaaacctgcaggccaatgagatcatgtggaacaacctgacagctgagagcctgcaggtgatgctgaagaccctggccgaggagctgatgcagacccagcagatgctgctgaacaaggaggaggccgtgctggagctggagaagagaattgaggagagcagcgagacctgtgagaagaagagtgacatcgtgctgctgctgagccagaagcaggccctggaggagctgaagcagagcgtgcagcagctgcgctgcacagaggccaagttcagcgcccagaaggagctgctggagcagaaggtgcaggagaatgatggcaaggagcccccacctgtggtgaactatgaggaggatgcccggtctgtgacctccatggagaggaaggagcggctgagcaagtttgagagcatccgccacagcattgctggcatcatccgcagccccaagagcgccctgggcagcagcgccctgagtgacatgatcagcatcagcgagaagcccctggccgagcaggactggtaccacggggccatcccccgcatcgaggcccaggagctgctgaagaagcagggcgacttcctggtgcgggagagccacggcaagccaggagaatatgtgctgtctgtgtacagtgatggccagaggaggcacttcatcatccagtatgtggacaacatgtacagatttgagggcaccggcttcagcaacatcccccagctgattgaccaccactacaccaccaagcaggtgatcaccaagaagagcggcgtggtgctgctgaaccccatccccaaggacaagaagtggatcctgagccatgaagatgtgatcctgggggagctgctgggcaaaggaaactttggagaggtgtacaagggcaccctgaaggacaagacctctgtggccgtgaagacctgcaaggaggacctgccccaggagctgaagatcaagttcctgcaggaggccaagatcctgaagcagtatgaccaccccaacatcgtgaagctgattggagtgtgcacccagaggcagcctgtgtacatcatcatggagctggtgtctggaggagacttcctgaccttcctgcggaggaagaaggatgagctgaagctgaagcagctggtgaagttcagcctggatgctgctgctggcatgctgtacctggagagcaagaactgcatccaccgggacctggccgccaggaactgcctggtgggggagaacaacgtgctgaagatcagtgactttggcatgagccggcaggaggatggcggcgtgtacagcagcagcggcctgaagcagatccccatcaagtggacagcccctgaggccctgaactacggccgctacagcagcgagagtgatgtgtggagctttggcatcctgctgtgggagaccttcagcctgggcgtgtgcccctacccaggcatgaccaaccagcaggcccgggagcaggtggagcggggctacaggatgtctgccccccagcactgcccagaggacatcagcaagatcatgatgaagtgctgggactacaagccagagaaccggcccaagttcagcgagctgcagaaggagctgaccatcatcaagaggaagctgacctag

SEQ ID NO: 152335 - DNA, 1944 bp, Artificial Sequence
  Description of Artificial Sequence: Synthetic coding sequence
atgaagctgcacatgctgcacaaccagtatgtgctggccctgaagggggcccagctgcaccagaaccagtactatgacatcaccctgcccctgctgctggacagcctgcagaagatgcaggaggagatgatcaaggccctgaagggcatctttgatgagtacagccagatcaccagcctggtgacagaggagatcgtgaatgtgcacaaggagatccagatgtctgtggagcagattgaccccagcacagagtacaacaacttcattgatgtgcacaggaccacagctgccaaggagcaggagattgaatttgacaccagcctgctggaggagaatgaaaacctgcaggccaatgagatcatgtggaacaacctgacagctgagagcctgcaggtgatgctgaagaccctggccgaggagctgatgcagacccagcagatgctgctgaacaaggaggaggccgtgctggagctggagaagagaattgaggagagcagcgagacctgtgagaagaagagtgacatcgtgctgctgctgagccagaagcaggccctggaggagctgaagcagagcgtgcagcagctgcgctgcacagaggccaagttcagcgcccagaaggagctgctggagcagaaggtgcaggagaatgatggcaaggagcccccacctgtggtgaactatgaagaagatgcccggtctgtgacctccatggagaggaaggagcggctgagcaagtttgagagcatccgccacagcattgctggcatcatccgcagccccaagagcgccctgggcagcagcgccctgagtgacatgatcagcatcagcgagaagcccctggccgagcaggactggtaccatggagccatccccagaattgaggcccaggagctgctgaagaagcagggcgacttcctggtgcgggagagccacggcaagccaggagaatatgtgctgtctgtgtacagtgatggccagaggaggcacttcatcatccagtatgtggacaacatgtacagatttgagggcaccggcttcagcaacatcccccagctgattgaccaccactacaccaccaagcaggtgatcaccaagaagtctggagtggtgctgctgaaccccatccccaaggacaagaagtggatcctgagccatgaagatgtgatcctgggggagctgctgggcaagggcaactttggagaggtgtacaagggcaccctgaaggacaagacctctgtggccgtgaagacctgcaaggaggacctgccccaggagctgaagatcaagttcctgcaggaggccaagatcctgaagcagtatgaccaccccaacatcgtgaagctgattggagtgtgcacccagaggcagcctgtgtacatcatcatggagctggtgtctggaggagacttcctgaccttcctgcggaggaagaaggatgagctgaagctgaagcagctggtgaagttcagcctggatgctgctgctggcatgctgtacctggagagcaagaactgcatccaccgggacctggccgccaggaactgcctggtgggagaaaataatgtgctgaagatcagtgactttggcatgagccggcaggaggatggaggagtgtacagcagcagcggcctgaagcagatccccatcaagtggacagcccctgaggccctgaactacggccgctacagcagcgagagtgatgtgtggagctttggcatcctgctgtgggagaccttcagcctgggcgtgtgcccctacccaggcatgaccaaccagcaggcccgggagcaggtggagcggggctacaggatgtctgccccccagcactgcccagaggacatcagcaagatcatgatgaagtgctgggactacaagccagaaaatcggcccaagttcagcgagctgcagaaggagctgaccatcatcaagaggaagctgacctag

SEQ ID NO: 152336 - DNA, 981 bp, Artificial Sequence
  Description of Artificial Sequence: Synthetic coding sequence
atgggctttggaagtgacctgaagaacagccatgaagctgtgctgaagctgcaggactgggagctgcggctgctggagaccgtgaagaagttcatggccctgcgcatcaagagtgacaaggagtatgccagcaccctgcagaacctgtgcaaccaggtggacaaggagagcacagtgcagatgaactacgtgtccaatgtgtccaagtcctggctgctgatgatccagcagacagagcagctgagccgcatcatgaagacccatgctgaggacctgaacagcggccccctgcaccggctgaccatgatgatcaaggacaagcagcaggtgaagaagagctacatcggcgtgcaccagcagattgaagctgagatgatcaaggtgaccaagacagagctggagaagctgaagtgcagctaccggcagctgatcaaggagatgaacagcgccaaggagaagtacaaggaggccctggccaagggcaaggagacagagaaggccaaggagagatatgacaaggccaccatgaagctgcacatgctgcacaaccagtatgtgctggccctgaagggggcccagctgcaccagaaccagtactatgacatcaccctgcccctgctgctggacagcctgcagaagatgcaggaggagatgatcaaggccctgaagggcatctttgatgagtacagccagatcaccagcctggtgacagaggagatcgtgaatgtgcacaaggagatccagatgtctgtggagcagattgaccccagcacagagtacaacaacttcattgatgtgcacaggaccacagctgccaaggagcaggagattgaatttgacaccagcctgctggaggagaatgaaaacctgcaggccaatgagatcatgtggaacaacctgacagctgagagcctgcaggtgatgaaggagcggcggggctaccccaacctgaacctcttcgtcatccagctgctggagtag

SEQ ID NO: 152337 - DNA, 3855 bp, Artificial Sequence
  Description of Artificial Sequence: Synthetic coding sequence
atgcacgtgttcatcgtgggcatgagcctgagctctgtgaccctggccagcgccctgcaggtgcggggggaggccctgtctgaggaggagatctggagcctgctcttcctggccgctgagcagctgctggaggacctgagaaatgacagcagtgactatgtggtgtgcccctggagcgccctgctgtctgctgctggcagcctgtccttccagggccgggtgagccacattgaagctgcccccttcaaggcccctgagctgctgcagggccagagtgaagatgagcagccagatgccagccagcccctgcagctgtgtgagcccctgcacagcatcctgctgaccatgtgtgaggaccagccccaccggcgctgcaccctgcagagcgtgctggaggcctgccgggtgcatgagaaggaggtgtctgtgtacccagccccagctggcctgcacatccggcggctggtgggcctggtgctgggcaccatcagcgaggtggagaagagggtggtggaggagagcagctctgtgcagcagaacagaagctacctgctgaggaagaggctgcggggcaccagcagcgagagccctgctgcccaggccccagaatgtctgcacccctgccgggtgtctgagaggagcacagagacccagagcagccctgagccccactggagcaccctgacccacagccactgcagcctgctggtgaacagagccctgcccggggctgacccccaggaccagcaggccggccgccgcctgagcagcggctctgtgcacagcgctgctgacagctcctggcccaccacccccagccagaggggcttcctgcagaggaggagcaagttcagcaggcctgagttcatcctgctggccggggaggcccccatgaccctgcacctgcccggctctgtggtgaccaagaagggcaagagctacctggccctgcgggacctgtgtgtggtgctgctgaatggccagcacctggaggtgaagtgtgatgtggagagcacagtgggcgctgtgttcaatgctgtgaccagctttgccaacctggaggagctgacctacttcggcctggcctacatgaagagcaaggagttcttcttcctggacagcgagacccggctgtgcaagatcgcccctgagggctggagggagcagccccagaagacctccatgaacaccttcaccctcttcctgcgcatcaagttctttgtgagccactacggcctgctgcagcacagcctgaccaggcaccagttctacctgcagctgaggaaggacatcctggaggagcggctgtactgcaatgaggagatcctgctgcagctgggcgtgctggccctgcaggccgagtttggaaactaccccaaggaggtggagagcaagccctacttccacgtggaggactacatcccagccagcctgattgaaagaatgacagccctgcgggtgcaggtggaggtgtctgagatgcaccggctgagcagcgccctgtggggagaagatgctgagctgaagttcctgcgggtgacccagcagctgcctgaatatggagtgctggtgcaccaggtgttttctgagaagaggaggcctgaggaggagatggccctgggcatctgtgccaagggcgtcatcgtgtatgaggtgaagaacaacagccgcatcgccatgctgcgcttccagtggagggagaccgggaagatcagcacctaccagaagaagttcaccatcaccagctctgtgacaggcaagaagcacacctttgtgacagattctgccaagaccagcaagtacctgctggacctgtgcagcgcccagcacggcttcaatgcccagatgggcagcggccagcccagccacgtgctgtttgaccatgacaagtttgtgcagatggccaacctgagccctgcccaccaggcccggagcaagcccctcatctggatccagaggctgagctgcagtgaaaatgagctgtttgtgtcccggctgcagggcgccgccggcggcctgctgagcacctccatggacaacttcaacgtggatggcagcaaggaggccggggctgagggcatcggccgcagcccctgcaccggccgggagcagctgaagagcgcctgtgtgatccagaagcccatgacctgggacagcctgagcggcccccctgtgcagagcatgcacgccggcagcaagaacaacagaaggaagagcttcatcgccgagcccggccgggagatcgtgcgggtgaccctgaagagggacccccaccggggctttggatttgtgatcaatgaaggagagtacagcggccaggccgaccccggcatcttcatcagcagcatcatccctgggggccctgctgagaaggccaagaccatcaagccaggcggccagatcctggccctgaaccacatcagcctggagggcttcaccttcaacatggctgtgaggatgatccagaacagcccagacaacatcgagctgatcatcagccagagcaagggcgtgggcggcaacaacccagatgaggagaagaacagcacagccaacagcggcgtgagcagcacagacatcctgagctttggctaccagggcagcctgctgagccacacccaggaccaggacaggaacacagaggagctggacatggccggcgtgcagagcctggtgccccggctgcggcaccagctgtccttcctgcccctgaagggagctggcagcagctgcccccccagccccccagagatctctgctggggagatctactttgtggagctggtgaaggaggatggcaccctgggcttctctgtgactggaggcatcaacacctctgtgccctatggaggcatctacgtgaagagcatcgtgcctgggggccctgctgccaaggagggccagatcctgcagggcgaccggctgctgcaggtggatggagtcatcctgtgtggcctgacccacaagcaggccgtgcagtgcctgaccggccctggccaggtggcccggctggtgctggagcggcgggtgcccaggagcacccagcagtgccccagcgccaatgacagcatgggagatgagaggacagctgtgtccctggtgacagccctgcccggccggcccagcagctgtgtgtctgtgacagatggccccaagtttgaggtgaagctgaagaagaatgccaacggcctgggcttctcctttgtgcagatggagaaggagagctgcagccacctgaagagtgacctggtgcgcatcaagaggctcttccctggccagcctgcagaagaaaatggagccatcgctgctggggacatcatcctggccgtgaatggccgcagcacagagggcctcatcttccaggaggtgctgcacctgctgcggggggccccccaggaggtgaccctgctgctgtgcaggcctcctcctggggccctgcctgagctggagcaggagtggcagaccccagagctgtctgctgacaaggagttcacccgggccacctgcacagacagctgcaccagccccatcctggaccaggaggacagctggagggacagcgccagcccagatgctggggagggcctgggcctgcggcctgagagcagccagaaggccatccgggaggcccagtggggccagaaccgggagcggccctgggccagcagcctgacccacagccctgagagccacccccacctgtgcaagctgcaccaggagagagatgagagcaccctggccaccagcctggagaaggatgtgcggcagaactgctacagcgtgtgtgacatcatgaggctgggccgctacagcttcagcagccccctgacccggctgagcacagacatcttctag

SEQ ID NO: 152338 - DNA, 3930 bp, Artificial Sequence
  Description of Artificial Sequence: Synthetic coding sequence
atgcagcccctgaccaaggatgctggcatgagcctgagctctgtgaccctggccagcgccctgcaggtgcggggggaggccctgtctgaggaggagatctggagcctgctcttcctggccgctgagcagctgctggaggacctgagaaatgacagcagtgactatgtggtgtgcccctggagcgccctgctgtctgctgctggcagcctgtccttccagggccgggtgagccacattgaagctgcccccttcaaggcccctgagctgctgcagggccagagtgaagatgagcagccagatgccagccagatgcacgtgtacagcctgggcatgaccctgtactggagcgctggcttccacgtgcccccccaccagcccctgcagctgtgtgagcccctgcacagcatcctgctgaccatgtgtgaggaccagccccaccggcgctgcaccctgcagagcgtgctggaggcctgccgggtgcatgagaaggaggtgtctgtgtacccagccccagctggcctgcacatccggcggctggtgggcctggtgctgggcaccatcagcgaggtggagaagagggtggtggaggagagcagctctgtgcagcagaacagaagctacctgctgaggaagaggctgcggggcaccagcagcgagagccctgctgcccaggccccagaatgtctgcacccctgccgggtgtctgagaggagcacagagacccagagcagccctgagccccactggagcaccctgacccacagccactgcagcctgctggtgaacagagccctgcccggggctgacccccaggaccagcaggccggccgccgcctgagcagcggctctgtgcacagcgctgctgacagctcctggcccaccacccccagccagaggggcttcctgcagaggaggagcaagttcagcaggcctgagttcatcctgctggccggggaggcccccatgaccctgcacctgcccggctctgtggtgaccaagaagggcaagagctacctggccctgcgggacctgtgtgtggtgctgctgaatggccagcacctggaggtgaagtgtgatgtggagagcacagtgggcgctgtgttcaatgctgtgaccagctttgccaacctggaggagctgacctacttcggcctggcctacatgaagagcaaggagttcttcttcctggacagcgagacccggctgtgcaagatcgcccctgagggctggagggagcagccccagaagacctccatgaacaccttcaccctcttcctgcgcatcaagttctttgtgagccactacggcctgctgcagcacagcctgaccaggcaccagttctacctgcagctgaggaaggacatcctggaggagcggctgtactgcaatgaggagatcctgctgcagctgggcgtgctggccctgcaggccgagtttggaaactaccccaaggagcaggtggagagcaagccctacttccacgtggaggactacatcccagccagcctcatcgagaggatgacagccctgcgggtgcaggtggaggtgtctgagatgcaccggctgagcagcgccctgtggggagaagatgctgagctgaagttcctgcgggtgacccagcagctgcctgaatatggagtgctggtgcaccaggtgttcagcgagaagagaagacctgaggaggagatggccctgggcatctgtgccaagggcgtgattgtgtatgaggtgaagaacaacagcagaattgccatgctgcgcttccagtggagggagaccgggaagatcagcacctaccagaagaagttcaccatcaccagctctgtgacaggcaagaagcacacctttgtgacagacagcgccaagaccagcaagtacctgctggacctgtgcagcgcccagcacggcttcaatgcccagatgggcagcggccagcccagccacgtgctgtttgaccatgacaagtttgtgcagatggccaacctgagccctgcccaccaggcccggagcaagcccctcatctggatccagaggctgagctgcagtgaaaatgagctgtttgtgtcccggctgcagggcgctgctgggggcctgctgagcacctccatggacaacttcaacgtggatggcagcaaggaggccggggctgagggcatcggccgcagcccctgcaccggccgggagcagctgaagagcgcctgcgtcatccagaagcccatgacctgggacagcctgagcggcccccctgtgcagagcatgcatgctggcagcaagaacaacagaaggaagagcttcatcgccgagcccggccgggagatcgtgcgggtgaccctgaagagggacccccaccggggcttcggcttcgtcatcaatgaaggagagtacagcggccaggccgaccccggcatcttcatcagcagcatcatccctgggggccctgctgagaaggccaagaccatcaagccaggcggccagatcctggccctgaaccacatcagcctggagggcttcaccttcaacatggctgtgaggatgatccagaacagcccagacaacatcgagctgatcatcagccagagcaaaggagtgggcggcaacaacccagatgaggagaagaacagcacagccaacagcggcgtgagcagcacagacatcctgagctttggctaccagggcagcctgctgagccacacccaggaccaggacaggaacacagaggagctggacatggccggcgtgcagagcctggtgccccggctgcggcaccagctgtccttcctgcccctgaagggggccggcagcagctgcccccccagccccccagagatctctgctggggagatctactttgtggagctggtgaaggaggatggcaccctgggcttctctgtgactggaggcatcaacacctctgtgccctacggcggcatctacgtgaagagcatcgtgcctgggggccctgctgccaaggagggccagatcctgcagggcgaccggctgctgcaggtggatggagtcatcctgtgtggcctgacccacaagcaggccgtgcagtgcctgactggacctggccaggtggcccggctggtgctggagaggagagtgcccaggagcacccagcagtgccccagcgccaatgacagcatgggagatgagaggacagctgtgtccctggtgacagccctgcccggccggcccagcagctgtgtgtctgtgacagatggccccaagtttgaggtgaagctgaagaagaatgccaacggcctgggcttctcctttgtgcagatggagaaggagagctgcagccacctgaagagtgacctggtgcgcatcaagaggctcttccctggccagcctgctgaggagaatggagccatcgccgccggggacatcatcctggccgtgaatggccgcagcacagagggcctcatcttccaggaggtgctgcacctgctgcggggggccccccaggaggtgaccctgctgctgtgccggcccccacctggggccctgcctgagctggagcaggagtggcagaccccagagctgtctgctgacaaggagttcacccgggccacctgcacagacagctgcaccagccccatcctggaccaggaggacagctggagggacagcgccagcccagatgctggggagggcctgggcctgcggcctgagagcagccagaaggccatccgggaggcccagtggggccagaaccgggagcggccctgggccagcagcctgacccacagccctgagagccacccccacctgtgcaagctgcaccaggagagagatgagagcaccctggccaccagcctggagaaggatgtgcggcagaactgctacagcgtgtgtgacatcatgaggctgggccgctacagcttcagcagccccctgacccggctgagcacagacatcttctag

SEQ ID NO: 152339 - DNA, 3834 bp, Artificial Sequence
  Description of Artificial Sequence: Synthetic coding sequence
atgagcctgagctctgtgaccctggccagcgccctgcaggtgcggggggaggccctgtctgaggaggagatctggagcctgctcttcctggccgctgagcagctgctggaggacctgagaaatgacagcagtgactatgtggtgtgcccctggagcgccctgctgtctgctgctggcagcctgtccttccagggccgggtgagccacatcgaggccgcccccttcaaggcccctgagctgctgcagggccagagtgaagatgagcagccagatgccagccagcccctgcagctgtgtgagcccctgcacagcatcctgctgaccatgtgtgaggaccagccccaccggcgctgcaccctgcagagcgtgctggaggcctgccgggtgcatgagaaggaggtgtctgtgtacccagccccagctggcctgcacatccggcggctggtgggcctggtgctgggcaccatcagcgaggtggagaagagggtggtggaggagagcagctctgtgcagcagaacagaagctacctgctgaggaagaggctgcggggcaccagcagcgagagccctgctgcccaggcccctgagtgcctgcacccctgccgggtgtctgagaggagcacagagacccagagcagccctgagccccactggagcaccctgacccacagccactgcagcctgctggtgaacagagccctgcctggagctgacccccaggaccagcaggccggccggcggctgagcagcggctctgtgcacagcgctgctgacagctcctggcccaccacccccagccagaggggcttcctgcagaggaggagcaagttcagcaggcctgagttcatcctgctggccggggaggcccccatgaccctgcacctgcccggctctgtggtgaccaagaagggcaagagctacctggccctgcgggacctgtgtgtggtgctgctgaatggccagcacctggaggtgaagtgtgatgtggagagcacagtgggcgctgtgttcaatgctgtgaccagctttgccaacctggaggagctgacctacttcggcctggcctacatgaagagcaaggagttcttcttcctggacagcgagacccggctgtgcaagatcgcccctgagggctggagggagcagccccagaagacctccatgaacaccttcaccctcttcctgcgcatcaagttctttgtgagccactacggcctgctgcagcacagcctgaccaggcaccagttctacctgcagctgaggaaggacatcctggaggagcggctgtactgcaatgaggagatcctgctgcagctgggcgtgctggccctgcaggccgagtttggaaactaccccaaggaggtggagagcaagccctacttccacgtggaggactacatcccagccagcctcatcgagaggatgacagccctgcgggtgcaggtggaggtgtctgagatgcaccggctgagcagcgccctgtggggagaagatgctgagctgaagttcctgcgggtgacccagcagctgcctgaatatggagtgctggtgcaccaggtgttcagcgagaagagaagacctgaggaggagatggccctgggcatctgtgccaagggcgtgattgtgtatgaggtgaagaacaacagcagaattgccatgctgcgcttccagtggagggagaccgggaagatcagcacctaccagaagaagttcaccatcaccagctctgtgacaggcaagaagcacacctttgtgacagacagcgccaagaccagcaagtacctgctggacctgtgcagcgcccagcacggcttcaatgcccagatgggcagcggccagcccagccacgtgctgtttgaccatgacaagtttgtgcagatggccaacctgagccctgcccaccaggcccggagcaagcccctcatctggatccagaggctgagctgcagtgaaaatgagctgtttgtgtcccggctgcagggcgctgctgggggcctgctgagcacctccatggacaacttcaacgtggatggcagcaaggaggccggggctgagggcatcggccgcagcccctgcaccggccgggagcagctgaagagcgcctgcgtcatccagaagcccatgacctgggacagcctgagcggcccccctgtgcagagcatgcatgctggcagcaagaacaacagaaggaagagcttcatcgccgagcccggccgggagatcgtgcgggtgaccctgaagagggacccccaccggggcttcggcttcgtcatcaatgaaggagagtacagcggccaggccgaccccggcatcttcatcagcagcatcatccctgggggccctgctgagaaggccaagaccatcaagccaggcggccagatcctggccctgaaccacatcagcctggagggcttcaccttcaacatggctgtgaggatgatccagaacagcccagacaacatcgagctgatcatcagccagagcaaaggagtgggcggcaacaacccagatgaggagaagaacagcacagccaacagcggcgtgagcagcacagacatcctgagctttggctaccagggcagcctgctgagccacacccaggaccaggacaggaacacagaggagctggacatggccggcgtgcagagcctggtgccccggctgcggcaccagctgtccttcctgcccctgaagggggccggcagcagctgcccccccagccccccagagatctctgctggggagatctactttgtggagctggtgaaggaggatggcaccctgggcttctctgtgactggaggcatcaacacctctgtgccctacggcggcatctacgtgaagagcatcgtgcctgggggccctgctgccaaggagggccagatcctgcagggcgaccggctgctgcaggtggatggagtcatcctgtgtggcctgacccacaagcaggccgtgcagtgcctgactggacctggccaggtggcccggctggtgctggagaggagagtgcccaggagcacccagcagtgccccagcgccaatgacagcatgggagatgagaggacagctgtgtccctggtgacagccctgcccggccggcccagcagctgtgtgtctgtgacagatggccccaagtttgaggtgaagctgaagaagaatgccaacggcctgggcttctcctttgtgcagatggagaaggagagctgcagccacctgaagagtgacctggtgcgcatcaagaggctcttccctggccagcctgctgaggagaatggagccatcgccgccggggacatcatcctggccgtgaatggccgcagcacagagggcctcatcttccaggaggtgctgcacctgctgcggggggccccccaggaggtgaccctgctgctgtgccggcccccacctggggccctgcctgagctggagcaggagtggcagaccccagagctgtctgctgacaaggagttcacccgggccacctgcacagacagctgcaccagccccatcctggaccaggaggacagctggagggacagcgccagcccagatgctggggagggcctgggcctgcggcctgagagcagccagaaggccatccgggaggcccagtggggccagaaccgggagcggccctgggccagcagcctgacccacagccctgagagccacccccacctgtgcaagctgcaccaggagagagatgagagcaccctggccaccagcctggagaaggatgtgcggcagaactgctacagcgtgtgtgacatcatgaggctgggccgctacagcttcagcagccccctgacccggctgagcacagacatcttctag

SEQ ID NO: 152340 - DNA, 786 bp, Artificial Sequence
  Description of Artificial Sequence: Synthetic coding sequence
atgggagatgagaggacagctgtgtccctggtgacagccctgcccggccggcccagcagctgtgtgtctgtgacagatggccccaagtttgaggtgaagctgaagaagaatgccaacggcctgggcttctcctttgtgcagatggagaaggagagctgcagccacctgaagagtgacctggtgcgcatcaagaggctcttccctggccagcctgctgaggagaatggagccatcgccgccggggacatcatcctggccgtgaatggccgcagcacagagggcctcatcttccaggaggtgctgcacctgctgcggggggccccccaggaggtgaccctgctgctgtgccggcccccacctggggccctgcctgagctggagcaggagtggcagaccccagagctgtctgctgacaaggagttcacccgggccacctgcacagacagctgcaccagccccatcctggaccaggaggacagctggagggacagcgccagcccagatgctggggagggcctgggcctgcggcctgagagcagccagaaggccatccgggaggcccagtggggccagaaccgggagcggccctgggccagcagcctgacccacagccctgagagccacccccacctgtgcaagctgcaccaggagagagatgagagcaccctggccaccagcctggagaaggatgtgcggcagaactgctacagcgtgtgtgacatcatgaggctgggccgctacagcttcagcagccccctgacccggctgagcacagacatcttctag

SEQ ID NO: 152341 - DNA, 3936 bp, Artificial Sequence
  Description of Artificial Sequence: Synthetic coding sequence
ttcagcagccacaggaccaagagcagcggctggcccccaccttctggcacctggggcctgagccaggtgcccccctacggctgggagatgacagccaacagagatggccgggactacttcatcaaccacatgacccaggccatcccctttgatgacccccggctggagagctgccagatcatccccccagcccccaggaaggtggagatgagaagagatcctgtgctgggcttcggctttgtggccggcagcgagaagcctgtggtggtgcgctctgtgaccccaggcggccccagcgagggcaagctgatccctggggaccagatcgtgatgatcaatgatgagcctgtgtctgctgccccccgggagagggtcatcgacctggtgcgcagctgcaaggagagcatcctgctgaccgtcatccagccctaccccagccccaagagcgccttcatctctgctgccaagaaggcccggctgaagagcaaccctgtgaaggtgcgcttcagcgaggaggtgatcatcaatggccaggtgtctgagaccgtgaaggacaacagcctgctcttcatgcccaacgtgctgaaggtgtacctggagaatggccagaccaagagcttccgctttgactgcagcaccagcatcaaggatgtgatcctgaccctgcaggagaagctgagcatcaagggcatcgagcacttcagcctgatgctggagcagaggacagagggcgccggcaccaagctgctgctgctgcacgagcaggagaccctgacccaggtgacccagaggcccagcagccacaagatgcgctgcctcttccgcatcagctttgtgcccaaggaccccatcgacctgctgcggcgggaccctgtggcctttgagtacctgtatgtgcagagctgcaatgatgtggtgcaggagcgcttcggccctgagctgaagtatgacatcgccctgcggctggccgccctgcagatgtacatcgccaccgtgaccaccaagcagacccagaagatcagcctgaagtacatcgagaaggagtggggcctggagaccttcctgcccagcgctgtgctgcagagcatgaaggagaagaacatcaagaaggccctgagccacctggtgaaggccaaccagaacctggtgcccccaggcaagaagctgagcgccctgcaggccaaggtgcactacctgaagttcctgagtgacctgcggctgtatggaggccgggtcttcaaggccaccctggtgcaggccgagaagaggtctgaggtgaccctgctggtgggccccaggtatggcatcagccacgtgatcaacaccaagaccaacctggtggccctgctggccgacttcagccacgtgaacagaattgagatgttttctgaggaggagagcctggtgcgggtggagctgcacgtgctggatgtgaagcccatcaccctgctgatggagagcagtgatgccatgaacctggcctgcctgacagctggctactaccgcctgctggtggacagccgccgcagcatcttcaacatggccaacaagaagaacacagccacccaggagactggacctgagaacaagggcaagcacaacctgctgggccctgactggaactgcatcccccagatgaccaccttcatcggggagggggagcaggaggcccagatcacctacatcgacagcaagcagaagacagtggagatcacagacagcaccatgtgccccaaggagcaccgccacctgtacatcgacaatgcctacagcagtgatggcctgaaccagcagctgagccagcccggggaggccccctgtgaggccgactaccgcagcctggcccagaggagcctgctgaccctgagcggccctgagaccctgaagaaggcccaggagagccccaggggggccaaggtgtccttcatctttggagactttgccctggatgatggcatcagcccccccaccctgggctatgagaccctgctggatgagggccctgagatgctggagaagcagaggaacctgtacatcggcagcgccaatgacatgaagggcctggacctgaccccagaggccgagggcatccagtttgtggagaacagcgtgtatgccaacattggagatgtgaagagcttccaggccgctgagggcatcgaggagcccctgctgcatgacatctgctacgccgagaacacagatgatgctgaagatgaagatgaggtgtcctgtgaggaggacctggtggtgggggagatgaaccagcctgccatcctgaacctgagcggcagcagtgatgacatcatcgacctgaccagcctgcccccaccagaaggagatgacaatgaagatgacttcctgctgcggagcctgaacatggccatcgccgcccctcctcctggcttccgggacagcagtgatgaggaggacagccagagccaggccgccagcttccctgaggacaaggagaagggcagcagcctgcagaatgatgagatccctgtgtccctgattgatgctgtgcccaccagcgctgagggcaaatgtgagaagggcctggacaatgctgtggtgtccaccctgggcgccctggaggccctgtctgtgtctgaggagcagcagaccagtgacaacagcggcgtggccatcctgcgggcctacagccctgagagcagcagtgacagcggaaatgagaccaacagcagcgagatgacagagagcagcgagctggccacagcccagaagcagagcgagaacctgagcaggatgttcctggccacccatgagggctaccaccccctggccgaggagcagacagagttccctgccagcaagaccccagctgggggcctgccccccaagagcagccacgccctggccgcccggcctgccacagacctgccccccaaggtggtgcccagcaagcagctgctgcacagcgaccacatggagatggagcctgagaccatggagaccaagtctgtgacagactacttcagcaagctgcacatgggctctgtggcctacagctgcaccagcaagaggaagagcaagctggctgatggagagggcaaggccccacccaacggcaacaccaccgggaagaagcagcagggcaccaagacagctgagatggaggaggaggccagcggcaagtttggcaccgtgagcagccgggacagccagcacctgagcaccttcaacctggagaggacagccttcaggaaggacagccagcgctggtacgtggccacagagggcggcatggccgagaagagcggcctggaggccgccaccgggaagaccttcccccgggccagcggcctgggcgcccgggaggccgagggcaaggaggagggcgccccagatggagagaccagtgatggcagcggcctgggccagggcgaccgcttcctgacagatgtgacctgtgccagcagcgccaaggacctggacaacccagaagatgctgacagcagcacctgtgaccaccccagcaagctgcctgaggctgatgaatctgtggcccggctgtgtgactaccacctggccaagaggatgagcagcctgcagagcgagggccacttcagcctgcagagcagccagggcagctctgtggatgctggctgcggcaccggcagcagcggcagcgcctgtgccacccctgtggagagccccctgtgccccagcctgggcaagcacctgatcccagatgccagcgggaaaggagtgaactacatccccagcgaggagcgggcccctggcctgcccaaccacggggccaccttcaaggagctgcacccccagacagagggcatgtgccccaggatgacagtgcctgccctgcacacagccatcaacacagagcccctgtttggcaccctgagagatggctgccaccggctgcccaagatcaaggagaccaccgtgtag

SEQ ID NO: 152342 - DNA, 3969 bp, Artificial Sequence
  Description of Artificial Sequence: Synthetic coding sequence
atggatgtgttctcctttgtgaagatcgccaagctgagcagccacaggaccaagagcagcggctggcccccacccagcggcacctggggcctgagccaggtgcccccctacggctgggagatgacagccaacagagatggccgggactacttcatcaaccacatgacccaggccatcccctttgatgacccccggctggagagctgccagatcatccccccagcccccaggaaggtggagatgaggcgggaccctgtgctgggctttggatttgtggccggcagcgagaagcctgtggtggtgcgctctgtgacccctgggggccccagcgagggcaagctgatccctggggaccagatcgtgatgatcaatgatgagcctgtgtctgctgccccccgggagcgggtgattgacctggtgcgcagctgcaaggagagcatcctgctgaccgtcatccagccctaccccagccccaagagcgccttcatctctgctgccaagaaggcccggctgaagagcaaccctgtgaaggtgcgcttcagcgaggaggtgatcatcaatggccaggtgtctgaaacagtgaaggacaacagcctgctcttcatgcccaacgtgctgaaggtgtacctggagaatggccagaccaagagcttccgctttgactgcagcaccagcatcaaggatgtgatcctgaccctgcaggagaagctgagcatcaagggcatcgagcacttcagcctgatgctggagcagaggacagaaggagctggcaccaagctgctgctgctgcacgagcaggagaccctgacccaggtgacccagaggcccagcagccacaagatgcgctgcctcttccgcatcagctttgtgcccaaggaccccatcgacctgctgcggcgggaccctgtggcctttgagtacctgtatgtgcagagctgcaatgatgtggtgcaggagagatttggacctgagctgaagtatgacatcgccctgcggctggccgccctgcagatgtacatcgccaccgtgaccaccaagcagacccagaagatcagcctgaagtacatcgagaaggagtggggcctggagaccttcctgcccagcgctgtgctgcagagcatgaaggagaagaacatcaagaaggccctgagccacctggtgaaggccaaccagaacctggtgcccccaggcaagaagctgagcgccctgcaggccaaggtgcactacctgaagttcctgagtgacctgcggctgtatggaggccgggtcttcaaggccaccctggtgcaggccgagaagaggtctgaggtgaccctgctggtgggccccaggtatggcatcagccacgtgatcaacaccaagaccaacctggtggccctgctggccgacttcagccacgtgaaccgcatcgagatgttcagcgaggaggagagcctggtgcgggtggagctgcacgtgctggatgtgaagcccatcaccctgctgatggagagcagtgatgccatgaacctggcctgcctgacagctggctactaccgcctgctggtggacagcagaagaagcatcttcaacatggccaacaagaagaacacagccacccaggagaccggcccagaaaataaaggcaagcacaacctgctgggccctgactggaactgcatcccccagatgaccaccttcatcggggagggggagcaggaggcccagatcacctacatcgacagcaagcagaagacagtggagatcacagacagcaccatgtgccccaaggagcaccgccacctgtacatcgacaatgcctacagcagtgatggcctgaaccagcagctgagccagcctggagaggccccctgtgaggccgactaccgcagcctggcccagaggagcctgctgaccctgagcggccctgagaccctgaagaaggcccaggagagccccaggggggccaaggtgtccttcatctttggagactttgccctggatgatggcatcagcccccccaccctgggctatgagaccctgctggatgagggccctgagatgctggagaagcagaggaacctgtacatcggcagcgccaatgacatgaagggcctggacctgaccccagaggccgagggcatccagtttgtggagaacagcgtgtatgccaacattggagatgtgaagagcttccaggccgctgagggcatcgaggagcccctgctgcatgacatctgctacgcagaaaatacagatgatgctgaagatgaagatgaggtgtcctgtgaggaggacctggtggtgggggagatgaaccagcctgccatcctgaacctgagcggcagcagtgatgacatcatcgacctgaccagcctgcccccaccagaaggagatgacaatgaagatgacttcctgctgcggagcctgaacatggccatcgccgcccctcctcctggcttccgggacagcagtgatgaggaggacagccagagccaggccgccagcttccctgaggacaaggagaagggcagcagcctgcagaatgatgagatccctgtgtccctgattgatgctgtgcccaccagcgctgagggcaaatgtgagaagggcctggacaatgctgtggtgtccaccctgggcgccctggaggccctgtctgtgtctgaggagcagcagaccagtgacaacagcggcgtggccatcctgcgggcctacagccctgagagcagcagtgacagcggaaatgagaccaacagcagcgagatgacagagagcagcgagctggccacagcccagaagcagagcgagaacctgagcaggatgttcctggccacccatgagggctaccaccccctggccgaggagcagacagagttccctgccagcaagaccccagctgggggcctgccccccaagagcagccacgccctggccgcccggcctgccacagacctgccccccaaggtggtgcccagcaagcagctgctgcacagcgaccacatggagatggagcctgagaccatggagaccaagtctgtgacagactacttcagcaagctgcacatgggctctgtggcctacagctgcaccagcaagaggaagagcaagctggctgatggagagggcaaggcccccccaaatggaaacaccaccgggaagaagcagcagggcaccaagacagctgagatggaggaggaggccagcggcaagtttggaacagtgagcagccgggacagccagcacctgagcaccttcaacctggagaggacagccttcaggaaggacagccagcgctggtacgtggccacagaaggaggcatggccgagaagagcggcctggaggccgccaccgggaagaccttcccccgggccagcggcctgggcgcccgggaggccgagggcaaggaggagggcgccccagatggagagaccagtgatggcagcggcctgggccagggcgaccgcttcctgacagatgtgacctgtgccagcagcgccaaggacctggacaacccagaagatgctgacagcagcacctgtgaccaccccagcaagctgcctgaggctgatgagagcgtggcccggctgtgtgactaccacctggccaagaggatgagcagcctgcagagcgagggccacttcagcctgcagagcagccagggcagctctgtggatgctggctgcggcaccggcagcagcggcagcgcctgtgccacccctgtggagagccccctgtgccccagcctgggcaagcacctgatcccagatgccagcggcaagggcgtgaactacatccccagcgaggagcgggcccctggcctgcccaaccacggggccaccttcaaggagctgcacccccagacagagggcatgtgccccaggatgacagtgcctgccctgcacacagccatcaacacagagcccctgtttggcaccctgagagatggctgccaccggctgcccaagatcaaggagaccaccgtgtag

SEQ ID NO: 152343 - DNA, 3942 bp, Artificial Sequence
  Description of Artificial Sequence: Synthetic coding sequence
aagagccacagcccccacaggaccaagagcagcggctggcccccaccttctggcacctggggcctgagccaggtgcccccctacggctgggagatgacagccaacagagatggccgggactacttcatcaaccacatgacccaggccatcccctttgatgacccccggctggagagctgccagatcatccccccagcccccaggaaggtggagatgagaagagatcctgtgctgggcttcggctttgtggccggcagcgagaagcctgtggtggtgcgctctgtgaccccaggcggccccagcgagggcaagctgatccctggggaccagatcgtgatgatcaatgatgagcctgtgtctgctgccccccgggagagggtcatcgacctggtgcgcagctgcaaggagagcatcctgctgaccgtcatccagccctaccccagccccaagagcgccttcatctctgctgccaagaaggcccggctgaagagcaaccctgtgaaggtgcgcttcagcgaggaggtgatcatcaatggccaggtgtctgagaccgtgaaggacaacagcctgctcttcatgcccaacgtgctgaaggtgtacctggagaatggccagaccaagagcttccgctttgactgcagcaccagcatcaaggatgtgatcctgaccctgcaggagaagctgagcatcaagggcatcgagcacttcagcctgatgctggagcagaggacagagggcgccggcaccaagctgctgctgctgcacgagcaggagaccctgacccaggtgacccagaggcccagcagccacaagatgcgctgcctcttccgcatcagctttgtgcccaaggaccccatcgacctgctgcggcgggaccctgtggcctttgagtacctgtatgtgcagagctgcaatgatgtggtgcaggagcgcttcggccctgagctgaagtatgacatcgccctgcggctggccgccctgcagatgtacatcgccaccgtgaccaccaagcagacccagaagatcagcctgaagtacatcgagaaggagtggggcctggagaccttcctgcccagcgctgtgctgcagagcatgaaggagaagaacatcaagaaggccctgagccacctggtgaaggccaaccagaacctggtgcccccaggcaagaagctgagcgccctgcaggccaaggtgcactacctgaagttcctgagtgacctgcggctgtatggaggccgggtcttcaaggccaccctggtgcaggccgagaagaggtctgaggtgaccctgctggtgggccccaggtatggcatcagccacgtgatcaacaccaagaccaacctggtggccctgctggccgacttcagccacgtgaacagaattgagatgttttctgaggaggagagcctggtgcgggtggagctgcacgtgctggatgtgaagcccatcaccctgctgatggagagcagtgatgccatgaacctggcctgcctgacagctggctactaccgcctgctggtggacagccgccgcagcatcttcaacatggccaacaagaagaacacagccacccaggagactggacctgagaacaagggcaagcacaacctgctgggccctgactggaactgcatcccccagatgaccaccttcatcggggagggggagcaggaggcccagatcacctacatcgacagcaagcagaagacagtggagatcacagacagcaccatgtgccccaaggagcaccgccacctgtacatcgacaatgcctacagcagtgatggcctgaaccagcagctgagccagcccggggaggccccctgtgaggccgactaccgcagcctggcccagaggagcctgctgaccctgagcggccctgagaccctgaagaaggcccaggagagccccaggggggccaaggtgtccttcatctttggagactttgccctggatgatggcatcagcccccccaccctgggctatgagaccctgctggatgagggccctgagatgctggagaagcagaggaacctgtacatcggcagcgccaatgacatgaagggcctggacctgaccccagaggccgagggcatccagtttgtggagaacagcgtgtatgccaacattggagatgtgaagagcttccaggccgctgagggcatcgaggagcccctgctgcatgacatctgctacgccgagaacacagatgatgctgaagatgaagatgaggtgtcctgtgaggaggacctggtggtgggggagatgaaccagcctgccatcctgaacctgagcggcagcagtgatgacatcatcgacctgaccagcctgcccccaccagaaggagatgacaatgaagatgacttcctgctgcggagcctgaacatggccatcgccgcccctcctcctggcttccgggacagcagtgatgaggaggacagccagagccaggccgccagcttccctgaggacaaggagaagggcagcagcctgcagaatgatgagatccctgtgtccctgattgatgctgtgcccaccagcgctgagggcaaatgtgagaagggcctggacaatgctgtggtgtccaccctgggcgccctggaggccctgtctgtgtctgaggagcagcagaccagtgacaacagcggcgtggccatcctgcgggcctacagccctgagagcagcagtgacagcggaaatgagaccaacagcagcgagatgacagagagcagcgagctggccacagcccagaagcagagcgagaacctgagcaggatgttcctggccacccatgagggctaccaccccctggccgaggagcagacagagttccctgccagcaagaccccagctgggggcctgccccccaagagcagccacgccctggccgcccggcctgccacagacctgccccccaaggtggtgcccagcaagcagctgctgcacagcgaccacatggagatggagcctgagaccatggagaccaagtctgtgacagactacttcagcaagctgcacatgggctctgtggcctacagctgcaccagcaagaggaagagcaagctggctgatggagagggcaaggccccacccaacggcaacaccaccgggaagaagcagcagggcaccaagacagctgagatggaggaggaggccagcggcaagtttggcaccgtgagcagccgggacagccagcacctgagcaccttcaacctggagaggacagccttcaggaaggacagccagcgctggtacgtggccacagagggcggcatggccgagaagagcggcctggaggccgccaccgggaagaccttcccccgggccagcggcctgggcgcccgggaggccgagggcaaggaggagggcgccccagatggagagaccagtgatggcagcggcctgggccagggcgaccgcttcctgacagatgtgacctgtgccagcagcgccaaggacctggacaacccagaagatgctgacagcagcacctgtgaccaccccagcaagctgcctgaggctgatgaatctgtggcccggctgtgtgactaccacctggccaagaggatgagcagcctgcagagcgagggccacttcagcctgcagagcagccagggcagctctgtggatgctggctgcggcaccggcagcagcggcagcgcctgtgccacccctgtggagagccccctgtgccccagcctgggcaagcacctgatcccagatgccagcgggaaaggagtgaactacatccccagcgaggagcgggcccctggcctgcccaaccacggggccaccttcaaggagctgcacccccagacagagggcatgtgccccaggatgacagtgcctgccctgcacacagccatcaacacagagcccctgtttggcaccctgagagatggctgccaccggctgcccaagatcaaggagaccaccggctag

SEQ ID NO: 152344 - DNA, 1794 bp, Artificial Sequence
  Description of Artificial Sequence: Synthetic coding sequence
atgtttgccagctgccactgtgtgccccggggccgccgcaccatgaagatgatccacttccgcagcagctctgtgaagagcctgagccaggagatgcgctgcaccatccggctgctggatgacagcgagatcagctgccacatccagcgggagaccaagggccagttcctgattgaccacatctgcaactactacagcctgctggagaaggactacttcggcatccgctacgtggaccctgagaagcagaggcactggctggagcccaacaagagcatcttcaagcagatgaagacccaccccccctacaccatgtgcttccgggtgaagttctacccccatgagcccctgaagatcaaggaggagctgacccgctacctgctgtacctgcagatcaagagggacatcttccacggccgcctgctgtgcagcttcagtgatgctgcctacctgggcgcctgcatcgtgcaggccgagctgggggactatgaccctgatgagcaccctgagaactacatcagcgagtttgagatcttccccaagcagagccagaagctggagaggaagatcgtggagatccacaagaatgagctgcggggccagagcccccctgtggccgagttcaacctgctgctgaaggcccacaccctggagacctacggcgtggacccccacccctgcaaggacagcacaggcaccaccaccttcctgggcttcaccgctgctggctttgtggtgttccagggcaacaagaggatccacctgatcaagtggccagatgtgtgcaagctgaagtttgagggcaagaccttctacgtgattggcacccagaaggagaagaaggccatgctggccttccacaccagcaccccagctgcctgcaagcacctgtggaagtgtggggtggagaaccaggccttctacaagtatgccaagagcagccagatcaagacagtgagcagcagcaagatcttcttcaagggcagccgcttccgctacagcggcaaggtggccaaggaggtggtggaggccagcagcaagatccagcgggagcccccagaggtgcaccgggccaacatcacccagagccgcagcagccacagcctgaacaagcagctgatcatcaacatggagcccctgcagcccctgctgcccagccccagcgagcaggaggaggagctgcccctgggggagggcgtgcccctgcccaaggaggagaacatcagcgcccccctcatcagcagcagccctgtgaaggccgcccgggagtatgaagatcctccttctgaggaggaggacaagatcaaggaggagcccctgaccatcagcgagctggtgtacaaccccagcgccagcctgctgcccacccctgtggatgatgatgaaattgacatgctgtttgactgccccagccggctggagctggagcgggaggacacagacagctttgaggacctggaggctgatgaaaatgccttcctgattgctgaggaggaggagctgaaggaggcccggcgggccctgtcctggagctatgacatcctgaccggccacatccgggtgaaccccctggtgaagagcttcagccggctgctggtggtgggcctgggcctgctgctgtttgtgttccccctgctgctgctgctgctggagagcggcatcgacctgtccttcctgtgtgagatccggcagaccccagagtttgagcagttccactatgagtactactgccccctgaaggagtgggtggccggcaaggtgcacctgatcctgtacatgctgggctgcagctag

SEQ ID NO: 152345 - DNA, 642 bp, Artificial Sequence
  Description of Artificial Sequence: Synthetic coding sequence
atgcaggccgaggagaccaagggcatcggcatcacctccatggccaagtgcctggtgaagatccagacccggcgcagcctgcagctgcacatggtgaaccactgcaacagcaatgtgtttgtgcggctgctgcggctgggcagcaaggtgacagccagaaatactggagtgcccctgcccaaggaggagaacatcagcgcccccctcatcagcagcagccctgtgaaggccgcccgggagtatgaggacccccccagcgaggaggaggacaagatcaaggaggagcccctgaccatcagcgagctggtgtacaaccccagcgccagcctgctgcccacccctgtggatgatgatgaaattgacatgctgtttgactgccccagccggctggagctggagcgggaggacacagacagctttgaggacctggaggctgatgaaaatgccttcctgattgctgaggaggaggagctgaaggaggcccggcgggccctgtcctggagctatgacatcctgaccggccacatccgggtgaaccccctggtgaagagcttcagccggctgctggtggtgggcctgggcctgctgctgtttgtgttccccctgctgctgctgctgctggagagcgtgtccatgcagtag

SEQ ID NO: 152346 - DNA, 804 bp, Artificial Sequence
  Description of Artificial Sequence: Synthetic coding sequence
atgtgcttccgggtgaagttctacccccatgagcccctgaagatcaaggaggagctgacccgctacctgctgtacctgcagatcaagagggacatcttccacggccgcctgctgtgcagcttcagtgatgctgcctacctgggcgcctgcatcgtgcaggccgagctgggggactatgaccctgatgagcaccctgagaactacatcagcgagtttgagatcttccccaagcagagccagaagctggagaggaagatcgtggagatccacaagaatgagctgcggggccagagcccccctgtggccgagttcaacctgctgctgaaggcccacaccctggagacctacggcgtggacccccacccctgcaaggacagcacaggcaccaccaccttcctgggcttcaccgctgctggctttgtggtgttccagggcaacaagaggatccacctgatcaagtggccagatgtgtgcaagctgaagtttgagggcaagaccttctacgtgattggcacccagaaggagaagaaggccatgctggccttccacaccagcaccccagctgcctgcaagcacctgtggaagtgtggggtggagaaccaggccttctacaagtatgccaagagcagccagatcaagacagtgagcagcagcaagatcttcttcaagggcagccgcttccgctacagcggcaaggtggccaaggaggtggtggaggccagcagcaagatccagcgggagcccccagaggtgcaccgctgtgtgcagaagaagatctgcagctgctttggagtgacctggtag

SEQ ID NO: 152347 - DNA, 1089 bp, Artificial Sequence
  Description of Artificial Sequence: Synthetic coding sequence
atggtgttccggcggggccagagcccccctgtggccgagttcaacctgctgctgaaggcccacaccctggagacctacggcgtggacccccacccctgcaaggacagcacaggcaccaccaccttcctgggcttcaccgctgctggctttgtggtgttccagggcaacaagaggatccacctgatcaagtggccagatgtgtgcaagctgaagtttgagggcaagaccttctacgtgattggcacccagaaggagaagaaggccatgctggccttccacaccagcaccccagctgcctgcaagcacctgtggaagtgtggggtggagaaccaggccttctacaagtatgccaagagcagccagatcaagacagtgagcagcagcaagatcttcttcaagggcagccgcttccgctacagcggcaaggtggccaaggaggtggtggaggccagcagcaagatccagcgggagcccccagaggtgcaccgggccaacatcacccagagccgcagcagccacagcctgaacaagcagctgatcatcaacatggagcccctgcagcccctgctgcccagccccagcgagcaggaggaggagctgcccctgggggagggcgtgcccctgcccaaggaggagaacatcagcgcccccctcatcagcagcagccctgtgaaggccgcccgggagtatgaagatcctccttctgaggaggaggacaagatcaaggaggagcccctgaccatcagcgagctggtgtacaaccccagcgccagcctgctgcccacccctgtggatgatgatgaaattgacatgctgtttgactgccccagccggctggagctggagcgggaggacacagacagctttgaggacctggaggctgatgaaaatgccttcctgattgctgaggaggaggagctgaaggaggcccggcgggccctgtcctggagctatgacatcctgaccggccacatccgggtgaaccccctggtgaagagcttcagccggctgctggtggtgggcctgggcctgctgctgtttgtgttccccctgctgctgctgctgctggagagcgtgtccatgcagtag

SEQ ID NO: 152348 - DNA, 1671 bp, Artificial Sequence
  Description of Artificial Sequence: Synthetic coding sequence
atgtttgccagctgccactgtgtgccccggggccgccgcaccatgaagatgatccacttccgcagcagctctgtgaagagcctgagccaggagatgcgctgcaccatccggctgctggatgacagcgagatcagctgccacatccagcgggagaccaagggccagttcctgattgaccacatctgcaactactacagcctgctggagaaggactacttcggcatccgctacgtggaccctgagaagcagaggcactggctggagcccaacaagagcatcttcaagcagatgaagacccaccccccctacaccatgtgcttccgggtgaagttctacccccatgagcccctgaagatcaaggaggagctgacccgctacctgctgtacctgcagatcaagagggacatcttccacggccgcctgctgtgcagcttcagtgatgctgcctacctgggcgcctgcatcgtgcaggccgagctgggggactatgaccctgatgagcaccctgagaactacatcagcgagtttgagatcttccccaagcagagccagaagctggagaggaagatcgtggagatccacaagaatgagctgcggggccagagcccccctgtggccgagttcaacctgctgctgaaggcccacaccctggagacctacggcgtggacccccacccctgcaaggacagcacaggcaccaccaccttcctgggcttcaccgctgctggctttgtggtgttccagggcaacaagaggatccacctgatcaagtggccagatgtgtgcaagctgaagtttgagggcaagaccttctacgtgattggcacccagaaggagaagaaggccatgctggccttccacaccagcaccccagctgcctgcaagcacctgtggaagtgtggggtggagaaccaggccttctacaagtatgccaagagcagccagatcaagacagtgagcagcagcaagatcttcttcaagggcagccgcttccgctacagcggcaaggtggccaaggaggtggtggaggccagcagcaagatccagcgggagcccccagaggtgcaccgggccaacatcacccagagccgcagcagccacagcctgaacaagcagctgatcatcaacatggagcccctgcagcccctgctgcccagccccagcgagcaggaggaggagctgcccctgggggagggcgtgcccctgcccaaggaggagaacatcagcgcccccctcatcagcagcagccctgtgaaggccgcccgggagtatgaagatcctccttctgaggaggaggacaagatcaaggaggagcccctgaccatcagcgagctggtgtacaaccccagcgccagcctgctgcccacccctgtggatgatgatgaaattgacatgctgtttgactgccccagccggctggagctggagcgggaggacacagacagctttgaggacctggaggctgatgaaaatgccttcctgattgctgaggaggaggagctgaaggaggcccggcgggccctgtcctggagctatgacatcctgaccggccacatccgggtgaaccccctggtgaagagcttcagccggctgctggtggtgggcctgggcctgctgctgtttgtgttccccctgctgctgctgctgctggagagcgtgtccatgcagtag

SEQ ID NO: 152349 - DNA, 423 bp, Artificial Sequence
  Description of Artificial Sequence: Synthetic coding sequence
ggcaccaccaccttcctgggcttcaccgctgctggctttgtggtgttccagggcaacaagaggatccacctgatcaagtggccagatgtgtgcaagctgaagtttgagggcaagaccttctacgtgattggcacccagaaggagaagaaggccatgctggccttccacaccagcaccccagctgcctgcaagcacctgtggaagtgtggggtggagaaccaggccttctacaagtatgccaagagcagccagatcaagacagtgagcagcagcaagatcttcttcaagggcagccgcttccgctacagcggcaaggtggccaaggaggtggtggaggccagcagcaagatccagcgggagcccccagaggtgcaccgctgtgtgcagaagaagatctgcagctgcttcggcgtgacctggtag

SEQ ID NO: 152350 - DNA, 2145 bp, Artificial Sequence
  Description of Artificial Sequence: Synthetic coding sequence
atgctgcacctgaaggtgcagttcctggatgacagccagaagatctttgtggtggaccagaagagcagcggcaaggccctcttcaacctgagctgcagccacctgaacctggccgagaaggagtacttcggcctggagttctgcagccacagcggcaacaacgtgtggctggagctgctgaagcccatcaccaagcaggtgaagaaccccaaggagatcgtgttcaagttcatggtgaagttcttccctgtggaccccggccacctgcgggaggagctgacccgctacctgttcaccctgcagatcaagaaggacctggccctgggccgcctgccctgcagcgacaactgcacagccctgatggtgagccacatcctgcagagcgagctgggggacttccacgaggagacagacaggaagcacctggcccagacccgctacctgcccaaccaggactgcctggagggcaagatcatgcacttccaccagaagcacatcggccgcagccctgctgagagtgacatcctgctgctggacatcgccaggaagctggacatgtatggcatccggccccacccagccagtgatggagagggcatgcagatccacctggccgtggcccacatgggcgtgctggtgctgcggggcaacaccaagatcaacaccttcaactgggccaagatcaggaagctgtccttcaagaggaagcacttcctgatcaagctgcacgccaacatcctggtgctgtgcaaggacaccctggagttcaccatggccagcagagatgcctgcaaggccttctggaagacctgtgtggagtaccacgccttcttccggctgtctgaggagcccaagagcaagcccaagaccctgctgtgcagcaagggcagcagcttccgctacagcggccgcacccagaggcagctgctggagtatggcaggaagggccgcctgaagagcctgccctttgagaggaagcactaccccagccagtaccacgagcggcagtgccgcagcagcccagacctgctgagtgatgtgtccaagcaggtggaggacctgcggctggcctacggcggcggctactaccagaatgtgaatggagtgcacgccagcgagcctgtgctggagagcagaagaagaaattctgccctggaggtgacctttgccacagagctggagcacagcaagccagaggccgaccccaccctgctgcaccagagccagagcagcagcagcttccccttcatctacatggaccctgtgttcaacacagagcccaaccccaacccagacccccgggacatcttcagcgagaggagcagcctgagcagcttccagaccagctgcaagttcagcggcaaccacatgagcatctacagcggcctgaccagcaaggtgcggcctgccaagcagctgacctacacagatgtgccctacatcccctgcaccggccagcaggtgggcatcatgccaccccaggtgttcttctacgtggacaagccaccccaggtgccccgctggagccccatccgggcagaggagaggaccagcccccacagctatgtggagcccacagccatgaagccagctgagaggagccccaggaacatccgcatgaagagcttccagcaggacctgcaggtgctgcaggaggccatcgcccggaccagcggccgcagcaacatcaacgtgggcctggaggaggaggaccccaacctggaggatgcctttgtgtgcaacatccaggagcagacccccaagaggagccagagccagagcgacatgaagaccatccgcttcccctttggaagtgagttccggcccctgggcccctgcccagccctgagccacaaggctgacctcttcacagacatgtttgctgagcaggagctgcctgctgtgctgatggaccagagcacagctgagagatatgtggccagcgagagcagtgacagcgagagcgagatcctgaagccagactactatgccctgtatggcaaggagatccgcagccccatggcccgcatccggctgagcagcggcagcctgcagctggatgaagaagatgaagatgcctacttcaacacccccacagctgaggacaggaccagcctgaagccctgcaactacttcctggcctag

SEQ ID NO: 152351 - DNA, 1785 bp, Artificial Sequence
  Description of Artificial Sequence: Synthetic coding sequence
atggtgagccacatcctgcagagcgagctgggggacttccacgaggagacagacaggaagcacctggcccagacccgctacctgcccaaccaggactgcctggagggcaagatcatgcacttccaccagaagcacatcggccgcagccctgctgagagtgacatcctgctgctggacatcgccaggaagctggacatgtatggcatccggccccacccagccagtgatggagagggcatgcagatccacctggccgtggcccacatgggcgtgctggtgctgcggggcaacaccaagatcaacaccttcaactgggccaagatcaggaagctgtccttcaagaggaagcacttcctgatcaagctgcacgccaacatcctggtgctgtgcaaggacaccctggagttcaccatggccagcagagatgcctgcaaggccttctggaagacctgtgtggagtaccacgccttcttccggctgtctgaggagcccaagagcaagcccaagaccctgctgtgcagcaagggcagcagcttccgctacagcggccgcacccagaggcagctgctggagtatggcaggaagggccgcctgaagagcctgccctttgagaggaagcactaccccagccagtaccacgagcggcagtgccgcagcagcccagacctgctgagtgatgtgtccaagcaggtggaggacctgcggctggcctacggcggcggctactaccagaatgtgaatggagtgcacgccagcgagcctgtgctggagagcagaagaagaaattctgccctggaggtgacctttgccacagagctggagcacagcaagccagaggccgaccccaccctgctgcaccagagccagagcagcagcagcttccccttcatctacatggaccctgtgttcaacacagagcccaaccccaacccagacccccgggacatcttcagcgagaggagcagcctgagcagcttccagaccagctgcaagttcagcggcaaccacatgagcatctacagcggcctgaccagcaaggtgcggcctgccaagcagctgacctacacagatgtgccctacatcccctgcaccggccagcaggtgggcatcatgccaccccaggtgttcttctacgtggacaagccaccccaggtgccccgctggagccccatccgggcagaggagaggaccagcccccacagctatgtggagcccacagccatgaagccagctgagaggagccccaggaacatccgcatgaagagcttccagcaggacctgcaggtgctgcaggaggccatcgcccggaccagcggccgcagcaacatcaacgtgggcctggaggaggaggaccccaacctggaggatgcctttgtgtgcaacatccaggagcagacccccaagaggagccagagccagagcgacatgaagaccatccgcttcccctttggaagtgagttccggcccctgggcccctgcccagccctgagccacaaggctgacctcttcacagacatgtttgctgagcaggagctgcctgctgtgctgatggaccagagcacagctgagagatatgtggccagcgagagcagtgacagcgagagcgagatcctgaagccagactactatgccctgtatggcaaggagatccgcagccccatggcccgcatccggctgagcagcggcagcctgcagctggatgaagaagatgaagatgcctacttcaacacccccacagctgaggacaggaccagcctgaagccctgcaactacttcctggcctag

SEQ ID NO: 152352 - DNA, 2043 bp, Artificial Sequence
  Description of Artificial Sequence: Synthetic coding sequence
atggccctggatggcatccgcatgccagatggctgctacgcagatggcacctgggagctgtctgtgcacgtgacagacctgaacagagatgtgaccctgcgggtgactggagaggtgcacatcggcggcgtgatgctgaagctggtggagaagctggatgtgaagaaggactggagcgaccacgccctgtggtgggagaagaagaggacctggctgctgaagacccactggaccctggacaagtatggcatccaggctgatgccaagctgcagttcaccccccagcacaagctgctgcggctgcagctgcccaacatgaagtatgtgaaggtgaaggtgaacttcagtgacagagtcttcaaggctgtgtctgacatctgcaagaccttcaacatccgccaccctgaggagctgagcctgctgaagaagccccgggaccccaccaagaagaagaagaagaagctggatgaccagagtgaagatgaggccctggagctggagggccccctcatcaccccaggcagcggcagcatctacagcagccctggcctgtacagcaagaccatgacccccacctatgatgcccatgatggcagccccctgagccccaccagcgcctggtttggagacagcgccctgtctgagggcaaccctggcatcctggccgtgtcccagcccatcaccagccctgagatcctggccaagatgttcaagccccaggccctgctggacaaggccaagatcaaccagggctggctggacagcagccgcagcctgatggagcaggatgtgaaggaaaatgaggccctgctgctgcgcttcaagtactacagcttctttgacctgaaccccaagtatgatgccatccgcatcaaccagctgtatgagcaggccaagtgggccatcctgctggaggagattgagtgcacagaggaggagatgatgatgtttgctgccctgcagtaccacatcaacaagctgagcatcatgaccagcgagaaccacctgaacaacagcgacaaggaggtggatgaggtggatgctgccctgagtgacctggagatcaccctggagggcggcaagaccagcaccatcctgggggacatcaccagcatccctgagctggccgactacatcaaggtgttcaagcccaagaagctgaccctgaagggctacaagcagtactggtgcaccttcaaggacaccagcatcagctgctacaagagcaaggaggagagcagcggcaccccagcccaccagatgaacctgcggggctgtgaggtgaccccagatgtgaacatcagcggccagaagttcaacatcaagctgctgatccctgtggccgagggcatgaatgagatctggctgcgctgtgacaatgagaagcagtatgcccactggatggccgcctgccgcctggccagcaagggcaagaccatggctgacagcagctacaacctggaggtgcagaacatcctgtccttcctgaagatgcagcacctgaacccagacccccagctgatccctgagcagatcaccacagacatcaccccagaatgtctggtgagcccccgctacctgaagaagtacaagaacaagcagatcacagcccgcatcctggaggcccaccagaatgtggcccagatgagcctcatcgaggccaagatgaggttcatccaggcctggcagagcctgcctgagtttggcatcacccacttcatcgcccgcttccagggcggcaagaaggaggagctgattggcatcgcctacaacagactcatccgcatggatgccagcactggagatgccatcaagacctggaggttcagcaacatgaagcagtggaatgtgaactgggagatcaagatggtgacagtggagtttgctgatgaggtgcggctgtccttcatctgcacagaggtggactgcaaggtggtgcatgagttcatcggcggctacatcttcctgagcacccgggccaaggaccagaatgaaagcctggatgaggagatgttctacaagctgaccagcggctgggtgtag

SEQ ID NO: 152353 - DNA, 2064 bp, Artificial Sequence
  Description of Artificial Sequence: Synthetic coding sequence
atggccctggatggcatccgcatgccagatggctgctacgcagatggcacctgggagctgtctgtgcacgtgacagacctgaacagagatgtgaccctgcgggtgactggagaggtgcacatcggcggcgtgatgctgaagctggtggagaagctggatgtgaagaaggactggagcgaccacgccctgtggtgggagaagaagaggacctggctgctgaagacccactggaccctggacaagtatggcatccaggctgatgccaagctgcagttcaccccccagcacaagctgctgcggctgcagctgcccaacatgaagtatgtgaaggtgaaggtgaacttcagtgacagagtcttcaaggctgtgtctgacatctgcaagaccttcaacatccgccaccctgaggagctgagcctgctgaagaagccccgggaccccaccaagaagaagaagaagaagctggatgaccagagtgaagatgaggccctggagctggagggccccctcatcaccccaggcagcggcagcatctacagcagccctggcctgtacagcaagaccatgacccccacctatgatgcccatgatggcagccccctgagccccaccagcgcctggtttggagacagcgccctgtctgagggcaaccctggcatcctggccgtgtcccagcccatcaccagccctgagatcctggccaagatgttcaagccccaggccctgctggacaaggccaagatcaaccagggctggctggacagcagccgcagcctgatggagcaggatgtgaaggaaaatgaggccctgctgctgcgcttcaagtactacagcttctttgacctgaaccccaagtatgatgccatccgcatcaaccagctgtatgagcaggccaagtgggccatcctgctggaggagattgagtgcacagaggaggagatgatgatgtttgctgccctgcagtaccacatcaacaagctgagcatcatgaccagcgagaaccacctgaacaacagcgacaaggaggtggatgaggtggatgctgccctgagtgacctggagatcaccctggagggcggcaagaccagcaccatcctgggggacatcaccagcatccctgagctggccgactacatcaaggtgttcaagcccaagaagctgaccctgaagggctacaagcagtactggtgcaccttcaaggacaccagcatcagctgctacaagagcaaggaggagagcagcggcaccccagcccaccagatgaacctgcggggctgtgaggtgaccccagatgtgaacatcagcggccagaagttcaacatcaagctgctgatccctgtggccgagggcatgaatgagatctggctgcgctgtgacaatgagaagcagtatgcccactggatggccgcctgccgcctggccagcaagggcaagaccatggctgacagcagctacaacctggaggtgcagaacatcctgtccttcctgaagatgcagcacctgaacccagacccccagctgatccctgagcagatcaccacagacatcaccccagaatgtctggtgagcccccgctacctgaagaagtacaagaacaagcagcccggctacatccgggacctgatcacagcccgcatcctggaggcccaccagaatgtggcccagatgagcctgattgaggccaagatgaggttcatccaggcctggcagagcctgcctgagtttggcatcacccacttcatcgcccgcttccagggcggcaagaaggaggagctgattggaattgcctacaacagactcatccgcatggatgccagcactggagatgccatcaagacctggaggttcagcaacatgaagcagtggaatgtgaactgggagatcaagatggtgacagtggagtttgctgatgaggtgcggctgtccttcatctgcacagaggtggactgcaaggtggtgcatgagttcatcggcggctacatcttcctgagcacccgggccaaggaccagaatgaaagcctggatgaggagatgttctacaagctgaccagcggctgggtgtag

SEQ ID NO: 152354 - DNA, 2043 bp, Artificial Sequence; identical to SEQ ID NO: 152352
  Description of Artificial Sequence: Synthetic coding sequence

SEQ ID NO: 152355 - DNA, 1902 bp, Artificial Sequence
  Description of Artificial Sequence: Synthetic coding sequence
atggccctggatggcatccgcatgccagatggctgctacgcagatggcacctgggagctgtctgtgcacgtgacagacctgaacagagatgtgaccctgcgggtgactggagaggtgcacatcggcggcgtgatgctgaagctggtggagaagctggatgtgaagaaggactggagcgaccacgccctgtggtgggagaagaagaggacctggctgctgaagacccactggaccctggacaagtatggcatccaggctgatgccaagctgcagttcaccccccagcacaagctgctgcggctgcagctgcccaacatgaagtatgtgaaggtgaaggtgaacttcagtgacagagtcttcaaggctgtgtctgacatctgcaagaccttcaacatccgccaccctgaggagctgagcctgctgaagaagccccgggaccccaccaagaagaagaagaagaagctggatgaccagagtgaagatgaggccctggagctggagggccccctcatcaccccaggcagcggcagcatctacagcagccctggcctgtacagcaagaccatgacccccacctatgatgcccatgatggcagccccctgagccccaccagcgcctggtttggagacagcgccctgtctgagggcaaccctggcatcctggccgtgtcccagcccatcaccagccctgagatcctggccaagatgttcaagccccaggccctgctggacaaggccaagatcaaccagggctggctggacagcagccgcagcctgatggagcaggatgtgaaggaaaatgaggccctgctgctgcgcttcaagtactacagcttctttgacctgaaccccaagtatgatgccatccgcatcaaccagctgtatgagcaggccaagtgggccatcctgctggaggagattgagtgcacagaggaggagatgatgatgtttgctgccctgcagtaccacatcaacaagctgagcatcatgaccagcgagaaccacctgaacaacagcgacaaggaggtggatgaggtggatgctgccctgagtgacctggagatcaccctggagggcggcaagaccagcaccatcctgggggacatcaccagcatccctgagctggccgactacatcaaggtgttcaagcccaagaagctgaccctgaagggctacaagcagtactggtgcaccttcaaggacaccagcatcagctgctacaagagcaaggaggagagcagcggcaccccagcccaccagatgaacctgcggggctgtgaggtgaccccagatgtgaacatcagcggccagaagttcaacatcaagctgctgatccctgtggccgagggcatgaatgagatctggctgcgctgtgacaatgagaagcagtatgcccactggatggccgcctgccgcctggccagcaagggcaagaccatggctgacagcagctacaacctggaggtgcagaacatcctgtccttcctgaagatgcagcacctgaacccagacccccagctgatccctgagcagatcaccacagacatcaccccagaatgtctggtgagcccccgctacctgaagaagtacaagaacaagcagcccggctacatccgggacctgatcacagcccgcatcctggaggcccaccagaatgtggcccagatgagcctgattgaggccaagatgaggttcatccaggcctggcagagcctgcctgagtttggcatcacccacttcatcgcccgcttccagggcggcaagaaggaggagctgattggaattgcctacaacagactcatccgcatggatgccagcactggagatgccatcaagacctggaggttcagcaacatgaagcagtggaatgtgaactgggagatcaagatggtgaacagctag

SEQ ID NO: 152356 - DNA, 2064 bp, Artificial Sequence; identical to SEQ ID NO: 152353
  Description of Artificial Sequence: Synthetic coding sequence

SEQ ID NO: 152357 - DNA, 462 bp, Artificial Sequence
  Description of Artificial Sequence: Synthetic coding sequence
atggccctggatggcatccgcatgccagatggctgctacgcagatggcacctgggagctgtctgtgcacgtgacagacctgaacagagatgtgaccctgcgggtgactggagaggtgcacatcggcggcgtgatgctgaagctggtggagaagctggatgtgaagaaggactggagcgaccacgccctgtggtgggagaagaagaggacctggctgctgaagacccactggaccctggacaagtatggcatccaggctgatgccaagctgcagttcaccccccagcacaagctgctgcggctgcagctgcccaacatgaagtatgtgaaggtgaaggtgaacttcagtgacagagtcttcaaggctgtgtctgacatctgcaagaccttcaacatccgccaccctgaggagctgagcctgctgaagaagccccgggaccccaccaagaagaagaagaagtag

SEQ ID NO: 152358 - DNA, 2004 bp, Artificial Sequence
  Description of Artificial Sequence: Synthetic coding sequence
atggccggcatgaagacagccagcggggactacatcgacagctcctgggagctgcgggtgtttgtgggggaggaggaccctgaggccgagagcgtgaccctgcgggtgactggagagagccacatcggcggcgtgctgctgaagatcgtggagcagatcaacaggaagcaggactggagcgaccacgccatctggtgggagcagaagaggcagtggctgctgcagacccactggaccctggacaagtatggcatcctggctgatgcccggctcttcttcggcccccagcacaggcctgtgatcctgcggctgcccaacagaagagccctgcggctgcgggccagcttcagccagcccctcttccaggccgtggccgccatctgccgcctgctgagcatccgccaccctgaggagctgagcctgctgcgggcccctgagaagaaggagaagaagaagaaggagaaggagcctgaggaggagctgtatgacctgagcaaggtggtgctggccggcggcgtggccccagccctcttccggggcatgcctgcccacttcagtgacagcgcccagacagaggcctgctaccacatgctgagccggccccagcccccaccagaccccctgctgctgcagaggctgccccggcccagcagcctgagtgacaagacccagctgcacagccgctggctggacagcagccgctgcctgatgcagcagggcatcaaggctggagatgccctgtggctgcgcttcaagtactacagcttctttgacctggaccccaagacagatcctgtgcggctgacccagctgtatgagcaggcccgctgggacctgctgctggaggagattgactgcacagaggaggagatgatggtgtttgctgccctgcagtaccacatcaacaagctgagccagagcggggaggtgggggagcccgccggcacagaccccggcctggatgacctggatgtggccctgagcaacctggaggtgaagctggagggcagcgcccccacagatgtgctggacagcctgaccaccatccctgagctgaaggaccacctgcgcatcttccgcatcccccggcggcccaggaagctgaccctgaagggctaccggcagcactgggtggtgttcaaggagaccaccctgagctactacaagagccaggatgaggcccctggggaccccatccagcagctgaacctgaagggctgtgaggtggtgcctgatgtgaatgtgtctggccagaagttctgcatcaagctgctggtgcccagccctgagggcatgtctgagatctacctgcgctgccaggatgagcagcagtatgcccgctggatggccggctgccgcctggccagcaaaggaagaaccatggctgacagcagctacaccagcgaggtgcaggccatcctggccttcctgagcctgcagaggacaggcagcggcggccctggcaaccacccccacggcccagatgccagcgctgagggcctgaacccctacggcctggtggccccccgcttccagaggaagttcaaggccaagcagctgaccccccgcatcctggaggcccaccagaatgtggcccagctgagcctggccgaggcccagctgcgcttcatccaggcctggcagagcctgcctgactttggcatctcctatgtgatggtgcgcttcaagggcagcaggaaggatgagatcctgggcatcgccaacaacagactcatcagaattgacctggccgtgggagatgtggtgaagacctggaggttcagcaacatgaggcagtggaatgtgaactgggacatccggcaggtggccattgaatttgatgagcacatcaacgtggccttcagctgtgtgtctgccagctgccgcatcgtgcatgagtacatcggcggctacatcttcctgagcacccgggagcgggcccggggggaggagctggatgaggacctcttcctgcagctgactggaggccacgaggccttctag

SEQ ID NO: 152359 - DNA, 1992 bp, Artificial Sequence
  Description of Artificial Sequence: Synthetic coding sequence
atggccggcatgaagacagccagcggggactacatcgacagctcctgggagctgcgggtgtttgtgggggaggaggaccctgaggccgagagcgtgaccctgcgggtgactggagagagccacatcggcggcgtgctgctgaagatcgtggagcagatcaacaggaagcaggactggagcgaccacgccatctggtgggagcagaagaggcagtggctgctgcagacccactggaccctggacaagtatggcatcctggctgatgcccggctcttcttcggcccccagcacaggcctgtgatcctgcggctgcccaacagaagagccctgcggctgcgggccagcttcagccagcccctcttccaggccgtggccgccatctgccgcctgctgagcatccgccaccctgaggagctgagcctgctgcgggcccctgagaagaaggagaagaagaagaaggagaaggagcctgaggaggagctgtatgacctgagcaaggtggtgctggccggcggcgtggccccagccctcttccggggcatgcctgcccacttcagtgacagcgcccagacagaggcctgctaccacatgctgagccggccccagcccccaccagaccccctgctgctgcagaggctgccccggcccagcagcctgagtgacaagacccagctgcacagccgctggctggacagcagccgctgcctgatgcagcagggcatcaaggctggagatgccctgtggctgcgcttcaagtactacagcttctttgacctggaccccaagacagatcctgtgcggctgacccagctgtatgagcaggcccgctgggacctgctgctggaggagattgactgcacagaggaggagatgatggtgtttgctgccctgcagtaccacatcaacaagctgagccagagcggggaggtgggggagcccgccggcacagaccccggcctggatgacctggatgtggccctgagcaacctggaggtgaagctggagggcagcgcccccacagatgtgctggacagcctgaccaccatccctgagctgaaggaccacctgcgcatcttccggcccaggaagctgaccctgaagggctaccggcagcactgggtggtgttcaaggagaccaccctgagctactacaagagccaggatgaggcccctggggaccccatccagcagctgaacctgaagggctgtgaggtggtgcctgatgtgaatgtgtctggccagaagttctgcatcaagctgctggtgcccagccctgagggcatgtctgagatctacctgcgctgccaggatgagcagcagtatgcccgctggatggccggctgccgcctggccagcaaaggaagaaccatggctgacagcagctacaccagcgaggtgcaggccatcctggccttcctgagcctgcagaggacaggcagcggcggccctggcaaccacccccacggcccagatgccagcgctgagggcctgaacccctacggcctggtggccccccgcttccagaggaagttcaaggccaagcagctgaccccccgcatcctggaggcccaccagaatgtggcccagctgagcctggccgaggcccagctgcgcttcatccaggcctggcagagcctgcctgactttggcatctcctatgtgatggtgcgcttcaagggcagcaggaaggatgagatcctgggcatcgccaacaacagactcatcagaattgacctggccgtgggagatgtggtgaagacctggaggttcagcaacatgaggcagtggaatgtgaactgggacatccggcaggtggccattgaatttgatgagcacatcaacgtggccttcagctgtgtgtctgccagctgccgcatcgtgcatgagtacatcggcggctacatcttcctgagcacccgggagcgggcccggggggaggagctggatgaggacctcttcctgcagctgactggaggccacgaggccttctag

SEQ ID NO: 152360 - DNA, 861 bp, Artificial Sequence
  Description of Artificial Sequence: Synthetic coding sequence
atggccggcatgaagacagccagcggggactacatcgacagctcctgggagctgcgggtgtttgtgggggaggaggaccctgaggccgagagcgtgaccctgcgggtgactggagagagccacatcggcggcgtgctgctgaagatcgtggagcagatcaacaggaagcaggactggagcgaccacgccatctggtgggagcagaagaggcagtggctgctgcagacccactggaccctggacaagtatggcatcctggctgatgcccggctcttcttcggcccccagcacaggcctgtgatcctgcggctgcccaacagaagagccctgcggctgcgggccagcttcagccagcccctcttccaggccgtggccgccatctgccgcctgctgagcatccgccaccctgaggagctgagcctgctgcgggcccctgagaagaaggagaagaagaagaaggagaaggagcctgaggaggagctgtatgacctgagcaaggtggtgctggccggcggcgtggccccagccctcttccggggcatgcctgcccacttcagtgacagcgcccagacagaggcctgctaccacatgctgagccggccccagcccccaccagaccccctgctgctgcagaggctgccccggcccagcagcctgagtgacaagacccagctgcacagccgctggctggacagcagccgctgcctgatgcagcagggcatcaaggctggagatgccctgtggctgcgcttcaagtactacagcttctttgacctggaccccaagacagatcctgtgcggctgacccagctgtatgagcaggcccgctgggacctgctgctggaggagattgactgctag

SEQ ID NO: 152361 - DNA, 555 bp, Artificial Sequence
  Description of Artificial Sequence: Synthetic coding sequence
atggctgctgctgggggcgcccggctgctgcgggccgccagcgctgtgctgggcggccctgctggccgctggctgcaccacgccggcagccgggccggcagcagcggcctgctgaggaacagaggccctgggggcagcgctgaggccagccgcagcctgtctgtgtctgcccgggcccggagcagcagcgaggacaagatcaccgtgcacttcatcaacagagatggagagaccctgaccaccaagggcaaggtgggggacagcctgctggatgtggtggtggagaacaacctggacattgatggctttggagcctgtgagggcaccctggcctgcagcacctgccacctgatctttgaggaccacatctatgagaagctggatgccatcacagatgaggagaatgacatgctggacctggcctacggcctgacagacaggagccggctgggctgccagatctgcctgaccaagtccatggacaacatgacagtgcgggtgcctgagaccgtggctgatgcccggcagagcattgatgtgggcaagaccagctag

SEQ ID NO: 152362 - DNA, 1494 bp, Artificial Sequence
  Description of Artificial Sequence: Synthetic coding sequence
atggccagccgctgctggcgctggtggggctggagcgcctggcccaggacccggctgcccccagctggcagcacccccagcttctgccaccacttcagcacccaggagaagaccccccagatctgtgtggtgggcagcggccctgctggcttctacacagcccagcacctgctgaagcacccccaggcccacgtggacatctatgagaagcagcctgtgcccttcggcctggtgcgcttcggcgtggccccagaccaccctgaggtgaagaatgtcatcaacaccttcacccagacagcccacagcggccgctgtgccttctggggcaatgtggaggtgggcagagatgtgacagtgcctgagctgcgggaggcctaccacgctgtggtgctgtcctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggaggccctgctgctgtgccagaggacagacatcaccaaggccgccctgggcgtgctgcggcagagccgggtgaagacagtgtggctggtgggccggcggggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggaagaagagctgctggggtgcggctggccgtgacccggctggagggcgtggatgaggccaccagggctgtgcccactggagacatggaggacctgccctgtggcctggtgctgagcagcatcggctacaagagcaggcctgtggaccccagcgtgccctttgacagcaagctgggcgtcatccccaacgtggagggccgggtgatggatgtgcccggcctgtactgcagcggctgggtgaagaggggccccaccggggtgattgccaccaccatgacagacagcttcctgaccggccagatgctgctgcaggacctgaaggccggcctgctgcccagcggcccccggcccggctatgctgccatccaggccctgctgagcagcagaggagtgcggcctgtgtccttcagtgactgggagaagctggatgctgaggaggtggcccggggccagggcaccgggaagccccgggagaagctggtggacccccaggagatgctgcggctgctgggccactag

SEQ ID NO: 152363 - DNA, 1569 bp, Artificial Sequence
  Description of Artificial Sequence: Synthetic coding sequence
atggccagccgctgctggcgctggtggggctggagcgcctggcccaggacccggctgcccccagctggcagcacccccaccttcggcggcagtgatgaggtgcgggaccctgccaatgccaaggccctgaggaacaagagaagaaggatgcaggtgcgggtgaagctgggcaagttccagctgctgctggacatccaggagaagaccccccagatctgtgtggtgggcagcggccctgctggcttctacacagcccagcacctgctgaagcacccccaggcccacgtggacatctatgagaagcagcctgtgcccttcggcctggtgcgctttggagtggccccagaccaccctgaggtgaagaatgtcatcaacaccttcacccagacagcccacagcggccgctgtgccttctggggcaatgtggaggtgggcagagatgtgacagtgcctgagctgcgggaggcctaccacgctgtggtgctgtcctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggagaggacagacatcaccaaggccgccctgggcgtgctgcggcagagccgggtgaagacagtgtggctggtgggcagaagaggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggccggcgggctgctggggtgcggctggccgtgacccggctggagggcgtggatgaggccaccagggctgtgcccaccggggacatggaggacctgccctgtggcctggtgctgagcagcatcggctacaagagcaggcctgtggaccccagcgtgccctttgacagcaagctgggcgtcatccccaacgtggagggccgggtgatggatgtgcccggcctgtactgcagcggctgggtgaagaggggccccactggagtcatcgccaccaccatgacagacagcttcctgaccggccagatgctgctgcaggacctgaaggccggcctgctgcccagcggccccaggcctggctacgccgccatccaggccctgctgagcagccggggcgtgcggcctgtgtccttcagtgactgggagaagctggatgctgaggaggtggcccggggccagggcaccgggaagccccgggagaagctggtggacccccaggagatgctgcggctgctgggccactag

SEQ ID NO: 152364 - DNA, 1356 bp, Artificial Sequence
  Description of Artificial Sequence: Synthetic coding sequence
atggccagccgctgctggcgctggtggggctggagcgcctggcccaggacccggctgcccccagctggcagcacccccagcttctgccaccacttcagcacccaggagaagaccccccagatctgtgtggtgggcagcggccctgctggcttctacacagcccagcacctgctgaagcagcacccccaggcccacgtggacatctatgagaagcagcctgtgcccttcggcctggtgcgctttggagtggccccagaccaccctgaggtgaagagctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggagaggacagacatcaccaaggccgccctgggcgtgctgcggcagagccgggtgaagacagtgtggctggtgggccggcggggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggaagaagagctgctggggtgcggctggccgtgacccggctggagggcgtggatgaggccaccagggctgtgcccactggagacatggaggacctgccctgtggcctggtgctgagcagcatcggctacaagagcaggcctgtggaccccagcgtgccctttgacagcaagctgggcgtcatccccaacgtggagggccgggtgatggatgtgcccggcctgtactgcagcggctgggtgaagaggggccccaccggggtgattgccaccaccatgacagacagcttcctgaccggccagatgctgctgcaggacctgaaggccggcctgctgcccagcggcccccggcccggctatgctgccatccaggccctgctgagcagcagaggagtgcggcctgtgtccttcagtgactgggagaagctggatgctgaggaggtggcccggggccagggcaccgggaagccccgggagaagctggtggacccccaggagatgctgcggctgctgggccactag

SEQ ID NO: 152365 - DNA, 1605 bp, Artificial Sequence
  Description of Artificial Sequence: Synthetic coding sequence
atggccagccgctgctggcgctggtggggctggagcgcctggcccaggacccggctgcccccagctggcagcacccccagcttctgccaccacttcagcacccaggagaagaccccccagatctgtgtggtgggcagcggccctgctggcttctacacagcccagcacctgctgaagagggtggaggccctgtgcagccagccccgggtgctgaacagccctgccctgtctggagaaggagaggacctgggcgccagccagcccctgagcctggaccccaccagctgccaccctgtgccccagcagcacccccaggcccacgtggacatctatgagaagcagcctgtgcccttcggcctggtgcgctttggagtggccccagaccaccctgaggtgaagaatgtcatcaacaccttcacccagacagcccacagcggccgctgtgccttctggggcaatgtggaggtgggcagagatgtgacagtgcctgagctgcgggaggcctaccacgctgtggtgctgtcctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggagaggacagacatcaccaaggccgccctgggcgtgctgcggcagagccgggtgaagacagtgtggctggtgggcagaagaggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggccggcgggctgctggggtgcggctggccgtgacccggctggagggcgtggatgaggccaccagggctgtgcccaccggggacatggaggacctgccctgtggcctggtgctgagcagcatcggctacaagagcaggcctgtggaccccagcgtgccctttgacagcaagctgggcgtcatccccaacgtggagggccgggtgatggatgtgcccggcctgtactgcagcggctgggtgaagaggggccccactggagtcatcgccaccaccatgacagacagcttcctgaccggccagatgctgctgcaggacctgaaggccggcctgctgcccagcggccccaggcctggctacgccgccatccaggccctgctgagcagccggggcgtgcggcctgtgtccttcagtgactgggagaagctggatgctgaggaggtggcccggggccagggcaccgggaagccccgggagaagctggtggacccccaggagatgctgcggctgctgggccactag

SEQ ID NO: 152366 - DNA, 1146 bp, Artificial Sequence
  Description of Artificial Sequence: Synthetic coding sequence
atgaccacctgcaaggccggcgtggtgcccctggccagccagcagcacccccaggcccacgtggacatctatgagaagcagcctgtgcccttcggcctggtgcgcttcggcgtggccccagaccaccctgaggtgaagaatgtcatcaacaccttcacccagacagcccacagcggccgctgtgccttctggggcaatgtggaggtgggcagagatgtgacagtgcctgagctgcgggaggcctaccacgctgtggtgctgtcctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggagaggacagacatcaccaaggccgccctgggcgtgctgcggcagagccgggtgaagacagtgtggctggtgggccggcggggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggaagaagagctgctggggtgcggctggccgtgacccggctggaggtgtccctgatgttcctgaaggacacccccttccctggcctgtgccaccccccaggagtggcccacaccctgcccaacagagtgtccatgaggcctcctgtgcagtgcccccgggagacctggaagaccagcctggtgggctggtgcagcgctgccctgggcatccgggccgccctgagcacccaggcctgccccctgacccccagcctgggcagcagccccatgtggagggctggcctgtggatgtgccaggccagcacagctgctgctggatag

SEQ ID NO: 152367 - DNA, 1320 bp, Artificial Sequence
  Description of Artificial Sequence: Synthetic coding sequence
atggaggacaaggaccgggagcacccccaggcccacgtggacatctatgagaagcagcctgtgcccttcggcctggtgcgcttcggcgtggccccagaccaccctgaggtgaagaatgtcatcaacaccttcacccagacagcccacagcggccgctgtgccttctggggcaatgtggaggtgggcagagatgtgacagtgcctgagctgcgggaggcctaccacgctgtggtgctgtcctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggagaggacagacatcaccaaggccgccctgggcgtgctgcggcagagccgggtgaagacagtgtggctggtgggccggcggggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggaagaagagctgctggggtgcggctggccgtgacccggctggagggcgtggatgaggccaccagggctgtgcccactggagacatggaggacctgccctgtggcctggtgctgagcagcatcggctacaagagcaggcctgtggaccccagcgtgccctttgacagcaagctgggcgtcatccccaacgtggagggccgggtgatggatgtgcccggcctgtactgcagcggctgggtgaagaggggccccaccggggtgattgccaccaccatgacagacagcttcctgaccggccagatgctgctgcaggacctgaaggccggcctgctgcccagcggcccccggcccggctatgctgccatccaggccctgctgagcagcagaggagtgcggcctgtgtccttcagtgactgggagaagctggatgctgaggaggtggcccggggccagggcaccgggaagccccgggagaagctggtggacccccaggagatgctgcggctgctgggccactag

SEQ ID NO: 152368 - DNA, 1494 bp, Artificial Sequence; identical to SEQ ID NO: 152362
  Description of Artificial Sequence: Synthetic coding sequence

SEQ ID NO: 152369 - DNA, 1452 bp, Artificial Sequence
  Description of Artificial Sequence: Synthetic coding sequence
atggccagccgctgctggcgctggtggggctggagcgcctggcccaggacccggctgcccccagctggcagcacccccagcttctgccaccacttcagcacccaggagaagaccccccagatctgtgtggtgggcagcggccctgctggcttctacacagcccagcacctgctgaagcacccccaggcccacgtggacatctatgagaagcagcctgtgcccttcggcctggtgcgcttcggcgtggccccagaccaccctgaggtgaagacagcccacagcggccgctgtgccttctggggcaatgtggaggtgggcagagatgtgacagtgcctgagctgcgggaggcctaccacgctgtggtgctgtcctatggagctgaggaccaccgggccctggagatccctggagaggagctgcccggggtgtgcagcgcccgggcctttgtgggctggtacaacggcctgcctgagaaccaggagctggagccagacctgagctgtgacacagctgtgatcctgggccagggcaatgtggccctggatgtggcccgcatcctgctgaccccacctgagcacctggagaggacagacatcaccaaggccgccctgggcgtgctgcggcagagccgggtgaagacagtgtggctggtgggccggcggggccccctgcaggtggccttcaccatcaaggagctgcgggagatgatccagctgcccggggcccggcccatcctggaccctgtggacttcctgggcctgcaggacaagatcaaggaggtgccccggcccaggaagaggctgacagagctgctgctgaggacagccacagagaagccaggccctgctgaggccgcccggcaggccagcgccagccgggcctggggcctgcgcttcttccgcagcccccagcaggtgctgcccagcccagatggaagaagagctgctggggtgcggctggccgtgacccggctggagggcgtggatgaggccaccagggctgtgcccactggagacatggaggacctgccctgtggcctggtgctgagcagcatcggctacaagagcaggcctgtggaccccagcgtgccctttgacagcaagctgggcgtcatccccaacgtggagggccgggtgatggatgtgcccggcctgtactgcagcggctgggtgaagaggggccccaccggggtgattgccaccaccatgacagacagcttcctgaccggccagatgctgctgcaggacctgaaggccggcctgctgcccagcggcccccggcccggctatgctgccatccaggccctgctgagcagcagaggagtgcggcctgtgtccttcagtgactgggagaagctggatgctgaggaggtggcccggggccagggcaccgggaagccccgggagaagctggtggacccccaggagatgctgcggctgctgggccactag

SEQ ID NO: 152370 - DNA, 1881 bp, Artificial Sequence
  Description of Artificial Sequence: Synthetic coding sequence
atggctgtgtctggcttcaccctgggcacctgcatcctgctgctgcacatctcctatgtggccaactacccaaatggcaaggtgacccagagctgccacggcatgatccctgagcacggccacagcccccagagcgtgcctgtgcatgacatctacgtgtcccagatgaccttccggcctggggaccagatcgaggtgaccctgagcggccaccccttcaagggcttcctgctggaggccagaaatgctgaggacctgaatggaccacccatcggcagcttcaccctgattgattctgaggtgtcccagctgctgacctgtgaggacatccagggcagcgctgtgagccacaggtctgccagcaagaagacagagatcaaggtgtactggaatgcccccagcagcgcccccaaccacacccagttcctggtgacagtggtggagaagtacaagatctactgggtgaagatccctggccccatcatcagccagcccaatgccttccccttcaccacccccaaggccaccgtggtgcccctgcccaccctgccccctgtgagccacctgaccaagcccttcagcgccagtgactgtggcaacaagaagttctgcatccgcagccccctgaactgtgaccctgagaaggaggccagctgtgtgttcctgtccttcaccagagatgaccagagcgtgatggtggagatgagcggccccagcaagggctacctgagctttgccctgagccatgaccagtggatgggagatgatgatgcctacctgtgcatccacgaggaccagacagtgtacatccagcccagccacctgaccggccgcagccaccctgtgatggacagccgggacaccctggaggacatggcctggaggctggctgatggagtgatgcagtgcagcttcagaagaaacatcaccctgcccggggtgaagaacagatttgacctgaacaccagctactacatcttcctggctgatggagctgccaatgatggccgcatctacaagcacagccagcagcccctcatcacctatgagaagtatgatgtgacagacagccccaagaacattggaggcagccacagcgtgctgctgctgaaggtgcatggagccctgatgtttgtggcctggatgaccaccgtgtccattggagtgctggtggcccgcttcttcaagcctgtgtggagcaaggccttcctgctgggggaggccgcctggttccaggtgcacaggatgctgatgttcaccaccaccgtgctgacctgcatcgcctttgtgatgcccttcatctacagaggaggctggagcagacatgctggctaccacccctacctgggctgcatcgtgatgaccctggccgtgctgcagcccctgctggccgtgttccggccccccctgcatgacccccggcggcagatgttcaactggacccactggagcatgggcacagctgcccgcatcatcgctgtggccgccatgttcctgggcatggacctgcccggcctgaacctgcctgacagctggaagacctacgccatgacaggctttgtggcctggcacgtgggcacagaggtggtgctggagctgaagtactggatgatgacagagttccgctccttcagccacctgctgcagtggaagcagagggtgatgctgctgaagaggcagtgctggcagttcatgtctgtgggcatgctgctcttcagcagctacttctacctgcagagcaccatctatgagcaggccaagaccctggcctttgctggccaggtgatcatcatcatcaagcccaagaagctggaggcctgcccagactgcctggagcacatctgtgagttcagcctgggccgcctgggcagctgcctgtag

SEQ ID NO: 152371 - DNA, 1779 bp, Artificial Sequence
  Description of Artificial Sequence: Synthetic coding sequence
atggctgtgtctggcttcaccctgggcacctgcatcctgctgctgcacatctcctatgtggccaactacccaaatggcaaggtgacccagagctgccacggcatgatccctgagcacggccacagcccccagagcgtgcctgtgcatgacatctacgtgtcccagatgaccttccggcctggggaccagatcgaggtgaccctgagcggccaccccttcaagggcttcctgctggaggccagaaatgctgaggacctgaatggaccacccatcggcagcttcaccctgattgattctgaggtgtcccagctgctgacctgtgaggacatccagggcagcgctgtgagccacaggtctgccagcaagaagacagagatcaaggtgtactggaatgcccccagcagcgcccccaaccacacccagttcctggtgacagtggtggagaagtacaagatctactgggtgaagatccctggccccatcatcagccagcccaatgccttccccttcaccacccccaaggccaccgtggtgcccctgcccaccctgccccctgtgagccacctgaccaagcccttcagcgccagtgactgtggcaacaagaagttctgcatccgcagccccctgaactgtgaccctgagaaggaggccagctgtgtgttcctgtccttcaccagagatgaccagagcgtgatggtggagatgagcggccccagcaagggctacctgagctttgccctgagccatgaccagtggatgggagatgatgatgcctacctgtgcatccacgaggaccagacagtgtacatccagcccagccacctgaccggccgcagccaccctgtgatggacagccgggacaccctggaggacatggcctggaggctggctgatggagtgatgcagtgcagcttcagaagaaacatcaccctgcccggggtgaagaacagatttgacctgaacaccagctactacatcttcctggctgatggagctgccaatgatggccgcatctacaagcacagccagcagcccctcatcacctatgagaagtatgatgtgacagacagccccaagaacattggaggcagccacagcgtgctgctgctgaaggtgcatggagccctgatgtttgtggcctggatgaccaccgtgtccattggagtgctggtggcccgcttcttcaagcctgtgtggagcaaggccttcctgctgggggaggccgcctggttccaggtgcacaggatgctgatgttcaccaccaccgtgctgacctgcatcgcctttgtgatgcccttcatctacagaggaggctggagcagacatgctggctaccacccctacctgggctgcatcgtgatgaccctggccgtgctgcagcccctgctggccgtgttccggccccccctgcatgacccccggcggcagatgttcaactggacccactggagcatgggcacagctgcccgcatcatcgctgtggccgccatgttcctgggcatggacctgcccggcctgaacctgcctgacagctggaagacctacgccatgacaggctttgtggcctggcacgtgggcacagaggtggtgctggaggtgcacgcctaccgcctgagcaggaaggtggagatcctggatgatgaccgcatccagatcctgcagagcttcaccgctgtggagacagagggccacgccttcaagaaggctgtgctggccatctacgtgtgtggaaatgtgaccttcctgatcatcttcctgagcgccatcaaccacctgtag

SEQ ID NO: 152372 - DNA, 729 bp, Artificial Sequence
  Description of Artificial Sequence: Synthetic coding sequence
atgctgagctgcttccggctgctgagccgccacatcagccccagcctggccagcctgcggcctgtgcgctgctgctttgccctgcccctgcgctgggcccctggccggcccctggacccccggcagatcgccccccggcggcccctggccgccgccgccagcagccgggaccccactggacctgctgctggccccagccgggtgcggcagaacttccacccagacagcgaggccgccatcaaccggcagatcaacctggagctgtatgccagctatgtgtacctgtccatggcctactacttcagcagagatgatgtggccctgaacaacttcagccgctacttcctgcaccagagccgggaggagacagaacatgctgagaagctgatgaggctgcagaaccagagaggaggccgcatccggctgcaggacatcaagaagccagagcaggatgactgggagagcggcctgcacgccatggagtgtgccctgctgctggagaagaatgtgaaccagagcctgctggagctgcacgccctggccagtgacaagggggacccccacctgtgtgacttcctggagacctactacctgaatgagcaggtgaagagcatcaaggagctgggggaccacgtgcacaacctggtgaagatgggcgccccagatgctggcctggccgagtacctgtttgacacccacaccctgggcaatgaaaacaagcagaactag

SEQ ID NO: 152373 - DNA, 552 bp, Artificial Sequence
  Description of Artificial Sequence: Synthetic coding sequence
atgaccacagccagcaccagccaggtgcggcagaactaccaccaggacagcgaggccgccatcaaccggcagatcaacctggagctgtatgccagctatgtgtacctgtccatgagctactactttgacagagatgatgtggccctgaagaactttgccaagtacttcctgcaccagagccatgaggagcgggagcacgccgagaagctgatgaagctgcagaaccagaggggcggccgcatcttcctgcaggacatcaagaagccagactgtgatgactgggagagcggcctgaatgccatggagtgtgccctgcacctggagaagaatgtgaaccagagcctgctggagctgcacaagctggccacagacaagaatgacccccacctgtgtgacttcatcgagacccactacctgaatgagcaggtgaaggccatcaaggagctgggggaccacgtgaccaacctgaggaagatgggcgcccctgagagcggcctggccgagtacctgtttgacaagcacaccctgggggacagcgacaatgaaagctag

SEQ ID NO: 152374 - DNA, 699 bp, Artificial Sequence
  Description of Artificial Sequence: Synthetic coding sequence
tctggcttccctgccagcacagtgctgggcagaaatcctgccctggtgccccaccctggccggccccccatcgccagcccccccagccccctgcacaggaccctgggcctgccccagggcccccggcggctgagcctggtggccgccatgaccacagccagcaccagccaggtgcggcagaactaccaccaggacagcgaggccgccatcaaccggcagatcaacctggagctgtatgccagctatgtgtacctgtccatgagctactactttgacagagatgatgtggccctgaagaactttgccaagtacttcctgcaccagagccatgaggagcgggagcacgccgagaagctgatgaagctgcagaaccagagaggaggccgcatcttcctgcaggacatcaagaagccagactgtgatgactgggagagcggcctgaatgccatggagtgtgccctgcacctggagaagaatgtgaaccagagcctgctggagctgcacaagctggccacagacaagaatgacccccacctgtgtgacttcatcgagacccactacctgaatgagcaggtgaaggccatcaaggagctgggggaccacgtgaccaacctgaggaagatgggcgcccctgagagcggcctggccgagtacctgtttgacaagcacaccctgggggacagcgacaatgaaagctag

SEQ ID NO: 152375 - DNA, 462 bp, Artificial Sequence
  Description of Artificial Sequence: Synthetic coding sequence
atgaccacagccagcaccagccagagctactactttgacagagatgatgtggccctgaagaactttgccaagtacttcctgcaccagagccatgaggagcgggagcacgccgagaagctgatgaagctgcagaaccagaggggcggccgcatcttcctgcaggacatcaagaagccagactgtgatgactgggagagcggcctgaatgccatggagtgtgccctgcacctggagaagaatgtgaaccagagcctgctggagctgcacaagctggccacagacaagaatgacccccacctgtgtgacttcatcgagacccactacctgaatgagcaggtgaaggccatcaaggagctgggggaccacgtgaccaacctgaggaagatgggcgcccctgagagcggcctggccgagtacctgtttgacaagcacaccctgggggacagcgacaatgaaagctag

SEQ ID NO: 152376 - DNA, 552 bp, Artificial Sequence
  Description of Artificial Sequence: Synthetic coding sequence
atggccacagcccagcccagccaggtgcggcagaagtatgacaccaactgtgatgctgccatcaacagccacatcaccctggagctgtacaccagctacctgtacctgtccatggccttctacttcaacagagatgatgtggccctggagaacttcttccgctacttcctgcggctgagtgatgacaagatggagcacgcccagaagctgatgaggctgcagaacctgcggggcggccacatctgcctgcatgacatcaggaagccagagtgccagggctgggagagcggcctggtggccatggagagcgccttccacctggagaagaatgtgaaccagagcctgctggacctgtaccagctggccgtggagaagggggacccccagctgtgccacttcctggagagccactacctgcacgagcaggtgaagaccatcaaggagctgggcggctacgtgagcaacctgaggaagatctgcagccctgaggccggcctggccgagtacctgtttgacaagctgaccctgggcggccgggtgaaggagacctag

SEQ ID NO: 152377 - DNA, 528 bp, Artificial Sequence
  Description of Artificial Sequence: Synthetic coding sequence
atgagcagccagatccggcagaactacagcacagatgtggaggccgctgtgaacagcctggtgaacctgtacctgcaggccagctacacctacctgagcctgggcttctactttgacagagatgatgtggccctggagggcgtgagccacttcttccgggagctggccgaggagaagcgggagggctatgagcggctgctgaagatgcagaaccagaggggcggccgggccctcttccaggacatcaagaagccagcagaagatgagtggggcaagaccccagatgccatgaaggccgccatggccctggagaagaagctgaaccaggccctgctggacctgcacgccctgggcagcgccaggacagacccccacctgtgtgacttcctggagacccacttcctggatgaggaggtgaagctgatcaagaagatgggagaccacctgaccaacctgcaccggctgggcggccctgaggccggcctgggggagtacctgtttgagcggctgaccctgaagcatgactag

SEQ ID NO: 152378 - DNA, 573 bp, Artificial Sequence
  Description of Artificial Sequence: Synthetic coding sequence
atgagcagccagatccggcagaactacagcacagatgtggaggccgctgtgaacagcctggtgaacctgtacctgcaggccagctacacctacctgagcctgggcttctactttgacagagatgatgtggccctggagggcgtgagccacttcttccgggagctggccgaggagaagcgggagggctatgagcggctgctgaagatgcagaaccagaggggcggccgggccctcttccaggacatcaagaagccagcagaagatgagtggggcaagaccccagatgccatgaaggccgccatggccctggagaagaagctgaaccaggccctgctggacctgcacgccctgggcagcgccaggacagacccccacctgtgtgacttcctggagacccacttcctggatgaggaggtgaagctgatcaagaagatgggagaccacctgaccaacctgcaccggctgggcggccctgaggccggcctgggggagtacctgagcaagggcagcctgagcagcaccaccaagagcctgctgagccctgccaccagcgagggccccctggccaagtag

SEQ ID NO: 152379 - DNA, 1272 bp, Artificial Sequence
  Description of Artificial Sequence: Synthetic coding sequence
atgaggagcctgggcgccaacatggccgccgccctgcgggctgctggggtgctgctgcgggaccccctggccagcagctcctggagggtgtgccagccctggcgctggaagagcggggctgctgctgctgctgtgaccacagaaacagcccagcacgcccagggcgccaagccccaggtgcagccccagaagaggaagcccaagacaggcatcctgatgctgaacatgggcggccctgagaccctgggagatgtgcatgacttcctgctgcggctcttcctggaccgggacctgatgaccctgcccatccagaacaagctggcccccttcatcgccaagaggaggacccccaagatccaggagcagtaccgccgcatcggcggcggcagccccatcaagatctggaccagcaagcagggcgagggcatggtgaagctgctggatgagctgagccccaacacagccccccacaagtactacatcggcttccgctacgtgcaccccctgacagaggaggccatcgaggagatggagagagatggcctggagcgggccatcgccttcacccagtacccccagtacagctgcagcaccaccggcagcagcctgaatgccatctaccgctactacaaccaggtgggcaggaagcccaccatgaagtggagcaccatcgaccgctggcccacccaccacctgctgatccagtgctttgctgaccacatcctgaaggagctggaccacttccccctggagaagaggtctgaggtggtgatcctcttcagcgcccacagcctgcccatgtctgtggtgaacagaggagacccctacccccaggaggtgtctgccaccgtgcagaaggtgatggagcggctggagtactgcaacccctaccgcctggtgtggcagagcaaggtgggccccatgccctggctgggcccccagacagatgagagcatcaagggcctgtgtgagcggggcaggaagaacatcctgctggtgcccatcgccttcaccagtgaccacatcgagaccctgtatgagctggacatcgagtacagccaggtgctggccaaggaatgtggggtggagaacatccggcgggcagagagcctgaatggaaaccccctcttcagcaaggccctggccgacctggtgcacagccacatccagagcaatgagctgtgcagcaagcagctgaccctgagctgccccctgtgtgtgaaccctgtgtgccgggagaccaagagcttcttcaccagccagcagctgtag

SEQ ID NO: 152380 - DNA, 1290 bp, Artificial Sequence
  Description of Artificial Sequence: Synthetic coding sequence
atgaggagcctgggcgccaacatggccgccgccctgcgggctgctggggtgctgctgcgggaccccctggccagcagctcctggagggtgtgccagccctggcgctggaagagcggggctgctgctgctgctgtgaccacagaaacagcccagcacgcccagggcgccaagccccaggtgcagccccagaagagatatgagagcaacatcaggaagcccaagacaggcatcctgatgctgaacatgggcggccctgagaccctgggagatgtgcatgacttcctgctgcggctcttcctggaccgggacctgatgaccctgcccatccagaacaagctggcccccttcatcgccaagaggaggacccccaagatccaggagcagtaccgccgcatcggcggcggcagccccatcaagatctggaccagcaagcagggcgagggcatggtgaagctgctggatgagctgagccccaacacagccccccacaagtactacatcggcttccgctacgtgcaccccctgacagaggaggccatcgaggagatggagagagatggcctggagcgggccatcgccttcacccagtacccccagtacagctgcagcaccaccggcagcagcctgaatgccatctaccgctactacaaccaggtgggcaggaagcccaccatgaagtggagcaccatcgaccgctggcccacccaccacctgctgatccagtgctttgctgaccacatcctgaaggagctggaccacttccccctggagaagaggtctgaggtggtgatcctcttcagcgcccacagcctgcccatgtctgtggtgaacagaggagacccctacccccaggaggtgtctgccaccgtgcagaaggtgatggagcggctggagtactgcaacccctaccgcctggtgtggcagagcaaggtgggccccatgccctggctgggcccccagacagatgagagcatcaagggcctgtgtgagcggggcaggaagaacatcctgctggtgcccatcgccttcaccagtgaccacatcgagaccctgtatgagctggacatcgagtacagccaggtgctggccaaggaatgtggggtggagaacatccggcgggcagagagcctgaatggaaaccccctcttcagcaaggccctggccgacctggtgcacagccacatccagagcaatgagctgtgcagcaagcagctgaccctgagctgccccctgtgtgtgaaccctgtgtgccgggagaccaagagcttcttcaccagccagcagctgtag

SEQ ID NO: 152381 - DNA, 1149 bp, Artificial Sequence
  Description of Artificial Sequence: Synthetic coding sequence
atgggcctgctgctgcccctggccctgtgcatcctggtgctgtgctgcggggccatgagccccccccagctggccctgaaccccagcgccctgctgagccggggctgcaatgacagtgatgtgctggccgtggccggctttgccctgcgggacatcaacaaggacaggaaggatggctacgtgctgcggctgaacagagtgaatgatgcccaggagtaccgccggggcggcctgggcagcctcttctacctgaccctggatgtgctggagacagactgccacgtgctgaggaagaaggcctggcaggactgtggcatgaggatcttctttgagagcgtgtatggccagtgcaaggccatcttctacatgaacaaccccagccgggtgctgtacctggccgcctacaactgcaccctgcggcctgtgtccaagaagaagatctacatgacctgcccagactgccccagcagcatccccacagacagcagcaaccaccaggtgctggaggccgccacagagagcctggccaagtacaacaatgaaaacaccagcaagcagtacagcctcttcaaggtgacccgggccagcagccagtgggtggtgggccccagctactttgtggagtacctgatcaaggagagcccctgcaccaagagccaggccagcagctgcagcctgcagagcagtgacagcgtgcctgtgggcctgtgcaagggcagcctgaccaggacccactgggagaagtttgtgtctgtgacctgtgacttctttgagagccaggccccagccaccggctctgaaaattctgctgtgaaccagaagcccaccaacctgcccaaggtggaggagagccagcagaagaacaccccacccacagacagccccagcaaggccggcccccggggctctgtgcagtacctgcctgacctggatgacaagaacagccaggagaagggcccccaggaggccttccctgtgcacctggacctgaccaccaacccccagggcgagaccctggacatctccttcctgttcctggagcccatggaggagaagctggtggtgctgcccttccccaaggagaaggccaggacagcagaatgtcctggccctgcccagaatgccagccccctggtgctgcccccatag

SEQ ID NO: 152382 - DNA, 1149 bp, Artificial Sequence; identical to SEQ ID NO: 152381
  Description of Artificial Sequence: Synthetic coding sequence

SEQ ID NO: 152383 - DNA, 705 bp, Artificial Sequence
  Description of Artificial Sequence: Synthetic coding sequence
atgacctgcccagactgccccagcagcatccccacagacagcagcaaccaccaggtgctggaggccgccacagagagcctggccaagtacaacaatgaaaacaccagcaagcagtacagcctcttcaaggtgacccgggccagcagccagtgggtggtgggccccagctactttgtggagtacctgatcaaggagagcccctgcaccaagagccaggccagcagctgcagcctgcagagcagtgacagcgtgcctgtgggcctgtgcaagggcagcctgaccaggacccactgggagaagtttgtgtctgtgacctgtgacttctttgagagccaggccccagccaccggctctgaaaattctgctgtgaaccagaagcccaccaacctgcccaaggtggaggagagccagcagaagaacaccccacccacagacagccccagcaaggccggcccccggggctctgtgcagtacctgcctgacctggatgacaagaacagccaggagaagggcccccaggaggccttccctgtgcacctggacctgaccaccaacccccagggcgagaccctggacatctccttcctgttcctggagcccatggaggagaagctggtggtgctgcccttccccaaggagaaggccaggacagcagaatgtcctggccctgcccagaatgccagccccctggtgctgcccccatag

SEQ ID NO: 152384 - DNA, 717 bp, Artificial Sequence
  Description of Artificial Sequence: Synthetic coding sequence
atgaggcagagcggggccagccagcccctgctgatcaacatgtacctgcctgaccctgtgggagatggcctcttcaaggatggcaagaaccccagctggggccccctgagccctgctgtgcagaagggcagcggccagatccagctgtggcagttcctgctggagctgctggccgaccgggccaatgccggctgcatcgcctgggagggcggccacggggagttcaagctgacagatcctgatgaggtggcccggcgctggggcgagaggaagagcaagcccaacatgaactatgacaagctgagccgggccctgcgctactactatgacaagaacatcatgagcaaggtgcacggcaagagatatgcctacagatttgacttccagggcctggcccaggcctgccagcccccaccagcccacgcccacgccgctgctgctgctgctgctgctgctgctgctgcccaggatggagccctgtacaagctgcctgctggcctggcccccctgcccttccctggcctgagcaagctgaacctgatggccgccagcgctggggtggccccagctggcttctcctactggccaggccctggccctgctgccacagctgctgctgccacagctgccctgtaccccagccccagcctgcagcccccacctggcccctttggagctgtggccgccgccagccacctgggcggccactaccactag

SEQ ID NO: 152385 - DNA, 1416 bp, Artificial Sequence
  Description of Artificial Sequence: Synthetic coding sequence
atggacagcagctgccacaatgccaccaccaagatgctggccacagccccagcccggggcaacatgatgagcaccagcaagcccctggccttcagcattgagcgcatcatggcccggaccccagagcccaaggccctgcctgtgccccacttcctgcagggcgccctgcccaagggggagcccaagcacagcctgcacctgaacagcagcatcccctgcatgatcccctttgtgcctgtggcctatgacaccagccccaaggccggcgtgactggaagtgagcccaggaaggccagcctggaggccccagctgccccagctgctgtgcccagcgccccagccttcagctgcagcgacctgctgaactgtgccctgagcctgaagggggacctggccagagatgccctgcccctgcagcagtacaagctggtgcggccccgggtggtgaaccacagcagcttccacgccatgggcgccctgtgctacctgaacagaggagatggcccctgccaccctgctgctggggtgaacatccaccctgtggccagctacttcctgagcagccccctgcacccccagcccaagacctacctggccgagaggaacaagctggtggtgcctgctgtggagaagtaccccagcggcgtggccttcaaggacctgagccaggcccagctgcagcactacatgaaggagagcgcccagctgctgtctgagaagatcgccttcaagaccagtgacttcagccggggcagccccaatgccaagcccaaggtgttcacctgtgaggtgttcaatgcccactacaacctgaccaggcacatgcctgtgcacactggagcccggccctttgtgtgcaaggtgtgtgggaagggcttccggcaggccagcaccctgtgccgccacaagatcatccacacccaggagaagccccacaagtgcaaccagtgtgggaaggccttcaacagaagcagcaccctgaacacccacacccgcatccatgctggctacaagccctttgtgtgtgagttctgtgggaagggcttccaccagaagggcaactacaagaaccacaagctgacccacagcggggagaagcagttcaagtgcaacatctgcaacaaggccttccaccaggtgtacaacctgaccttccacatgcacacccacaatgacaagaagcccttcacctgccccacctgtgggaagggcttctgcaggaactttgacctgaagaagcacgtgaggaagctgcatgacagcagcctgggcctggcccggaccccagctggggagcctggaacagagcccccaccacccctgccccagcagccccccatgaccctgccccccctgcagccccccctgcccaccccaggccccctgcagcccggcctgcaccagggccaccagtag

SEQ ID NO: 152386 - DNA, 108 bp, Artificial Sequence
  Description of Artificial Sequence: Synthetic coding sequence
atggacagcagctgccacaatgccaccaccaagatgctggccacagccccagcccggggcaacatgatgagcaccagcaagcccctggccttcagcattgaaagatag

SEQ ID NO: 152387 - DNA, 1278 bp, Artificial Sequence
  Description of Artificial Sequence: Synthetic coding sequence
atggacagcagctgccacaatgccaccaccaagatgctggccacagccccagcccggggcaacatgatgagcaccagcaagcccctggccttcagcattgagcgcatcatggcccggaccccagagcccaaggccctgcctgtgccccacttcctgcagggcgccctgcccaagggggagcccaagcacagcctgcacctgaacagcagcatcccctgcatgatcccctttgtgcctgtggcctatgacaccagccccaaggccggcgtgactggaagtgagcccaggaaggccagcctggaggccccagctgccccagctgctgtgcccagcgccccagccttcagctgcagcgacctgctgaactgtgccctgagcctgaagggggacctggccagagatgccctgcccctgcagcagtacaagctgcccaagacctacctggccgagaggaacaagctggtggtgcctgctgtggagaagtaccccagcggcgtggccttcaaggacctgagccaggcccagctgcagcactacatgaaggagagcgcccagctgctgtctgagaagatcgccttcaagaccagtgacttcagccggggcagccccaatgccaagcccaaggtgttcacctgtgaggtgtgtgggaaggtgttcaatgcccactacaacctgaccaggcacatgcctgtgcacactggagcccggccctttgtgtgcaaggtgtgtgggaagggcttccggcaggccagcaccctgtgccgccacaagatcatccacacccaggagaagccccacaagtgcaaccagtgtgggaaggccttcaacagaagcagcaccctgaacacccacacccgcatccatgctggctacaagccctttgtgtgtgagttctgtgggaagggcttccaccagaagggcaactacaagaaccacaagctgacccacagcggggagaagcagttcaagtgcaacatctgcaacaaggccttccaccaggtgtacaacctgaccttccacatgcacacccacaatgacaagaagcccttcacctgccccacctgtgggaagggcttctgcaggaactttgacctgaagaagcacgtgaggaagctgcatgacagcagcctgggcctggcccggaccccagctggggagcctggaacagagcccccaccacccctgccccagcagccccccatgaccctgccccccctgcagccccccctgcccaccccaggccccctgcagcccggcctgcaccagggccaccagtag

SEQ ID NO: 152388 - DNA, 1428 bp, Artificial Sequence
  Description of Artificial Sequence: Synthetic coding sequence
atggacagcagctgccacaatgccaccaccaagatgctggccacagccccagcccggggcaacatgatgagcaccagcaagcccctggccttcagcattgagcgcatcatggcccggaccccagagcccaaggccctgcctgtgccccacttcctgcagggcgccctgcccaagggggagcccaagcacagcctgcacctgaacagcagcatcccctgcatgatcccctttgtgcctgtggcctatgacaccagccccaaggccggcgtgactggaagtgagcccaggaaggccagcctggaggccccagctgccccagctgctgtgcccagcgccccagccttcagctgcagcgacctgctgaactgtgccctgagcctgaagggggacctggccagagatgccctgcccctgcagcagtacaagctggtgcggccccgggtggtgaaccacagcagcttccacgccatgggcgccctgtgctacctgaacagaggagatggcccctgccaccctgctgctggggtgaacatccaccctgtggccagctacttcctgagcagccccctgcacccccagcccaagacctacctggccgagaggaacaagctggtggtgcctgctgtggagaagtaccccagcggcgtggccttcaaggacctgagccaggcccagctgcagcactacatgaaggagagcgcccagctgctgtctgagaagatcgccttcaagaccagtgacttcagccggggcagccccaatgccaagcccaaggtgttcacctgtgaggtgtgtgggaaggtgttcaatgcccactacaacctgaccaggcacatgcctgtgcacactggagcccggccctttgtgtgcaaggtgtgtgggaagggcttccggcaggccagcaccctgtgccgccacaagatcatccacacccaggagaagccccacaagtgcaaccagtgtgggaaggccttcaacagaagcagcaccctgaacacccacacccgcatccatgctggctacaagccctttgtgtgtgagttctgtgggaagggcttccaccagaagggcaactacaagaaccacaagctgacccacagcggggagaagcagttcaagtgcaacatctgcaacaaggccttccaccaggtgtacaacctgaccttccacatgcacacccacaatgacaagaagcccttcacctgccccacctgtgggaagggcttctgcaggaactttgacctgaagaagcacgtgaggaagctgcatgacagcagcctgggcctggcccggaccccagctggggagcctggaacagagcccccaccacccctgccccagcagccccccatgaccctgccccccctgcagccccccctgcccaccccaggccccctgcagcccggcctgcaccagggccaccagtag

SEQ ID NO: 152389 - DNA, 1380 bp, Artificial Sequence
  Description of Artificial Sequence: Synthetic coding sequence
atggccagcagcgccagcctggagaccatggtgcccccagcctgcccccgggccggggccagccctgccaccagcaagaccctggccttcagcattgaaagaatcatggccaagaccagcgagccccgggccccctttgagcccaggcctggggccctggaggctgatggcagccagggcaagaagctgctgaacctgtgcagccccctgccctgcatgatccccctgcagcccctgggctatgaggtgcccagcaagaccctgctgagctacagcgagctgtggaagagcagcctgcgggccggcggcggcggcggcggcggcggcggcggcggcggcggcggcggcggggcccctgtgtgtggggccagcggcctgtgcaagaccaactgtggggtgtgctgcaaggccgagctgggcctggcccccagcgccctgcctgctggccgggtcatcaagccccaggtgatcaaccaggccgtgggcctgcctgccagcggcagcctgtactacttcaactacctggacagcacagcctacccaccttctgagctgctgagcggccacctgttccccagcggcctgctgaatgcccaggccccagctgccctggccgcccaccccaagctgttcctgctggagaatgccaagctggccggcctggccgctgacaagttcccccacccagccccctacccccacaaggagcggctgcctgcccccctggagcaggtgctgaaggagaacagcgccctgacagctgagcggggcggcgtgaagggccacagcaagctgcccggcggcagcgcagatggcaagcccaagaacttcacctgtgaggtgtgtgggaaggtgttcaatgcccactacaacctgaccaggcacatgcctgtgcacactggagcccggccctttgtgtgcaaggtgtgtgggaagggcttccggcaggccagcaccctgtgccgccacaagatcatccacacccaggagaagccccacaagtgcaaccagtgtgggaaggccttcaacagaagcagcaccctgaacacccacatccgcatccacgccggctacaagccctttgtgtgtgagttctgtgggaagggcttccaccagaagggcaactacaagaaccacaagctgacccacagcggggagaagcagtacaagtgcaccatctgcaacaaggccttccaccaggtgtacaacctgaccttccacatgcacacccacaatgacaagaagcccttcacctgtgccacctgtgggaagggcttctgcaggaactttgacctgaagaagcacgtgaggaagctgcatgacagcgtgggccctgctgcccccagcgccaaggacctgaccaggacagtgcagagctag

SEQ ID NO: 152390 - DNA, 1380 bp, Artificial Sequence; identical to SEQ ID NO: 152389
  Description of Artificial Sequence: Synthetic coding sequence

SEQ ID NO: 152391 - DNA, 1380 bp, Artificial Sequence; identical to SEQ ID NO: 152389
  Description of Artificial Sequence: Synthetic coding sequence

SEQ ID NO: 152392 - DNA, 1140 bp, Artificial Sequence
  Description of Artificial Sequence: Synthetic coding sequence
atggccgccacagctgctgctgtggtggccgaggaggacacagagctgcgggacctgctggtgcagaccctggagaacagcggcgtgctgaaccgcatcaaggccgagctgcgggctgctgtgttcctggccctggaggagcaggagaaggtggagaacaagacccccctggtgaatgaaagcctgaagaagttcctgaacaccaaggatggccgcctggtggccagcctggtggccgagttcctgcagttcttcaacctggacttcaccctggccgtgttccagcctgagaccagcaccctgcagggcctggagggccgggagaacctggcccgggacctgggcatcattgaagctgagggcaccgtgggcggccccctgctgctggaggtgatccgccgctgccagcagaaggagaagggccccaccaccggggagggcgccctggacctgagtgatgtgcacagcccccccaagagccctgagggcaagaccagcgcccagaccacccccagcaagaaggccaatgatgaggccaaccagagcgacacctctgtgtccctgtctgagcccaagagcaagagcagcctgcacctgctgagccatgagaccaagattggcagcttcctgagcaacagaaccctggatggcaaggacaaggccggcctgtgcccagatgaagatgacatggagggggacagcttctttgatgaccccatccccaagccagagaagacctacggcctgaggaaggagcccaggaagcaggccggcagcctggccagcctgagtgatgccccacccctgaagagcggcctgagcagcctggccggggcccccagcctgaaggacagcgagagcaagaggggcaacacagtgctgaaggacctgaagctgatcagtgacaagattggcagcctgggcctgggcactggagaagatgatgattatgtggatgacttcaacagcaccagccacaggtctgagaagtctgagatcagcattggagaggagattgaggaggacctgtctgtggagattgatgacatcaacaccagtgacaagctggatgacctgacccaggacctgactgtgtcccagctgagtgatgtggccgactacctggaggatgtggcctag

SEQ ID NO: 152393 - DNA, 1200 bp, Artificial Sequence
  Description of Artificial Sequence: Synthetic coding sequence
atggccgccacagctgctgctgtggtggccgaggaggacacagagctgcgggacctgctggtgcagaccctggagaacagcggcgtgctgaaccgcatcaaggccgagctgcgggctgctgtgttcctggccctggaggagcaggagaaggtggagaacaagacccccctggtgaatgaaagcctgaagaagttcctgaacaccaaggatggccgcctggtggccagcctggtggccgagttcctgcagttcttcaacctggacttcaccctggccgtgttccagcctgagaccagcaccctgcagggcctggagggccgggagaacctggcccgggacctgggcatcattgaagctgagggcaccgtgggcggccccctgctgctggaggtgatccgccgctgccagcagaaggagaagggccccaccaccggggagggcgccctggacctgagtgatgtgcacagcccccccaagagccctgagggcaagaccagcgcccagaccacccccagcaagatcccccgctacaagggccagggcaagaagaagaccagcggccagaaggccggggacaagaaggccaatgatgaggccaaccagagcgacacctctgtgtccctgtctgagcccaagagcaagagcagcctgcacctgctgagccatgagaccaagattggcagcttcctgagcaacagaaccctggatggcaaggacaaggccggcctgtgcccagatgaagatgacatggagggggacagcttctttgatgaccccatccccaagccagagaagacctacggcctgaggaaggagcccaggaagcaggccggcagcctggccagcctgagtgatgccccacccctgaagagcggcctgagcagcctggccggggcccccagcctgaaggacagcgagagcaagaggggcaacacagtgctgaaggacctgaagctgatcagtgacaagattggcagcctgggcctgggcactggagaagatgatgattatgtggatgacttcaacagcaccagccacaggtctgagaagtctgagatcagcattggagaggagattgaggaggacctgtctgtggagattgatgacatcaacaccagtgacaagctggatgacctgacccaggacctgactgtgtcccagctgagtgatgtggccgactacctggaggatgtggcctag

SEQ ID NO: 152394 - DNA, 1095 bp, Artificial Sequence
  Description of Artificial Sequence: Synthetic coding sequence
atggccgccacagctgctgctgtggtggccgaggaggacacagagctgcgggacctgctggtgcagaccctggagaacagcggcgtgctgaaccgcatcaaggccgagctgcgggctgctgtgttcctggccctggaggagcaggagaaggtggagaacaagacccccctggtgaatgaaagcctgaagaagttcctgaacaccaaggatggccgcctggtggccagcctggtggccgagttcctgcagttcttcaacctggacttcaccctggccgtgttccagcctgagaccagcaccctgcagggcctggagggccgggagaacctggcccgggacctgggcatcattgaagctgagggcaccgtgggcggccccctgctgctggaggtgatccgccgctgccagcagaaggagaagggccccaccaccggggagaaggccaatgatgaggccaaccagagcgacacctctgtgtccctgtctgagcccaagagcaagagcagcctgcacctgctgagccatgagaccaagattggcagcttcctgagcaacagaaccctggatggcaaggacaaggccggcctgtgcccagatgaagatgacatggagggggacagcttctttgatgaccccatccccaagccagagaagacctacggcctgaggaaggagcccaggaagcaggccggcagcctggccagcctgagtgatgccccacccctgaagagcggcctgagcagcctggccggggcccccagcctgaaggacagcgagagcaagaggggcaacacagtgctgaaggacctgaagctgatcagtgacaagattggcagcctgggcctgggcaccggggaggatgatgattatgtggatgacttcaacagcaccagccacaggtctgagaagtctgagatcagcatcggggaggagattgaggaggacctgtctgtggagattgatgacatcaacaccagtgacaagaccatcacccagctggagtgcctgctgagcattggagccctgcacttcaagaacacagctgacatcttcaaggtgatcttcatcctgctgaacaagatcctgcccatctag

SEQ ID NO: 152395 - DNA, 420 bp, Artificial Sequence
  Description of Artificial Sequence: Synthetic coding sequence
atgagcagcctgcctgtgccctacaagctgcctgtgtccctgtctgtgggcagctgtgtgatcatcaagggcacccccatccacagcttcatcaatgacccccagctgcaggtggacttctacacagacatggatgaggacagcgacatcgccttccgcttccgggtgcacttcggcaaccacgtggtgatgaacagaagagaatttggcatctggatgctggaggagaccacagattatgtgccctttgaagatggcaagcagtttgagctgtgcatctacgtgcactacaatgaatatgagatcaaggtgaatggcatccgcatctacggctttgtgcaccgcatccccccatcctttgtgaagatggtgcaggtgtcccgggacatcagcctgacctctgtgtgtgtgtgcaactag

SEQ ID NO: 152396 - DNA, 8616 bp, Artificial Sequence
  Description of Artificial Sequence: Synthetic coding sequence
atgaggcggggccgcctgctggagatcgccctgggcttcaccgtgctgctggccagctacaccagccatggagcagatgccaacctggaggccggaaatgtgaaggagacccgggccagccgggccaagaggcggggcggcggcggccatgatgccctgaagggccccaacgtgtgtggcagccgctacaatgcctactgctgccccggctggaagaccctgcccggcggcaaccagtgcatcgtgcccatctgccgccacagctgtggagatggcttctgcagccggcccaacatgtgcacctgccccagcggccagatcgcccccagctgtggcagccgcagcatccagcactgcaacatccgctgcatgaatggaggcagctgcagtgatgaccactgcctgtgccagaagggctacatcggcacccactgcggccagcctgtgtgtgagagcggctgcctgaatggaggccgctgtgtggcccccaacagatgtgcctgcacctacggcttcaccggcccccagtgtgagcgggactacagaacaggcccctgcttcaccgtcatcagcaaccagatgtgccagggccagctgagcggcatcgtgtgcaccaagaccctgtgctgtgccaccgtgggccgggcctggggccacccctgtgagatgtgcccagcccagccccacccctgccggcggggcttcatccccaacatcagaactggagcctgccaggatgtggatgagtgccaggccatccctggcctgtgccagggcggcaactgcatcaacacagtgggcagctttgagtgcaagtgcccagctggccacaagctgaatgaggtgtcccagaagtgtgaagatattgatgaatgttccaccatccctggcatctgtgagggcggagaatgtaccaacacagtgagcagctacttctgcaagtgccccccaggcttctacaccagcccagatggcacccgctgcattgatgtgcggcccggctactgctacacagccctgaccaacggccgctgcagcaaccagctgccccagagcatcaccaagatgcagtgctgctgtgatgctggccgctgctggagccctggggtgacagtggcccctgagatgtgccccatccgggccacagaggacttcaacaagctgtgcagcgtgcccatggtgattcctggccggcctgagtacccacctccacccctgggccccatcccccctgtgctgcctgtgcccccaggcttccccccaggcccccagatccctgtgccccggccccctgtggagtacctgtaccccagccgggagcccccccgggtgctgcctgtgaatgtgacagactactgccagctggtgcgctacctgtgccagaatggccgctgcatccccaccccaggcagctgccgctgtgagtgcaacaagggcttccagctggacctgcggggagaatgtattgatgtggatgaatgtgagaagaacccctgtgctggaggagagtgcatcaacaaccagggcagctacacctgccagtgcagagctggctaccagagcaccctgaccaggacagaatgtcgggacattgatgaatgtctgcagaatggccgcatctgcaacaacggccgctgcatcaacacagatggcagcttccactgtgtgtgcaatgccggcttccacgtgaccagagatggcaagaactgtgaggacatggatgaatgttccatccggaacatgtgcctgaatggcatgtgcatcaatgaagatggcagcttcaagtgcatctgcaagccaggcttccagctggccagtgatggccgctactgcaaggacatcaatgaatgtgagaccccaggcatctgcatgaatggccgctgtgtgaacacagatggcagctaccgctgtgagtgcttccctggcctggccgtgggcctggatggccgggtgtgtgtggacacccacatgaggagcacctgctacggcggctacaagaggggccagtgcatcaagcccctgtttggagctgtgaccaagtctgagtgctgctgtgccagcacagaatatgccttcggggagccctgccagccctgcccagcccagaacagcgctgagtaccaggccctgtgcagcagcggccctggcatgaccagcgctggcagtgacatcaatgaatgtgccctggaccctgacatctgccccaacggcatctgtgagaacctgcggggcacctacaagtgcatctgcaacagcggctatgaggtggacagcacaggcaagaactgtgtggacatcaatgaatgtgtgctgaacagcctgctgtgtgacaatggccagtgcaggaacaccccaggcagctttgtgtgcacctgccccaagggcttcatctacaagccagacctgaagacctgtgaggacattgatgaatgtgagagcagcccctgcatcaacggggtgtgcaagaacagccctggcagcttcatctgtgaatgtagcagcgagagcaccctggaccccaccaagaccatctgcatcgagaccatcaagggcacctgctggcagacagtgattgatggccgctgtgagatcaacatcaatggagccaccctgaagagccagtgctgcagcagcctgggcgccgcctggggcagcccctgcaccctgtgccaggtggaccccatctgtgggaagggctacagccgcatcaagggcacccagtgtgaagatattgatgaatgtgaggtgtttcctggggtgtgcaagaatggcctgtgtgtgaacacccggggcagcttcaagtgccagtgccccagcggcatgaccctggatgccaccggccgcatctgcctggacatccggctggagacctgcttcctgcgctatgaagatgaggagtgcaccctgcccatcgccggccgccacaggatggatgcctgctgctgcagcgtgggcgccgcctggggcacagaggagtgtgaagaatgtcccatgaggaacaccccagaatatgaggagctgtgcccccggggccctggctttgccaccaaggagatcaccaacgggaagcccttcttcaaggacatcaatgaatgcaagatgatccccagcctgtgcacccatggaaaatgtagaaacaccatcggcagcttcaagtgccgctgtgacagcggctttgccctggacagcgaggagaggaactgcacagacattgatgaatgtcgcatcagcccagacctgtgtggccggggccagtgtgtgaacacccctggggactttgagtgcaagtgtgatgagggctatgaaagtggcttcatgatgatgaagaactgcatggacattgatgagtgccagagggaccccctgctgtgccggggcggcgtgtgccacaacacagagggcagctaccgctgtgaatgtcctcctggccaccagctgagccccaacatcagcgcctgcatcgacatcaatgaatgtgagctgagcgcccacctgtgccccaacggccgctgtgtgaacctgattggcaagtaccagtgtgcctgcaaccctggctaccacagcaccccagacaggctcttctgtgtggacattgatgagtgcagcatcatgaatggaggctgtgagaccttctgcaccaacagcgagggcagctatgagtgcagctgccagcccggctttgccctgatgccagaccagaggagctgcacagacattgatgaatgtgaggacaaccccaacatctgtgatggcggccagtgcaccaacatccctggagagtaccgctgcctgtgctatgatggcttcatggccagcgaggacatgaagacctgtgtggatgtgaatgaatgtgacctgaaccccaacatctgcctgagcggcacctgtgagaacaccaagggcagcttcatctgccactgtgacatgggctacagcggcaagaagggcaagacaggctgcacagacatcaatgaatgtgagatcggggcccacaactgtgggaagcatgctgtgtgcaccaacacagctggcagcttcaagtgcagctgcagccctggctggattggagatggcatcaagtgcacagacctggatgagtgcagcaatggcacccacatgtgcagccagcacgccgactgcaagaacaccatgggcagctaccgctgcctgtgcaaggagggctacacaggagatggcttcacctgcacagacctggatgaatgttctgagaacctgaacctgtgtggaaatggccagtgcctgaatgcccctgggggctaccgctgtgaatgtgacatgggctttgtgcccagcgcagatggcaaggcctgtgaagatattgatgaatgttccctgcccaacatctgtgtgtttggcacctgccacaacctgcccggcctcttccgctgtgaatgtgagatcggctatgagctggacagaagtggcggcaactgcacagatgtgaatgaatgtctggaccccaccacctgcatcagcggcaactgtgtgaacaccccaggcagctacatctgtgactgccccccagactttgagctgaaccccaccagggtgggctgtgtggacaccaggagcggcaactgctacctggacatccggcccaggggggacaacggggacacagcctgcagcaatgaaattggagtgggcgtgtccaaggccagctgctgctgcagcctgggcaaggcctggggcaccccctgtgagatgtgcccagctgtgaacaccagcgagtacaagatcctgtgccctggaggagagggcttccggcccaaccccatcaccgtcatcctggaggacattgatgagtgccaggagctgcccggcctgtgccagggcggcaagtgcatcaacaccttcggcagcttccagtgccgctgccccaccggctactacctgaatgaagacaccagggtgtgtgatgatgtgaatgaatgtgagaccccaggcatctgtggccctggcacctgctacaacacagtgggcaactacacctgcatctgccccccagactacatgcaggtgaatggaggcaacaactgcatggacatgagaagaagcctgtgctacagaaactactatgctgacaaccagacctgtgatggagagctgctcttcaacatgaccaagaagatgtgctgctgcagctacaacatcggccgggcctggaacaagccctgtgagcagtgccccatccccagcacagatgaatttgccaccctgtgtggcagccagaggcctggctttgtgattgacatctacacaggcctgcctgtggacattgatgaatgtcgggagatccctggggtgtgtgaaaatggagtgtgcatcaacatggtgggcagcttccgctgtgagtgccctgtgggcttcttctacaatgacaagctgctggtgtgtgaagatattgatgagtgccagaatggacctgtgtgccagagaaatgctgagtgcatcaacacagctggcagctaccgctgtgactgcaagccaggctaccgcttcaccagcacaggccagtgcaatgacagaaatgaatgccaggagatccccaacatctgcagccacggccagtgcatcgacacagtgggcagcttctactgcctgtgccacacaggcttcaagaccaatgatgaccagaccatgtgcctggacatcaatgaatgtgaaagagatgcctgtggaaatggcacctgcaggaacaccatcggcagcttcaactgccgctgcaaccacggcttcatcctgagccacaacaatgactgcattgatgtggatgaatgtgccagcggaaatggaaacctgtgcagaaatggccagtgcatcaacacagtgggcagcttccagtgccagtgcaatgaaggctatgaggtggccccagatggccgcacctgtgtggacatcaatgaatgtctgctggagcccaggaaatgtgcccctggcacctgccagaacctggatggcagctaccgctgcatctgccccccaggctacagcctgcagaatgagaagtgtgaggacattgatgaatgtgtggaggagcctgagatctgtgccctgggcacctgcagcaacacagagggcagcttcaagtgcctgtgcccagagggcttcagcctgagcagcagtggaagacgctgccaggacctgaggatgagctactgctacgccaagtttgaaggaggcaagtgcagcagccccaagagcaggaaccacagcaagcaggagtgctgctgtgccctgaagggggagggctggggagacccctgtgagctgtgccccacagagccagatgaggccttccggcagatctgcccctacggcagcggcatcatcgtgggcccagatgacagcgctgtggacatggatgagtgcaaggagccagatgtgtgcaagcacggccagtgcatcaacacagatggcagctaccgctgtgagtgccccttcggctacatcctggccggaaatgaatgtgtggacacagatgaatgttctgtgggcaacccctgtggaaatggcacctgcaagaatgtgattggaggctttgaatgtacctgtgaggagggctttgagcccggccccatgatgacctgtgaggacatcaatgaatgtgcccagaaccccctgctgtgtgccttccgctgtgtgaacacctacggcagctatgaatgtaaatgtcctgtgggctacgtgctgcgggaggacaggaggatgtgcaaggatgaagatgaatgtgaggagggcaagcatgactgcacagagaagcagatggagtgcaagaacctgattggcacctacatgtgcatctgtggccctggctaccagaggaggccagatggagagggctgtgtggatgaaaatgaatgccagaccaagccaggcatctgtgaaaatggccgctgcctgaacacccggggcagctacacctgtgaatgtaatgatggcttcaccgccagccccaaccaggatgagtgcctggacaaccgggagggctactgcttcacagaggtgctgcagaacatgtgccagatcggcagcagcaacagaaatcctgtgaccaagtctgagtgctgctgtgatggcggccggggctggggcccccactgtgagatctgccccttccagggcaccgtggccttcaagaagctgtgcccccacggccggggcttcatgaccaatggagctgacattgatgagtgcaaggtgattcatgatgtgtgcagaaatggagaatgtgtgaatgaccggggcagctaccactgcatctgcaagacaggctacaccccagacatcaccggcaccagctgtgtggacctgaatgaatgcaaccaggcccccaagccctgcaacttcatctgcaagaacacagagggcagctaccagtgcagctgccccaagggctacatcctgcaggaggatggccgcagctgcaaggacctggatgaatgtgccaccaagcagcacaactgccagttcctgtgtgtgaacaccatcggcggcttcacctgcaagtgccccccaggcttcacccagcaccacaccagctgcatcgacaacaatgaatgtaccagtgacatcaacctgtgtggcagcaagggcatctgccagaacaccccaggcagcttcacctgtgagtgccagaggggcttcagcctggaccagacaggcagcagctgtgaagatgtggatgaatgtgagggcaaccaccgctgccagcacggctgccagaacatcattggaggctaccgctgcagctgcccccagggctacctgcagcactaccagtggaaccagtgtgtggatgaaaatgaatgtctgagcgcccacatctgtggcggggccagctgccacaacaccctgggcagctacaagtgcatgtgcccagctggcttccagtatgagcagttcagcggcggctgccaggacatcaatgaatgtggcagcgcccaggccccctgcagctatggctgcagcaacacagagggcggctacctgtgtggctgccccccaggctacttcagaattggccagggccactgtgtgtctggcatgggcatgggccggggcaaccctgagccccctgtgtctggagagatggatgacaacagcctgagccctgaggcctgctatgagtgcaagatcaatggctaccccaagaggggcaggaagaggaggagcaccaatgaaacagatgccagcaacatcgaggaccagagcgagacagaggccaacgtgtccctggcctcctgggatgtggagaagacagccatctttgccttcaacatcagccacgtgagcaacaaggtgcgcatcctggagctgctgcctgccctgaccaccctgaccaaccacaaccgctacctgattgaaagtggaaatgaagatggcttcttcaagatcaaccagaaggagggcatctcctacctgcacttcaccaagaagaagcctgtggccggcacctacagcctgcagatcagcagcacccccctgtacaagaagaaggagctgaaccagctggaggacaagtatgacaaggactacctgtctggagagctgggggacaacctgaagatgaagatccaggtgctgctgcactag

SEQ ID NO: 152397 - DNA, 2958 bp, Artificial Sequence
  Description of Artificial Sequence: Synthetic coding sequence
atgggctttgtgcccagcgcagatggcaaggcctgtgaagatattgatgaatgttccctgcccaacatctgtgtgtttggcacctgccacaacctgcccggcctcttccgctgtgaatgtgagatcggctatgagctggacagaagtggcggcaactgcacagatgtgaatgaatgtctggaccccaccacctgcatcagcggcaactgtgtgaacaccccaggcagctacatctgtgactgccccccagactttgagctgaaccccaccagggtgggctgtgtggacaccaggagcggcaactgctacctggacatccggcccaggggggacaacggggacacagcctgcagcaatgaaattggagtgggcgtgtccaaggccagctgctgctgcagcctgggcaaggcctggggcaccccctgtgagatgtgcccagctgtgaacaccagcgagtacaagatcctgtgccctggaggagagggcttccggcccaaccccatcaccgtcatcctggaggacattgatgagtgccaggagctgcccggcctgtgccagggcggcaagtgcatcaacaccttcggcagcttccagtgccgctgccccaccggctactacctgaatgaagacaccagggtgtgtgatgatgtgaatgaatgtgagaccccaggcatctgtggccctggcacctgctacaacacagtgggcaactacacctgcatctgccccccagactacatgcaggtgaatggaggcaacaactgcatggacatgagaagaagcctgtgctacagaaactactatgctgacaaccagacctgtgatggagagctgctcttcaacatgaccaagaagatgtgctgctgcagctacaacatcggccgggcctggaacaagccctgtgagcagtgccccatccccagcacagatgaatttgccaccctgtgtggcagccagaggcctggctttgtgattgacatctacacaggcctgcctgtggacattgatgaatgtcgggagatccctggggtgtgtgaaaatggagtgtgcatcaacatggtgggcagcttccgctgtgagtgccctgtgggcttcttctacaatgacaagctgctggtgtgtgaagatattgatgagtgccagaatggacctgtgtgccagagaaatgctgagtgcatcaacacagctggcagctaccgctgtgactgcaagccaggctaccgcttcaccagcacaggccagtgcaatgacagaaatgaatgccaggagatccccaacatctgcagccacggccagtgcatcgacacagtgggcagcttctactgcctgtgccacacaggcttcaagaccaatgatgaccagaccatgtgcctggacatcaatgaatgtgaaagagatgcctgtggaaatggcacctgcaggaacaccatcggcagcttcaactgccgctgcaaccacggcttcatcctgagccacaacaatgactgcattgatgtggatgaatgtgccagcggaaatggaaacctgtgcagaaatggccagtgcatcaacacagtgggcagcttccagtgccagtgcaatgaaggctatgaggtggccccagatggccgcacctgtgtggacatcaatgaatgtctgctggagcccaggaaatgtgcccctggcacctgccagaacctggatggcagctaccgctgcatctgccccccaggctacagcctgcagaatgagaagtgtgaggacattgatgaatgtgtggaggagcctgagatctgtgccctgggcacctgcagcaacacagagggcagcttcaagtgcctgtgcccagagggcttcagcctgagcagcagtggaagacgctgccaggacctgaggatgagctactgctacgccaagtttgaaggaggcaagtgcagcagccccaagagcaggaaccacagcaagcaggagtgctgctgtgccctgaagggggagggctggggagacccctgtgagctgtgccccacagagccagatgaggccttccggcagatctgcccctacggcagcggcatcatcgtgggcccagatgacagcgctgtggacatggatgagtgcaaggagccagatgtgtgcaagcacggccagtgcatcaacacagatggcagctaccgctgtgagtgccccttcggctacatcctggccggaaatgaatgtgtggacacagatgaatgttctgtgggcaacccctgtggaaatggcacctgcaagaatgtgattggaggctttgaatgtacctgtgaggagggctttgagcccggccccatgatgacctgtgaggacatcaatgaatgtgcccagaaccccctgctgtgtgccttccgctgtgtgaacacctacggcagctatgaatgtaaatgtcctgtgggctacgtgctgcgggaggacaggaggatgtgcaaggatgaagatgaatgtgaggagggcaagcatgactgcacagagaagcagatggagtgcaagaacctgattggcacctacatgtgcatctgtggccctggctaccagaggaggccagatggagagggctgtgtggatgaaaatgaatgccagaccaagccaggcatctgtgaaaatggccgctgcctgaacacccggggcagctacacctgtgaatgtaatgatggcttcaccgccagccccaaccaggatgagtgcctggatgtgatcctgagcctgctgctgctgagccctgccttccccagctgcttcttcagccccaggaccatcggcaaaggaacagccagccagcgctgctacaagacctgtgtgcgcagcgccccagccaccggcacccccagccccaacagaaatgctgctgtgacagaaggagaggccggcgtgcccaccgtgcgcagcgccctgagccggggcctgtggctgagcaggaacagcgtgcccatggccgaggacagctag

SEQ ID NO: 152398 - DNA, 3450 bp, Artificial Sequence
  Description of Artificial Sequence: Synthetic coding sequence
atgaggcggggccgcctgctggagatcgccctgggcttcaccgtgctgctggccagctacaccagccatggagcagatgccaacctggaggccggaaatgtgaaggagacccgggccagccgggccaagaggcggggcggcggcggccatgatgccctgaagggccccaacgtgtgtggcagccgctacaatgcctactgctgccccggctggaagaccctgcccggcggcaaccagtgcatcgtgcccatctgccgccacagctgtggagatggcttctgcagccggcccaacatgtgcacctgccccagcggccagatcgcccccagctgtggcagccgcagcatccagcactgcaacatccgctgcatgaatggaggcagctgcagtgatgaccactgcctgtgccagaagggctacatcggcacccactgcggccagcctgtgtgtgagagcggctgcctgaatggaggccgctgtgtggcccccaacagatgtgcctgcacctacggcttcaccggcccccagtgtgagcgggactacagaacaggcccctgcttcaccgtcatcagcaaccagatgtgccagggccagctgagcggcatcgtgtgcaccaagaccctgtgctgcacctacatcaatgaatgtgagatcggggcccacaactgtgggaagcatgctgtgtgcaccaacacagctggcagcttcaagtgcagctgcagccctggctggattggagatggcatcaagtgcacagacctggatgagtgcagcaatggcacccacatgtgcagccagcacgccgactgcaagaacaccatgggcagctaccgctgcctgtgcaaggagggctacacaggagatggcttcacctgcacagacctggatgaatgttctgagaacctgaacctgtgtggaaatggccagtgcctgaatgcccctgggggctaccgctgtgaatgtgacatgggctttgtgcccagcgcagatggcaaggcctgtgaagatattgatgaatgttccctgcccaacatctgtgtgtttggcacctgccacaacctgcccggcctcttccgctgtgaatgtgagatcggctatgagctggacagaagtggcggcaactgcacagatgtgaatgaatgtctggaccccaccacctgcatcagcggcaactgtgtgaacaccccaggcagctacatctgtgactgccccccagactttgagctgaaccccaccagggtgggctgtgtggacaccaggagcggcaactgctacctggacatccggcccaggggggacaacggggacacagcctgcagcaatgaaattggagtgggcgtgtccaaggccagctgctgctgcagcctgggcaaggcctggggcaccccctgtgagatgtgcccagctgtgaacaccagcgagtacaagatcctgtgccctggaggagagggcttccggcccaaccccatcaccgtcatcctggaggacattgatgagtgccaggagctgcccggcctgtgccagggcggcaagtgcatcaacaccttcggcagcttccagtgccgctgccccaccggctactacctgaatgaagacaccagggtgtgtgatgatgtgaatgaatgtgagaccccaggcatctgtggccctggcacctgctacaacacagtgggcaactacacctgcatctgccccccagactacatgcaggtgaatggaggcaacaactgcatggacatgagaagaagcctgtgctacagaaactactatgctgacaaccagacctgtgatggagagctgctcttcaacatgaccaagaagatgtgctgctgcagctacaacatcggccgggcctggaacaagccctgtgagcagtgccccatccccagcacagatgaatttgccaccctgtgtggcagccagaggcctggctttgtgattgacatctacacaggcctgcctgtggacattgatgaatgtcgggagatccctggggtgtgtgaaaatggagtgtgcatcaacatggtgggcagcttccgctgtgagtgccctgtgggcttcttctacaatgacaagctgctggtgtgtgaagatattgatgagtgccagaatggacctgtgtgccagagaaatgctgagtgcatcaacacagctggcagctaccgctgtgactgcaagccaggctaccgcttcaccagcacaggccagtgcaatgacagaaatgaatgccaggagatccccaacatctgcagccacggccagtgcatcgacacagtgggcagcttctactgcctgtgccacacaggcttcaagaccaatgatgaccagaccatgtgcctggacatcaatgaatgtgaaagagatgcctgtggaaatggcacctgcaggaacaccatcggcagcttcaactgccgctgcaaccacggcttcatcctgagccacaacaatgactgcattgatgtggatgaatgtgccagcggaaatggaaacctgtgcagaaatggccagtgcatcaacacagtgggcagcttccagtgccagtgcaatgaaggctatgaggtggccccagatggccgcacctgtgtggacatcaatgaatgtctgctggagcccaggaaatgtgcccctggcacctgccagaacctggatggcagctaccgctgcatctgccccccaggctacagcctgcagaatgagaagtgtgaggacattgatgaatgtgtggaggagcctgagatctgtgccctgggcacctgcagcaacacagagggcagcttcaagtgcctgtgcccagagggcttcagcctgagcagcagtggaagacgctgccaggacctgaggatgagctactgctacgccaagtttgaaggaggcaagtgcagcagccccaagagcaggaaccacagcaagcaggagtgctgctgtgccctgaagggggagggctggggagacccctgtgagctgtgccccacagagccagatgaggccttccggcagatctgcccctacggcagcggcatcatcgtgggcccagatgacagcgctgtggacatggatgagtgcaaggagccagatgtgtgcaagcacggccagtgcatcaacacagatggcagctaccgctgtgagtgccccttcggctacatcctggccggaaatgaatgtgtggacacagatgaatgttctgtgggcaacccctgtggaaatggcacctgcaagaatgtgattggaggctttgaatgtacctgtgaggagggctttgagcccggccccatgatgacctgtgaggacatcaatgaatgtgcccagaaccccctgctgtgtgccttccgctgtgtgaacacctacggcagctatgaatgtaaatgtcctgtgggctacgtgctgcgggaggacaggaggatgtgcaaggatgaagatgaatgtgaggagggcaagcatgactgcacctag

SEQ ID NO: 152399 - DNA, 8739 bp, Artificial Sequence
  Description of Artificial Sequence: Synthetic coding sequence
atgggcagaagaagaaggctgtgcctgcagctgtacttcctgtggctgggctgtgtggtgctgtgggcccagggcacagctggccagccccagcccccaccacccaagccaccccggccccagcccccaccccagcaggtgcgcagcgccacagctggcagcgagggcggcttcctggcccctgagtaccgggaggagggcgctgctgtggccagccgggtgagaagaagaggccagcaggatgtgctgcggggccccaacgtgtgtggcagccgcttccacagctactgctgccccggctggaagaccctgcccggcggcaaccagtgcatcgtgcccatctgcaggaacagctgtggagatggcttctgcagccggcccaacatgtgcacctgcagcagcggccagatcagcagcacctgtggcagcaagagcatccagcagtgcagcgtgcgctgcatgaatggaggcacctgtgctgatgaccactgccagtgccagaagggctacatcggcacctactgcggccagcctgtgtgtgaaaatggctgccagaatggaggccgctgcatcggccccaacagatgtgcctgtgtgtatggcttcaccggcccccagtgtgagcgggactacagaacaggcccctgcttcacccaggtgaacaaccagatgtgccagggccagctgaccggcatcgtgtgcaccaagaccctgtgctgtgccaccatcggccgggcctggggccacccctgtgagatgtgcccagcccagccccagccctgccggcggggcttcatccccaacatcagaactggagcctgccaggatgtggatgagtgccaggccatccctggcatctgccagggcggcaactgcatcaacacagtgggcagctttgagtgccgctgcccagctggccacaagcagagcgagaccacccagaagtgtgaagatattgatgaatgttccatcatccctggcatctgtgaaacaggagaatgtagcaacacagtgggcagctacttctgtgtgtgcccccggggctacgtgaccagcacagatggcagccgctgcatcgaccagaggacaggcatgtgcttcagcggcctggtgaatggccgctgtgcccaggagctgcccggccgcatgaccaagatgcagtgctgctgtgagcccggccgctgctggggcatcggcaccatccctgaggcctgccctgtgcggggcagcgaggagtaccgccgcctgtgcatggatggcctgcccatgggcggcatccctggcagcgctggcagcaggcctgggggcactggaggaaatggatttgcccccagcggaaatggaaatggctacggccctgggggcaccggcttcatccccatccctggaggaaatggcttcagccctggggtgggcggggccggcgtgggcgctgggggccagggccccatcatcaccggcctgaccatcctgaaccagaccatcgacatctgcaagcaccacgccaacctgtgcctgaatggccgctgcatccccaccgtgagcagctaccgctgtgagtgcaacatgggctacaagcaggatgccaacggggactgcattgatgtggatgagtgcaccagcaacccctgcaccaacggggactgtgtgaacaccccaggcagctactactgcaagtgccacgccggcttccagaggacccccaccaagcaggcctgcatcgacattgatgagtgcatccagaatggagtgctgtgcaagaatggccgctgtgtgaacacagatggcagcttccagtgcatctgcaatgccggctttgagctgaccacagatggcaagaactgtgtggaccatgatgagtgcaccaccaccaacatgtgcctgaatggcatgtgcatcaatgaagatggcagcttcaagtgcatctgcaagccaggctttgtgctggcccccaacggccgctactgcacagatgtggatgagtgccagaccccaggcatctgcatgaatggccactgcatcaacagcgagggcagcttccgctgtgactgccccccaggcctggccgtgggcatggatggccgggtgtgtgtggacacccacatgaggagcacctgctatggaggcatcaagaagggcgtgtgtgtgcggcccttccctggagctgtgaccaagtctgagtgctgctgtgccaacccagactatggctttggagagccctgccagccctgcccagccaagaacagcgctgagttccacggcctgtgcagcagcggcgtgggcatcaccgtggatggccgggacatcaatgaatgtgccctggaccctgacatctgtgccaacggcatctgtgagaacctgcggggcagctaccgctgcaactgcaacagcggctatgagccagatgccagcggcaggaactgcattgatattgatgaatgtctggtgaaccggctgctgtgtgacaatggcctgtgcaggaacaccccaggcagctacagctgcacctgccccccaggctacgtgttcagaacagaaacagagacctgtgaggacatcaatgaatgtgagagcaacccctgtgtgaatggagcctgcaggaacaacctgggcagcttcaactgtgagtgcagccctggcagcaagctgagcagcacaggcctcatctgcatcgacagcctgaagggcacctgctggctgaacatccaggacagccgctgtgaggtgaacatcaacggggccaccctgaagtctgagtgctgtgccaccctgggcgccgcctggggcagcccctgtgagcgctgtgagctggacacagcctgcccccggggcctggcccgcatcaagggcgtgacctgtgaagatgtgaatgaatgtgaggtgtttcctggggtgtgccccaacggccgctgtgtgaacagcaagggcagcttccactgtgaatgtcctgagggcctgaccctggatggcaccggccgggtgtgcctggacatccgcatggagcagtgctacctgaagtgggatgaagatgagtgcatccaccctgtgcctgggaagttcaggatggatgcctgctgctgtgctgtgggcgccgcctggggcacagaatgtgaagaatgtcccaagccaggcaccaaggagtatgagaccctgtgccccaggggggccggctttgccaacagaggagatgtgctgaccggccggcccttctacaaggacatcaatgaatgcaaggccttccctggcatgtgcacctacggcaagtgcaggaacaccatcggcagcttcaagtgccgctgcaacagcggctttgccctggacatggaggagaggaactgcacagacattgatgagtgccgcatcagcccagacctgtgtggcagcggcatctgtgtgaacaccccaggcagctttgaatgtgaatgttttgagggctatgagagcggcttcatgatgatgaagaactgcatggacattgatgaatgtgagaggaaccccctgctgtgccggggcggcacctgtgtgaacacagagggcagcttccagtgtgactgccccctgggccacgagctgagccccagccgggaggactgtgtggacatcaatgaatgttccctgagtgacaacctgtgcagaaatggaaaatgtgtgaacatgattggcacctaccagtgcagctgcaaccctggctaccaggccaccccagaccggcagggctgcacagacattgatgagtgcatgatcatgaatggaggctgtgacacccagtgcaccaacagcgagggcagctatgaatgtagctgcagcgagggctacgccctgatgccagatggccgcagctgtgccgacattgatgaatgtgagaacaacccagacatctgtgatggcggccagtgcaccaacatccctggagagtaccgctgcctgtgctatgatggcttcatggcctccatggacatgaagacctgcattgatgtgaatgaatgtgacctgaacagcaacatctgcatgtttggagaatgtgagaacaccaagggcagcttcatctgccactgccagctgggctacagcgtgaagaagggcaccaccggctgcacagatgtggatgaatgtgaaattggagcccacaactgtgacatgcacgccagctgcctgaacatccctggcagcttcaagtgcagctgccgggagggctggattggaaatggcatcaagtgcatcgacctggatgaatgtagcaatggcacccaccagtgcagcatcaatgcccagtgtgtgaacaccccaggcagctaccgctgtgcctgcagcgagggcttcaccggagatggcttcacctgcagtgatgtggatgaatgtgccgagaacatcaacctgtgtgaaaatggccagtgcctgaatgtgcctggggcctaccgctgtgaatgtgagatgggcttcaccccagccagtgacagccgcagctgccaggacattgatgagtgcagcttccagaacatctgtgtgtttggcacctgcaacaacctgcccggcatgttccactgcatctgtgatgatggctatgagctggacagaactggaggcaactgcacagacattgatgaatgtgccgaccccatcaactgtgtgaatggcctgtgtgtgaacaccccaggccgctatgagtgcaactgccccccagacttccagctgaaccccactggagtgggctgtgtggacaacagagtgggcaactgctacctgaagtttggccccagaggagatggcagcctgagctgcaacacagaaattggagtgggcgtgagccgcagcagctgctgctgcagcctgggcaaggcctggggcaacccctgtgagacctgcccccctgtgaacagcacagagtactacaccctgtgccctggaggagagggcttccggcccaaccccatcaccatcatcctggaggacattgatgagtgccaggagctgcccggcctgtgccagggcggcaactgcatcaacaccttcggcagcttccagtgtgagtgcccccagggctactacctgtctgaggacacccgcatctgtgaagatattgatgaatgttttgcccaccctggggtgtgtggccctggcacctgctacaacaccctgggcaactacacctgcatctgccccccagagtacatgcaggtgaatggaggccacaactgcatggacatgaggaagagcttctgctaccgcagctacaacggcaccacctgtgaaaatgagctgcccttcaacgtgaccaagaggatgtgctgctgcacctacaacgtgggcaaggcctggaacaagccctgtgagccctgccccaccccaggcacagctgacttcaagaccatctgtggcaacatccctggcttcacctttgacatccacacaggcaaggctgtggacattgatgagtgcaaggagatccctggcatctgtgccaatggagtgtgcatcaaccagatcggcagcttccgctgtgagtgccccaccggcttctcctacaatgacctgctgctggtgtgtgaagatattgatgaatgtagcaatggagacaacctgtgccagagaaatgctgactgcatcaacagccctggcagctaccgctgtgaatgtgccgccggcttcaagctgagccccaatggagcctgtgtggacagaaatgaatgtctggagatccccaacgtgtgcagccacggcctgtgtgtggacctgcagggcagctaccagtgcatctgccacaacggcttcaaggccagccaggaccagaccatgtgcatggatgtggatgaatgtgagcggcacccctgtggaaatggcacctgcaagaacacagtgggcagctacaactgcctgtgctacccaggctttgagctgacccacaacaatgactgcctggacattgatgagtgcagcagcttcttcggccaggtgtgcagaaatggccgctgcttcaatgagatcggcagcttcaagtgcctgtgcaatgaaggctatgagctgaccccagatggcaagaactgcatcgacaccaatgaatgtgtggccctgcccggcagctgcagccctggcacctgccagaacctggagggcagcttccgctgcatctgccccccaggctatgaggtgaagtctgagaactgcatcgacatcaatgaatgtgatgaggaccccaacatctgcctgtttggcagctgcaccaacacccctgggggcttccagtgcctgtgccccccaggctttgtgctgagtgacaatggccgccgctgctttgacacccggcagagcttctgcttcaccaactttgaaaatggcaagtgcagcgtgcccaaggccttcaacaccaccaaggccaagtgctgctgcagcaagatgcctggagagggctggggagacccctgtgagctgtgccccaaggatgatgaggtggccttccaggacctgtgcccctacggccatggaacagtgcccagcctgcatgacacccgggaggatgtgaatgaatgtctggagagccctggcatctgcagcaatggccagtgcatcaacacagatggcagcttccgctgtgaatgtcccatgggctacaacctggactacacaggagtgcgctgtgtggacacagatgagtgcagcatcggcaacccctgtggaaatggcacctgcaccaacgtcatcggcagctttgagtgcaactgcaatgaaggatttgagcccggccccatgatgaactgtgaggacatcaatgaatgtgcccagaaccccctgctgtgtgccttccgctgcatgaacaccttcggcagctatgagtgcacctgccccatcggctacgccctgcgggaggaccagaagatgtgcaaggacctggatgaatgtgccgagggcctgcatgactgtgagagccggggcatgatgtgcaagaacctgattggcaccttcatgtgcatctgccccccaggcatggcccggcggccagatggagagggctgtgtggatgaaaatgaatgtaggaccaagccaggcatctgtgaaaatggccgctgtgtgaacatcatcggcagctaccgctgtgagtgcaatgaaggcttccagagcagcagcagcggcacagaatgtctggacaaccggcagggcctgtgctttgctgaggtgctgcagaccatctgccagatggccagcagcagcaggaacctggtgaccaagtctgagtgctgctgtgatggcggccggggctggggccaccagtgtgagctgtgccccctgcccggcacagcccagtacaagaagatctgcccccacggccctggctacaccacagatggccgggacattgatgagtgcaaggtgatgcccaacctgtgcaccaacggccagtgcatcaacaccatgggcagcttccgctgcttctgcaaggtgggctacaccacagacatcagcggcaccagctgcatcgacctggatgagtgcagccagagccccaagccctgcaactacatctgcaagaacacagagggcagctaccagtgcagctgcccccggggctacgtgctgcaggaggatggcaagacctgcaaggacctggatgagtgccagaccaagcagcacaactgccagttcctgtgtgtgaacaccctgggcggcttcacctgcaagtgccccccaggcttcacccagcaccacacagcctgcatcgacaacaatgaatgtggcagccagcccagcctgtgtggggccaagggcatctgccagaacaccccaggcagcttcagctgtgagtgccagaggggcttcagcctggatgccaccggcctgaactgtgaagatgtggatgaatgtgatggcaaccaccgctgccagcacggctgccagaacatcctgggcggctaccgctgtggctgcccccagggctacatccagcactaccagtggaaccagtgtgtggatgaaaatgaatgtagcaaccccaatgcctgtggcagcgccagctgctacaacaccctgggcagctacaagtgtgcctgccccagcggcttctcctttgaccagttcagcagcgcctgccatgatgtgaatgaatgtagcagcagcaagaacccctgcaactacggctgcagcaacacagaaggaggctacctgtgtggctgccccccaggctactacagagtgggccagggccactgtgtgtctggcatgggcttcaacaagggccagtacctgagcctggacacagaggtggatgaggagaatgccctgagccctgaggcctgctatgagtgcaagatcaatggctacagcaagaaggacagccggcagaagaggagcatccacgagccagaccccacagctgtggagcagatcagcctggagagcgtggacatggacagccctgtgaacatgaagttcaacctgagccacctgggcagcaaggagcacatcctggagctgcggcctgccatccagcccctgaacaaccacatccgctacgtgatcagccagggcaatgatgattctgtgttccgcatccaccagagaaatggcctgagctacctgcacacagccaagaagaagctgatgcctggcacctacaccctggagatcaccagcatccccctgtacaagaagaaggagctgaagaagctggaggagagcaatgaagatgactacctgctgggggagctgggggaggccctgaggatgaggctgcagatccagctgtactag

SEQ ID NO: 152400 - DNA, 8739 bp, Artificial Sequence; identical to SEQ ID NO: 152399
  Description of Artificial Sequence: Synthetic coding sequence

SEQ ID NO: 152401 - DNA, 597 bp, Artificial Sequence
  Description of Artificial Sequence: Synthetic coding sequence
atgggcctgaggaaaggacatggcaccctgggccagggcctgagcgccctgcagagcgagcagggccgcctcatccagctgctgtctgagagccagggccacatggcccacctggtgaacagcgtgtctgacatcctggatgccctgcagagggaccggggcctgggccggcccaggaacaaggctgacctgcagagggccccagcccggggcacccggccccggggctgtgccaccggcagccggccccgggactgcctggatgtgctgctgagcggccagcaggatgatggagtgtacagcgtcttccccacccactacccagctggcttccaggtgtactgtgacatgaggacagatggcggcggctggacagtgttccagaggagagaagatggctctgtgaacttcttccggggctgggatgcctacagagatggcttcggccgcctgaccggggagcactggctgggccccctggactggtgcaccctgagcctggccctgctggtgcctgtggcccccagccccaccccaccccacagctttgtgaatgtgctgcacccccctgtgcctgggggccccaccctgcagtag

SEQ ID NO: 152402 - DNA, 912 bp, Artificial Sequence
  Description of Artificial Sequence: Synthetic coding sequence
atgggcctgaggaaaggacatggcaccctgggccagggcctgagcgccctgcagagcgagcagggccgcctcatccagctgctgtctgagagccagggccacatggcccacctggtgaacagcgtgtctgacatcctggatgccctgcagagggaccggggcctgggccggcccaggaacaaggctgacctgcagagggccccagcccggggcacccggccccggggctgtgccaccggcagccggccccgggactgcctggatgtgctgctgagcggccagcaggatgatggagtgtacagcgtcttccccacccactacccagctggcttccaggtgtactgtgacatgaggacagatggcggcggctggacagtgttccagaggagagaagatggctctgtgaacttcttccggggctgggatgcctacagagatggcttcggccgcctgaccggggagcactggctgggcctgaagagaattcatgccctgaccacccaggccgcctatgagctgcacgtggacctggaggactttgaaaatggaacagcctatgcccgctatggcagctttggagtgggcctcttctctgtggaccctgaagaagatggctaccccctgactgtggccgactacagcggcacagctggggacagcctgctgaagcacagcggcatgaggttcaccaccaaggaccgggacagcgaccacagcgagaacaactgtgccgccttctacagaggagcctggtggtacagaaactgccacaccagcaacctgaatggccagtacctgcggggggcccacgccagctatgcagatggagtggagtggagctcctggacaggctggcagtacagcctgaagttcagcgagatgaagatccggcctgtgagagaagatagatag

SEQ ID NO: 152403 - DNA, 1386 bp, Artificial Sequence
  Description of Artificial Sequence: Synthetic coding sequence
atggtgaatgaccgctggaagaccatgggcggggccgcccagctggaggaccggccccgggacaagccccagaggcccagctgtggctacgtgctgtgcaccgtgctgctggccctggccgtgctgctggccgtggccgtgactggagctgtgctcttcctgaaccacgcccacgcccctggaacagcccctcctcctgtggtgtccactggagctgccagcgccaacagcgccctggtgacagtggagagagctgacagcagccacctgagcatcctgattgacccccgctgcccagacctgacagacagctttgcccggctggagagcgcccaggcctctgtgctgcaggccctgacagagcaccaggcccagccccggctggtgggggaccaggagcaggagctgctggacaccctggccgaccagctgccccggctgctggcccgggccagcgagctgcagacagagtgcatgggcctgaggaaaggacatggcaccctgggccagggcctgagcgccctgcagagcgagcagggccgcctcatccagctgctgtctgagagccagggccacatggcccacctggtgaacagcgtgtctgacatcctggatgccctgcagagggaccggggcctgggccggcccaggaacaaggctgacctgcagagggccccagcccggggcacccggccccggggctgtgccaccggcagccggccccgggactgcctggatgtgctgctgagcggccagcaggatgatggagtgtacagcgtcttccccacccactacccagctggcttccaggtgtactgtgacatgaggacagatggcggcggctggacagtgttccagaggagagaagatggctctgtgaacttcttccggggctgggatgcctacagagatggcttcggccgcctgaccggggagcactggctgggcctgaagagaattcatgccctgaccacccaggccgcctatgagctgcacgtggacctggaggactttgaaaatggaacagcctatgcccgctatggcagctttggagtgggcctcttctctgtggaccctgaagaagatggctaccccctgactgtggccgactacagcggcacagctggggacagcctgctgaagcacagcggcatgaggttcaccaccaaggaccgggacagcgaccacagcgagaacaactgtgccgccttctacagaggagcctggtggtacagaaactgccacaccagcaacctgaatggccagtacctgcggggggcccacgccagctatgcagatggagtggagtggagctcctggacaggctggcagtacagcctgaagttcagcgagatgaagatccggcctgtgagagaagatagatag

SEQ ID NO: 152404 - DNA, 933 bp, Artificial Sequence
  Description of Artificial Sequence: Synthetic coding sequence
tgaacaggagctgtgctcttcctgaaccacgcccacgcccctggaacagcccctcctcctgtggtgtccactggagctgccagcgccaacagcgccctggtgacagtggagagagctgacagcagccacctgagcatcctgattgacccccgctgcccagacctgacagacagctttgcccggctggagagcgcccaggcctctgtgctgcaggccctgacagagcaccaggcccagccccggctggtgggggaccaggagcaggagctgctggacaccctggccgaccagctgccccggctgctggcccgggccagcgagctgcagacagagtgcatgggcctgaggaaaggacatggcaccctgggccagggcctgagcgccctgcagagcgagcagggccgcctcatccagctgctgtctgagagccagggccacatggcccacctggtgaacagcgtgtctgacatcctggatgccctgcagagggaccggggcctgggccggcccaggaacaaggctgacctgcagagggccccagcccggggcacccggccccggggctgtgccaccggcagccggccccgggactgcctggatgtgctgctgagcggccagcaggatgatggagtgtacagcgtcttccccacccactacccagctggcttccaggtgtactgtgacatgaggacagatggcggcggctggacagtgttccagaggagagaagatggctctgtgaacttcttccggggctgggatgcctacagagatggcttcggccgcctgaccggggagcactggctgggccccctggactggtgcaccctgagcctggccctgctggtgcctgtggcccccagccccaccccaccccacagctttgtgaatgtgctgcacccccctgtgcctgggggccccaccctgcagtag

SEQ ID NO: 152405 - DNA, 1386 bp, Artificial Sequence; identical to SEQ ID NO: 152403
  Description of Artificial Sequence: Synthetic coding sequence

SEQ ID NO: 152406 - DNA, 870 bp, Artificial Sequence
  Description of Artificial Sequence: Synthetic coding sequence
atggtgaatgaccgctggaagaccatgggcggggccgcccagctggaggaccggccccgggacaagccccagaggcccagctgtggctacgtgctgtgcaccgtgctgctggccctggccgtgctgctggccgtggccgtgactggagctgtgctcttcctgaaccacgcccacgcccctggaacagcccctcctcctgtggtgtccactggagctgccagcgccaacagcgccctggtgacagtggagagagctgacagcagccacctgagcatcctgattgacccccgctgcccagacctgacagacagctttgcccggctggagagcgcccaggcctctgtgctgcaggccctgacagagcaccaggcccagccccggctggtgggggaccaggagcaggagctgctggacaccctggccgaccagctgccccggctgctggcccgggccagcgagctgcagacagagtgcatgggcctgaggaaaggacatggcaccctgggccagggcctgagcgccctgcagagcgagcagggccgcctcatccagctgctgtctgagagccagggccacatggcccacctggtgaacagcgtgtctgacatcctggatgccctgcagagggaccggggcctgggccggcccaggaacaaggctgacctgcagagggccccagcccggggcacccggccccggggctgtgccaccggcagccggccccgggactgcctggatgtgctgctgagcggccagcaggatgatggagtgtacagcgtcttccccacccactacccagctggcttccaggtgtactgtgacatgaggacagatggcggcggctggacagtgttccagaggcgggagtag

SEQ ID NO: 152407 - DNA, 540 bp, Artificial Sequence
  Description of Artificial Sequence: Synthetic coding sequence
atggtgaatgaccgctggaagaccatgggcggggccgcccagctggaggaccggccccgggacaagccccaggccaggaagctgcggctgcgggagcggcccagctgtggctacgtgctgtgcaccgtgctgctggccctggccgtgctgctggccgtggccgtgactggagctgtgctcttcctgaaccacgcccacgcccctggaacagcccctcctcctgtggtgtccactggagctgccagcgccaacagcgccctggtgacagtggagagagctgacagcagccacctgagcatcctgattgacccccgctgcccagacctgacagacagctttgcccggctggagagcgcccaggcctctgtgctgcaggccctgacagagcaccaggcccagccccggctggtgggggaccaggagcaggagctgctggacaccctggccgaccagctgccccggctgctggcccgggccagcgagctgcagacagagtgcatgggcctgaggaaaggacatggcaccctgggccagggctag

SEQ ID NO: 152408 - DNA, 1170 bp, Artificial Sequence
  Description of Artificial Sequence: Synthetic coding sequence
atgagaagagtgaccctcttcctgaatggcagccccaagaatggcaaggtggtggccgtgtatggcaccctgagtgacctgctgtctgtggccagcagcaagctgggcatcaaggccacctctgtgtacaacgggaagggcggcctgattgatgacatcgccctgatcagagatgatgatgtgctgtttgtgtgtgagggggagcccttcatcgacccccagacagacagcaagcccccagagggcctgctgggcttccacacagactggctgaccctgaatgtgggcggccgctacttcaccaccaccaggagcaccctggtgaacaaggagccagacagcatgctggcccacatgttcaaggacaagggcgtgtggggcaacaagcaggaccacagaggagccttcctgattgacaggagccctgagtactttgagcccatcctgaactacctgcggcacggccagctgattgtgaatgatggcatcaacctgctgggcgtgctggaggaggcccgcttctttggaattgacagcctgattgagcacctggaggtggccatcaagaacagccagcccccagaggaccacagccccatcagcaggaaggagtttgtgcgcttcctgctggccacccccaccaagtctgagctgcgctgccagggcctgaacttcagcggggctgacctgagccggctggacctgcgctacatcaacttcaagatggccaacctgagccgctgcaacctggcccacgccaacctgtgctgtgccaacctggagagagctgacctgagcggctctgtgctggactgtgccaacctgcagggcgtgaagatgctgtgcagcaatgctgagggcgccagcctgaagctgtgcaactttgaggaccccagcggcctgaaggccaacctggagggcgccaacctgaagggcgtggacatggagggcagccagatgacaggcatcaacctgcgggtggccaccctgaagaatgccaagctgaagaactgcaacctgcggggggccaccctggccggcacagacctggagaactgtgacctgagcggctgtgacctgcaggaggccaacctgcggggcagcaatgtgaagggggccatctttgaggagatgctgacccccctgcacatgagccagagcgtgaggtag

SEQ ID NO: 152409 - DNA, 939 bp, Artificial Sequence
  Description of Artificial Sequence: Synthetic coding sequence
atggccaaggtgttctccttcatcctggtgaccacagccctgaccatgggccgggagatcagcgccctggaggactgtgcccaggagcagatgaggctgcgggcccaggtgcggctgctggagaccagggtgaagcagcagcaggtgaagatcaagcagctgctgcaggagaatgaggtgcagttcctggacaagggagatgagaacacagtcatcgacctgggcagcaagaggcagtatgctgactgcagcgagatcttcaatgatggctacaagctgagcggcttctacaagatcaagcccctgcagagccctgctgagttctctgtgtactgtgacatgtctgatggcggcggctggacagtcatccagaggagaagtgatggcagcgagaacttcaacagaggctggaaggactatgaaaatggcttcggcaactttgtgcagaagcatggagagtactggctgggcaacaagaacctgcacttcctgaccacccaggaggactacaccctgaagattgacctggccgactttgagaagaacagccgctatgcccagtacaagaacttcaaggtgggagatgagaagaacttctatgagctgaacatcggggagtacagcggcacagctggggacagcctggccggcaacttccaccctgaggtgcagtggtgggccagccaccagaggatgaagttcagcacctgggaccgggaccatgacaactatgagggcaactgtgccgaggaggaccagagcggctggtggttcaaccgctgccacagcgccaacctgaatggagtgtactacagcggcccctacacagccaagacagacaatggaattgtgtggtacacctggcacggctggtggtacagcctgaagtctgtggtgatgaagatccggcccaatgacttcatccccaacgtcatctag

SEQ ID NO: 152410 - DNA, 939 bp, Artificial Sequence; identical to SEQ ID NO: 152409
  Description of Artificial Sequence: Synthetic coding sequence

SEQ ID NO: 152411 - DNA, 939 bp, Artificial Sequence; identical to SEQ ID NO: 152409
  Description of Artificial Sequence: Synthetic coding sequence

SEQ ID NO: 152412 - DNA, 939 bp, Artificial Sequence; identical to SEQ ID NO: 152409
  Description of Artificial Sequence: Synthetic coding sequence

SEQ ID NO: 152413 - DNA, 939 bp, Artificial Sequence; identical to SEQ ID NO: 152409
  Description of Artificial Sequence: Synthetic coding sequence

SEQ ID NO: 152414 - DNA, 939 bp, Artificial Sequence; identical to SEQ ID NO: 152409
  Description of Artificial Sequence: Synthetic coding sequence

SEQ ID NO: 152415 - DNA, 849 bp, Artificial Sequence
  Description of Artificial Sequence: Synthetic coding sequence
atgaggctgcgggcccaggtgcggctgctggagaccagggtgaagcagcagcaggtgaagatcaagcagctgctgcaggagaatgaggtgcagttcctggacaagggagatgagaacacagtcatcgacctgggcagcaagaggcagtatgctgactgcagcgagatcttcaatgatggctacaagctgagcggcttctacaagatcaagcccctgcagagccctgctgagttctctgtgtactgtgacatgtctgatggcggcggctggacagtcatccagaggagaagtgatggcagcgagaacttcaacagaggctggaaggactatgaaaatggcttcggcaactttgtgcagaagcatggagagtactggctgggcaacaagaacctgcacttcctgaccacccaggaggactacaccctgaagattgacctggccgactttgagaagaacagccgctatgcccagtacaagaacttcaaggtgggagatgagaagaacttctatgagctgaacatcggggagtacagcggcacagctggggacagcctggccggcaacttccaccctgaggtgcagtggtgggccagccaccagaggatgaagttcagcacctgggaccgggaccatgacaactatgagggcaactgtgccgaggaggaccagagcggctggtggttcaaccgctgccacagcgccaacctgaatggagtgtactacagcggcccctacacagccaagacagacaatggaattgtgtggtacacctggcacggctggtggtacagcctgaagtctgtggtgatgaagatccggcccaatgacttcatccccaacgtcatctag

SEQ ID NO: 152416 - DNA, 939 bp, Artificial Sequence; identical to SEQ ID NO: 152409
  Description of Artificial Sequence: Synthetic coding sequence

SEQ ID NO: 152417 - DNA, 1320 bp, Artificial Sequence
  Description of Artificial Sequence: Synthetic coding sequence
atgaagctggccaactggtactggctgagcagcgctgtgctggccacctacggcttcctggtggtggccaacaatgaaacagaggagatcaaggatgagcgggccaaggatgtgtgccctgtgcggctggagagccggggcaaatgtgaggaggccggggagtgcccctaccaggtgtccctgccccccctgaccatccagctgcccaagcagttcagcagaattgaggaggtgttcaaggaggtgcagaacctgaaggagatcgtgaacagcctgaagaagagctgccaggactgcaagctgcaggctgatgacaacggggaccctggaagaaatggcctgctgctgcccagcactggagcccctggagaggtgggggacaacagagtgcgggagctggagagcgaggtgaacaagctgagcagcgagctgaagaatgccaaggaggagatcaacgtgctgcacggccgcctggagaagctgaacctggtgaacatgaacaacatcgagaactacgtggacagcaaggtggccaacctgacctttgtggtgaacagcctggatggcaagtgcagcaaatgtcccagccaggagcagatccagagcaggcctgtgcagcacctgatctacaaggactgcagcgactactatgccatcggcaagaggagcagcgagacctacagagtgaccccagaccccaagaacagcagctttgaggtgtactgtgacatggagaccatgggcggcggctggacagtgctgcaggcccggctggatggcagcaccaacttcaccaggacctggcaggactacaaggccggctttggaaacctgcggcgggagttctggctgggcaatgacaagatccacctgctgaccaagagcaaggagatgatcctgagaattgacctggaggacttcaacggggtggagctgtatgccctgtatgaccagttctacgtggccaatgagttcctgaagtaccgcctgcacgtgggcaactacaacggcacagctggagatgccctgcgcttcaacaagcactacaaccacgacctgaagttcttcaccaccccagacaaggacaatgaccgctaccccagcggcaactgtggcctgtactacagcagcggctggtggtttgatgcctgcctgagcgccaacctgaatggcaagtactaccaccagaagtaccggggcgtgagaaatggcatcttctggggcacctggccaggagtgtctgaggcccaccctgggggctacaagagcagcttcaaggaggccaagatgatgatccggcccaagcacttcaagccctag

SEQ ID NO: 152418 - DNA, 1095 bp, Artificial Sequence
  Description of Artificial Sequence: Synthetic coding sequence
atgaccagcgagctggacatctttgtgggcaacaccaccctgattgatgaagatgtgtaccgcctgtggctggatggctacagcgtgacagatgctgtggccctgcgggtgcgcagcggcatcctggagcagacaggagccacagctgctgtgctgcagagcgacaccatggaccactaccgcaccttccacatgctggagcggctgctgcacgccccacccaagctgctgcaccagctgatcttccagatcccccccagccggcaggccctgctgattgagcgctactatgcctttgatgaggcctttgtgcgggaggtgctgggcaagaagctgagcaagggcaccaagaaggacctggatgacatcagcaccaagacaggcatcaccctgaagagctgccggcggcagtttgacaacttcaagagggtcttcaaggtggtggaggagatgaggggcagcctggtggacaacatccagcagcacttcctgctgagtgaccggctggcccgggactatgctgccatcgtgttctttgccaacaacagatttgagaccgggaagaagaagctgcagtacctgagctttggagactttgccttctgtgccgagctgatgatccagaactggaccctgggcgctgtgggggaggcccccacagatcctgacagccagatggatgacatggacatggacctggacaaggagttcctgcaggacctgaaggagctgaaggtgctggtggccgacaaggacctgctggacctgcacaagagcctggtgtgcacagccctgcggggcaagctgggcgtcttcagcgagatggaggccaacttcaagaacctgagccggggcctggtgaatgtggccgccaagctgacccacaacaaggatgtgcgggacctgtttgtggacctggtggagaagtttgtggagccctgccgcagtgaccactggcccctgagtgatgtgcgcttcttcctgaaccagtacagcgcctctgtgcacagcctggatggcttccgccaccaggccctgtgggaccgctacatgggcaccctgcggggctgcctgctgcggctgtaccatgactag

SEQ ID NO: 152419 - DNA, 1074 bp, Artificial Sequence
  Description of Artificial Sequence: Synthetic coding sequence
atgaccagcgagctggacatctttgtgggcaacaccaccctgattgatgaagatgtgtaccgcctgtggctggatggctacagcgtgacagatgctgtggccctgcgggtgcgcagcggcatcctggagcagacaggagccacagctgctgtgctgcagagcgacaccatggaccactaccgcaccttccacatgctggagcggctgctgcacgccccacccaagctgctgcaccagctgatcttccagatcccccccagccggcaggccctgctgattgagcgctactatgcctttgatgaggcctttgtgcgggaggtgctgggcaagaagctgagcaagggcaccaagaaggacctggatgacatcagcaccaagacaggcatcaccctgaagagctgccggcggcagtttgacaacttcaagagggtcttcaaggtggtggaggagatgaggggcagcctggtggacaacatccagcagcacttcctgctgagtgaccggctggcccgggactatgctgccatcgtgttctttgccaacaacagatttgagaccgggaagaagaagctgcagtacctgagctttggagactttgccttctgtgccgagctgatgatccagaactggaccctgggcgctgtggacagccagatggatgacatggacatggacctggacaaggagttcctgcaggacctgaaggagctgaaggtgctggtggccgacaaggacctgctggacctgcacaagagcctggtgtgcacagccctgcggggcaagctgggcgtcttcagcgagatggaggccaacttcaagaacctgagccggggcctggtgaatgtggccgccaagctgacccacaacaaggatgtgcgggacctgtttgtggacctggtggagaagtttgtggagccctgccgcagtgaccactggcccctgagtgatgtgcgcttcttcctgaaccagtacagcgcctctgtgcacagcctggatggcttccgccaccaggccctgtgggaccgctacatgggcaccctgcggggctgcctgctgcggctgtaccatgactag

SEQ ID NO: 152420 - DNA, 1989 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccacagaattggaggctacaaggtgcgctatgccacctggagcatcatcatggattctgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggccctgacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcaccggggccttcctgatcagctgcatggtgggctctgtgattgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaagggcaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaaggtgtggaacctgaaggcccccctggtgcacaccccccggcccggcagccaggagtgccctggggaccggggccagtgtgatgaggacagccggctgtggcccaggacaggccacagcccccaccggctgctgtag

SEQ ID NO: 152421 - DNA, 1104 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgtgcccattgatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggaccagacaacctgccctacgtgcagatcctgaagcacagcggcatcaacagcagtgatgctgaggtgctgaccctcttcaacgtgacagaggcccagagcggggagtatgtgtgcaaggtgagcaactacatcggggaggccaaccagagcgcctggctgactgtgaccaggcctgtggccaaggactgctggagctag

SEQ ID NO: 152422 - DNA, 2196 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggaccagacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcacaggagccttcctgatcagctgcatggtgggcagcgtcatcgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaaaggaaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaggacaacgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggaccgcatcgtggccctgaccagcaaccaggagtacctggacctgtccatgcccctggaccagtacagccccagcttcccagacaccaggagcagcacctgcagcagtggagaagattctgtgttcagccatgagcccctgcctgaggagccctgcctgcccaggcacccagcccagctggccaatggaggcctgaagagaagatag

SEQ ID NO: 152423 - DNA, 2439 bp, Artificial Sequence
  Description of Artificial Sequence: Synthetic coding sequence
atggctgctgtgacccgggactttggagagatgctgctgcacagcggccgggtgctgcctgctgaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccacagaattggaggctacaaggtgcgctatgccacctggagcatcatcatggattctgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggccctgacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcaccggggccttcctgatcagctgcatggtgggctctgtgattgtgtacaagatgaagagcggcaccaagaagagtgacttccacagccagatggctgtgcacaagctggccaagagcatccccctgcggcggcaggtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaagggcaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaagataatgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggacagaattgtggccctgaccagcaaccaggagtacctggacctgtccatgcccctggaccagtacagccccagcttcccagacaccaggagcagcacctgcagcagcggggaggacagcgtcttcagccatgagcccctgcctgaggagccctgcctgcccaggcacccagcccagctggccaacggcggcctgaagagaagatag

SEQ ID NO: 152424 - DNA, 2469 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgtgcccattgatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggaccagacaacctgccctacgtgcagatcctgaagcacagcggcatcaacagcagtgatgctgaggtgctgaccctcttcaacgtgacagaggcccagagcggggagtatgtgtgcaaggtgagcaactacatcggggaggccaaccagagcgcctggctgactgtgaccaggcctgtgctggaggagaggcctgctgtgatgaccagccccctgtacctggagatcatcatctactgcaccggggccttcctgatcagctgcatggtgggctctgtgattgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaagggcaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaagataatgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggacagaattgtggccctgaccagcaaccaggagtacctggacctgtccatgcccctggaccagtacagccccagcttcccagacaccaggagcagcacctgcagcagcggggaggacagcgtcttcagccatgagcccctgcctgaggagccctgcctgcccaggcacccagcccagctggccaacggcggcctgaagagaagatag

SEQ ID NO: 152425 - DNA, 2202 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggaccagacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcacaggagccttcctgatcagctgcatggtgggcagcgtcatcgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaaaggaaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaggacaacgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggaccgcatcgtggccctgaccagcaaccaggagtacctggacctgtccatgcccctggaccagtacagccccagcttcccagacaccaggagcagcacctgcagcagtggagaagattctgtgttcagccatgagcccctgcctgaggagccctgcctgcccaggcacccagcccagctggccaatggaggcctgaagagaagatag

SEQ ID NO: 152426 - DNA, 2463 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccacagaattggaggctacaaggtgcgctatgccacctggagcatcatcatggattctgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggccctgacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcaccggggccttcctgatcagctgcatggtgggctctgtgattgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaagggcaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaagataatgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggacagaattgtggccctgaccagcaaccaggagtacctggacctgtccatgcccctggaccagtacagccccagcttcccagacaccaggagcagcacctgcagcagcggggaggacagcgtcttcagccatgagcccctgcctgaggagccctgcctgcccaggcacccagcccagctggccaacggcggcctgaagagaagatag

SEQ ID NO: 152427 - DNA, 2202 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggaccagacaacctgccctacgtgcagatcctgaagcacagcggcatcaacagcagtgatgctgaggtgctgaccctcttcaacgtgacagaggcccagagcggggagtatgtgtgcaaggtgagcaactacatcggggaggccaaccagagcgcctggctgactgtgaccaggcctgtggccaaggccctggaggagaggcctgctgtgatgaccagccccctgtacctggagatcatcatctactgcacaggagccttcctgatcagctgcatggtgggcagcgtcatcgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaaaggaaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaggacaacgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggaccgcatcgtggccctgaccagcaaccaggagtacctggacctgtccatgcccctggaccagtacagccccagcttcccagacaccaggagcagcacctgcagcagtggagaagattctgtgttcagccatgagcccctgcctgaggagccctgcctgcccaggcacccagcccagctggccaatggaggcctgaagagaagatag

SEQ ID NO: 152428 - DNA, 2463 bp, Artificial Sequence; identical to SEQ ID NO: 152426
  Description of Artificial Sequence: Synthetic coding sequence

SEQ ID NO: 152429 - DNA, 2463 bp, Artificial Sequence; identical to SEQ ID NO: 152426
  Description of Artificial Sequence: Synthetic coding sequence

SEQ ID NO: 152430 - DNA, 324 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagctag

SEQ ID NO: 152431 - DNA, 2562 bp, Artificial Sequence
  Description of Artificial Sequence: Synthetic coding sequence
atggaggcccgggtgtccctgaagagaagaattgagctgactgtggagtacccctggaggtgtggggccctgagccccaccagcaactgcaggacaggcatgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcactggagaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggaccagacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcacaggagccttcctgatcagctgcatggtgggcagcgtcatcgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaaaggaaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaggacaacgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggaccgcatcgtggccctgaccagcaaccaggagtacctggacctgtccatgcccctggaccagtacagccccagcttcccagacaccaggagcagcacctgcagcagtggagaagattctgtgttcagccatgagcccctgcctgaggagccctgcctgcccaggcacccagcccagctggccaatggaggcctgaagagaagatag

SEQ ID NO: 152432 - DNA, 168 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacacctag

SEQ ID NO: 152433 - DNA, 6 bp, Artificial Sequence
  Description of Artificial Sequence: Synthetic coding sequence
atgtag

SEQ ID NO: 152434 - DNA, 2469 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccacagaattggaggctacaaggtgcgctatgccacctggagcatcatcatggattctgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggccctgacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcaccggggccttcctgatcagctgcatggtgggctctgtgattgtgtacaagatgaagagcggcaccaagaagagtgacttccacagccagatggctgtgcacaagctggccaagagcatccccctgcggcggcaggtgacagtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaagggcaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaagataatgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggacagaattgtggccctgaccagcaaccaggagtacctggacctgtccatgcccctggaccagtacagccccagcttcccagacaccaggagcagcacctgcagcagcggggaggacagcgtcttcagccatgagcccctgcctgaggagccctgcctgcccaggcacccagcccagctggccaacggcggcctgaagagaagatag

SEQ ID NO: 152435 - DNA, 897 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccacagaattggaggctacaaggtgcgctatgccacctggagcatcatcatggattctgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagctag

SEQ ID NO: 152436 - DNA, 438 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatcgtggagaatgagtactag

SEQ ID NO: 152437 - DNA, 429 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccaccgcatcggcggctacaaggtgcgctatgccacctggagcatcatcatggacagcgtggtgcccagcgacaagggcaactacacctgcatctag

SEQ ID NO: 152438 - DNA, 258 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggatgccctgcccagcagtgaagatgatgatgatgatgatgacagcagcagcgaggagaaggagacagacaacaccaagcccaaccctgtggccccctactggaccagccctgagaagatggagaagaagctgcatgctgtgcctgctgccaagacagtgaagttctag

SEQ ID NO: 152439 - DNA, 2463 bp, Artificial Sequence
  Description of Artificial Sequence: Synthetic coding sequence
atgtggagctggaagtgcctgctcttctgggccgtgctggtgacagccaccctgtgcacagcccggcccagccccaccctgcctgagcaggcccagccctggggcgcccctgtggaggtggagagcttcctggtgcaccctggggacctgctgcagctgcgctgccgcctgagagatgatgtgcagagcatcaactggctgagagatggagtgcagctggccgagagcaacagaacccgcatcaccggggaggaggtggaggtgcaggacagcgtgcctgctgacagcggcctgtatgcctgtgtgaccagcagccccagcggcagtgacaccacctacttctctgtgaatgtgtctgatgccctgcccagcagtgaagatgatgatgatgatgatgacagcagcagcgaggagaaggagacagacaacaccaagcccaacaggatgcctgtggccccctactggaccagccctgagaagatggagaagaagctgcatgctgtgcctgctgccaagacagtgaagttcaagtgccccagcagcggcacccccaaccccaccctgcgctggctgaagaatggcaaggagttcaagccagaccacagaattggaggctacaaggtgcgctatgccacctggagcatcatcatggattctgtggtgcccagcgacaagggcaactacacctgcatcgtggagaatgaatatggcagcatcaaccacacctaccagctggatgtggtggagaggagcccccaccggcccatcctgcaggccggcctgcctgccaacaagacagtggccctgggcagcaatgtggagttcatgtgcaaggtgtacagcgacccccagccccacatccagtggctgaagcacatcgaggtgaatggcagcaagattggccctgacaacctgccctacgtgcagatcctgaagacagctggggtgaacaccacagacaaggagatggaggtgctgcacctgagaaatgtgtcctttgaagatgctggggagtacacctgcctggccggcaacagcatcggcctgagccaccacagcgcctggctgactgtgctggaggccctggaggagaggcctgctgtgatgaccagccccctgtacctggagatcatcatctactgcaccggggccttcctgatcagctgcatggtgggctctgtgattgtgtacaagatgaagagcggcaccaagaagagtgacttccacagccagatggctgtgcacaagctggccaagagcatccccctgcggcggcaggtgtctgctgacagcagcgcctccatgaacagcggcgtgctgctggtgcggcccagccggctgagcagcagcggcacccccatgctggccggcgtgtctgaatatgagctgcctgaggacccccgctgggagctgccccgggaccggctggtgctgggcaagcccctgggggagggctgcttcggccaggtggtgctggccgaggccatcggcctggacaaggacaagcccaacagagtgaccaaggtggccgtgaagatgctgaagagtgatgccacagagaaggacctgagtgacctgatcagcgagatggagatgatgaagatgattggcaagcacaagaacatcatcaacctgctgggcgcctgcacccaggacggccccctgtatgtgattgtggagtatgccagcaagggcaacctgcgggagtacctgcaggcccggcggcccccaggcctggagtactgctacaaccccagccacaaccctgaggagcagctgagcagcaaggacctggtgtcctgtgcctaccaggtggcccggggcatggagtacctggccagcaagaagtgcatccaccgggacctggccgccagaaatgtgctggtgacagaagataatgtgatgaagattgctgactttggcctggcccgggacatccaccacatcgactactacaagaagaccaccaacggccgcctgcctgtgaagtggatggcccctgaggccctgtttgaccgcatctacacccaccagagtgatgtgtggagctttggagtgctgctgtgggagatcttcaccctgggcggcagcccctacccaggagtgcctgtggaggagctgttcaagctgctgaaggagggccacaggatggacaagcccagcaactgcaccaatgagctgtacatgatgatgagggactgctggcatgctgtgcccagccagaggcccaccttcaagcagctggtggaggacctggacagaattgtggccctgaccagcaaccaggagtacctggacctgtccatgcccctggaccagtacagccccagcttcccagacaccaggagcagcacctgcagcagcggggaggacagcgtcttcagccatgagcccctgcctgaggagccctgcctgcccaggcacccagcccagctggccaacggcggcctgaagagaagatag

SEQ ID NO: 152440 - DNA, 2010 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagccagaagatgccatcagcagtggagatgatgaagatgacacagatggagctgaggactttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcacagaattggaggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggccgccggcgtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatctag

SEQ ID NO: 152441 - DNA, 2460 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggctgctggggtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcattggagtcttcctgattgcctgcatggtggtgaccgtcatcctgtgcaggatgaagaacaccaccaagaagccagacttcagcagccagcctgctgtgcacaagctgaccaagaggatccccctgcggcggcaggtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgacagcgtcttctccccagaccccatgccctatgagccctgcctgccccagtacccccacatcaatggatctgtgaagacctag

SEQ ID NO: 152442 - DNA, 2358 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggctgctggggtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcattggagtcttcctgattgcctgcatggtggtgaccgtcatcctgtgcaggatgaagaacaccaccaagaagccagacttcagcagccagcctgctgtgcacaagctgaccaagaggatccccctgcggcggcaggtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagccctacagcccctgctacccagaccccaggtag

SEQ ID NO: 152443 - DNA, 2115 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgagggcgccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcacagaattggaggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggccgccggcgtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgattctgtgttctccccagaccccatgccctatgagccctgcctgccccagtacccccacatcaatggatctgtgaagacctag

SEQ ID NO: 152444 - DNA, 2124 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagccagaagatgccatcagcagtggagatgatgaagatgacacagatggagctgaggactttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcacagaattggaggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggccgccggcgtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggaggagaagaaggtgtctggagctgtggactgccacaagccaccctgcaaccccagccacctgccctgtgtgctggccgtggaccagtag

SEQ ID NO: 152445 - DNA, 2466 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggctgctggggtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcattggagtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgacagcgtcttctccccagaccccatgccctatgagccctgcctgccccagtacccccacatcaatggatctgtgaagacctag

SEQ ID NO: 152446 - DNA, 765 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtgggcagccagggcctgtag

SEQ ID NO: 152447 - DNA, 2043 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagccagaagatgccatcagcagtggagatgatgaagatgacacagatggagctgaggactttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcacagaattggaggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaagcacagcggcatcaacagcagcaatgctgaggtgctggccctcttcaacgtgacagaagcagatgctggggagtacatctgcaaggtgagcaactacatcggccaggccaaccagagcgcctggctgactgtgctgcccaagcagcaggcccctggccgggagaaggagatcacagccagcccagactacctggagatcgccatctactgcattggagtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgagatctag

SEQ ID NO: 152448 - DNA, 2310 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaagcacagcggcatcaacagcagcaatgctgaggtgctggccctcttcaacgtgacagaagcagatgctggggagtacatctgcaaggtgagcaactacatcggccaggccaaccagagcgcctggctgactgtgctgcccaagcagcaggcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgagatctag

SEQ ID NO: 152449 - DNA, 2307 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaagcacagcggcatcaacagcagcaatgctgaggtgctggccctcttcaacgtgacagaagcagatgctggggagtacatctgcaaggtgagcaactacatcggccaggccaaccagagcgcctggctgactgtgctgcccaagcagcaggcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaatag

SEQ ID NO: 152450 - DNA, 2124 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgagggcgccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcacagaattggaggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaagcacagcggcatcaacagcagcaatgctgaggtgctggccctcttcaacgtgacagaagcagatgctggggagtacatctgcaaggtgagcaactacatcggccaggccaaccagagcgcctggctgactgtgctgcccaagcagcaggcccctggccgggagaaggagatcacagccagcccagactacctggagatcgccatctactgcattggagtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgacagcgtcttctccccagaccccatgccctatgagccctgcctgccccagtacccccacatcaatggatctgtgaagacctag

SEQ ID NO: 152451 - DNA, 2118 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgacagcgtcttctccccagaccccatgccctatgagccctgcctgccccagtacccccacatcaatggatctgtgaagacctag

SEQ ID NO: 152452 - DNA, 2130 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggcccctggccgggagaaggagatcacagccagcccagactacctggagatcgccatctactgcattggagtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaaaggaaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagagaacaacgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgacagcgtcttctccccagaccccatgccctatgagccctgcctgccccagtacccccacatcaatggatctgtgaagacctag

SEQ ID NO: 152453 - DNA, 2469 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaaggtgaccaaggccgccggcgtgaacaccacagacaaggagattgaggtgctgtacatcagaaatgtgacctttgaagatgctggggagtacacctgcctggccggcaacagcatcggcatctccttccacagcgcctggctgactgtgctgcctgcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgattctgtgttctccccagaccccatgccctatgagccctgcctgccccagtacccccacatcaatggatctgtgaagacctag

SEQ ID NO: 152454 - DNA, 2469 bp, Artificial Sequence
  Description of Artificial Sequence: Synthetic coding sequence
atggtgtcctggggccgcttcatctgcctggtggtggtgaccatggccaccctgagcctggcccggcccagcttcagcctggtggaggacaccaccctggagcctgaggagccccccaccaagtaccagatcagccagcctgaggtgtatgtggccgcccctggagagagcctggaggtgcgctgcctgctgaaggatgctgctgtgatctcctggaccaaggatggagtgcacctgggccccaacaacagaacagtgctgattggagagtacctgcagatcaagggggccaccccccgggacagcggcctgtatgcctgcacagccagcaggacagtggacagcgagacctggtacttcatggtgaatgtgacagatgccatcagcagtggagatgatgaagatgacacagatggagcagaagattttgtgtctgagaacagcaacaacaagagggccccctactggaccaacacagagaagatggagaagaggctgcatgctgtgcctgctgccaacacagtgaagttccgctgcccagctgggggcaaccccatgcccaccatgcgctggctgaagaatggcaaggagttcaagcaggagcaccgcatcggcggctacaaggtgaggaaccagcactggagcctcatcatggagagcgtggtgcccagcgacaagggcaactacacctgtgtggtggagaatgaatatggcagcatcaaccacacctaccacctggatgtggtggagaggagcccccaccggcccatcctgcaggccggcctgcctgccaatgccagcacagtggtgggcggagatgtggagtttgtgtgcaaggtgtacagtgatgcccagccccacatccagtggatcaagcacgtggagaagaatggcagcaaatatggcccagatggcctgccctacctgaaggtgctgaagcacagcggcatcaacagcagcaatgctgaggtgctggccctcttcaacgtgacagaagcagatgctggggagtacatctgcaaggtgagcaactacatcggccaggccaaccagagcgcctggctgactgtgctgcccaagcagcaggcccctggccgggagaaggagatcacagccagcccagactacctggagatcgccatctactgcatcggggtcttcctgattgcctgcatggtggtgaccgtcatcctgtgcaggatgaagaacaccaccaagaagccagacttcagcagccagcctgctgtgcacaagctgaccaagaggatccccctgcggcggcaggtgacagtgtctgctgagagcagcagctccatgaacagcaacacccccctggtgcgcatcaccacccggctgagcagcacagctgacacccccatgctggccggcgtgtctgaatatgagctgcctgaggaccccaagtgggagttcccccgggacaagctgaccctgggcaagcccctgggggagggctgcttcggccaggtggtgatggccgaggccgtgggcatcgacaaggacaagcccaaggaggccgtgacagtggccgtgaagatgctgaaggatgatgccacagagaaggacctgagtgacctggtgtctgagatggagatgatgaagatgattggcaagcacaagaacatcatcaacctgctgggcgcctgcacccaggacggccccctgtatgtgattgtggagtatgccagcaagggcaacctgcgggagtacctgcgggcccggcggcccccaggcatggagtacagctatgacatcaacagagtgcctgaggagcagatgaccttcaaggacctggtgtcctgcacctaccagctggcccggggcatggagtacctggccagccagaagtgcatccaccgggacctggccgccagaaatgtgctggtgacagaaaataatgtgatgaagattgctgactttggcctggcccgggacatcaacaacatcgactactacaagaagaccaccaacggccgcctgcctgtgaagtggatggcccctgaggccctgtttgacagagtgtacacccaccagagtgatgtgtggagctttggagtgctgatgtgggagatcttcaccctgggcggcagcccctacccaggcatccctgtggaggagctgttcaagctgctgaaggagggccacaggatggacaagccagccaactgcaccaatgagctgtacatgatgatgagggactgctggcatgctgtgcccagccagaggcccaccttcaagcagctggtggaggacctggaccgcatcctgaccctgaccaccaatgaggagtacctggacctgagccagcccctggagcagtacagccccagctacccagacaccaggagcagctgcagcagtggagatgattctgtgttctccccagaccccatgccctatgagccctgcctgccccagtacccccacatcaatggatctgtgaagacctag

SEQ ID NO: 152455 - DNA, 1515 bp, Artificial Sequence
  Description of Artificial Sequence: Synthetic coding sequence
atgacccccagccccctgctgctgctgctgctgccccccctgctgctgggcgccttccccccagctgctgctgcccggggcccccccaagatggctgacaaggtggtgccccggcaggtggcccggctgggccgcacagtgcggctgcagtgccctgtggagggggaccccccacccctgaccatgtggaccaaggatggccgcaccatccacagcggctggagccgcttccgggtgctgccccagggcctgaaggtgaagcaggtggagcgggaggatgctggggtgtatgtgtgcaaggccaccaatggatttggcagcctgtctgtgaactacaccctggtggtgctggatgacatcagccctgggaaggagagcctgggccctgacagcagcagcggcggccaggaggaccctgccagccagcagtgggcccggccccgcttcacccagcccagcaagatgagaagaagagtcatcgcccggcctgtgggcagctctgtgcggctgaagtgtgtggccagcggccaccccaggccagacatcacctggatgaaggatgaccaggccctgaccaggcctgaggccgctgagcccaggaagaagaagtggaccctgagcctgaagaacctgcggcctgaggacagcggcaagtacacctgccgggtgagcaacagagctggggccatcaatgccacctacaaggtggatgtgatccagaggaccaggagcaagcctgtgctgaccggcacccaccctgtgaacaccaccgtggactttggaggcaccaccagcttccagtgcaaggtgcggagtgatgtgaagcctgtgatccagtggctgaagagggtggagtatggagctgagggccgccacaacagcaccattgatgtgggcggccagaagtttgtggtgctgcccactggagatgtgtggagcaggccagatggcagctacctgaacaagctgctgatcacccgggcccggcaggatgatgctggcatgtacatctgcctgggcgccaacaccatgggctacagcttccgcagcgccttcctgactgtgctgcctgaccccaagcccccaggcccccctgtggccagcagcagcagcgccaccagcctgccctggcctgtggtgattggcatcccagctggagctgtgttcatcctgggcaccctgctgctgtggctgtgccaggcccagaagaagccctgcaccccagccccagccccacccctgcccggccacaggcctcctggaacagcccgggacagaagtggggacaaggacctgcccagcctggccgccctgtctgctggccctggggtgggcctgtgtgaggagcacggcagccctgctgccccccagcacctgctgggccctggccctgtggccggccccaagctgtaccccaagctgtacacagacatccacacccacacccacacccacagccacacccacagccacgtggagggcaaggtgcaccagcacatccactaccagtgctag

SEQ ID NO: 152456 - DNA, 1515 bp, Artificial Sequence; identical to SEQ ID NO: 152455
  Description of Artificial Sequence: Synthetic coding sequence

SEQ ID NO: 152457 - DNA, 1515 bp, Artificial Sequence; identical to SEQ ID NO: 152455
  Description of Artificial Sequence: Synthetic coding sequence

SEQ ID NO: 152458 - DNA, 459 bp, Artificial Sequence
  Description of Artificial Sequence: Synthetic coding sequence
atgacccccagccccctgctgctgctgctgctgccccccctgctgctgggcgccttccccccagctgctgctgcccggggcccccccaagatggctgacaaggtggtgccccggcaggtggcccggctgggccgcacagtgcggctgcagtgccctgtggagggggaccccccacccctgaccatgtggaccaaggatggccgcaccatccacagcggctggagccgcttccgggtgctgccccagggcctgaaggtgaagcaggtggagcgggaggatgctggggtgtatgtgtgcaaggccaccaatggatttggcagcctgtctgtgaactacaccctggtggtgctggatgacatcagccctgggaaggagagcctgggccctgacagcagcagcggcggccaggaggaccctgccagccagcagtgggcccggccccgcttcacccagccctag

SEQ ID NO: 152459 - DNA, 1515 bp, Artificial Sequence; identical to SEQ ID NO: 152455
  Description of Artificial Sequence: Synthetic coding sequence

SEQ ID NO: 152460 - DNA, 243 bp, Artificial Sequence
  Description of Artificial Sequence: Synthetic coding sequence
atgacccccagccccctgctgctgctgctgctgccccccctgctgctgggcgccttccccccagctgctgctgcccggggcccccccaagatggctgacaaggtggtgccccggcaggtggcccggctgggccgcacagtgcggctgcagtgccctgtggagggggaccccccacccctgaccatgtggaccaaggatggccgcaccatccacagcggctggagccgcttccgggtgctgtag

SEQ ID NO: 152461 - DNA, 1326 bp, Artificial Sequence
  Description of Artificial Sequence: Synthetic coding sequence
atggctgacaaggtggtgccccggcaggtggcccggctgggccgcacagtgcggctgcagtgccctgtggagggggaccccccacccctgaccatgtggaccaaggatggccgcaccatccacagcggctggagccgcttccgggtgctgccccagggcctgaaggtgaagcaggtggagcgggaggatgctggggtgtatgtgtgcaaggccaccaatggatttggcagcctgtctgtgaactacaccctggtggtgctggatgacatcagccctgggaaggagagcctgggccctgacagcagcagcggcggccaggaggaccctgccagccagcagtgggcccggccccgcttcacccagcccagcaagatgagaagaagagtcatcgcccggcctgtgggcagctctgtgcggctgaagtgtgtggccagcggccaccccaggccagacatcacctggatgaaggatgaccaggccctgaccaggcctgaggccgctgagcccaggaagaagaagtggaccctgagcctgaagaacctgcggcctgaggacagcggcaagtacacctgccgggtgagcaacagagctggggccatcaatgccacctacaaggtggatgtgatccagaggaccaggagcaagcctgtgctgaccggcacccaccctgtgaacaccaccgtggactttggaggcaccaccagcttccagtgcaaggtgcggagtgatgtgaagcctgtgatccagtggctgaagagggtggagtatggagctgagggccgccacaacagcaccattgatgtgggcggccagaagtttgtggtgctgcccactggagatgtgtggagcaggccagatggcagctacctgaacaagctgctgatcacccgggcccggcaggatgatgctggcatgtacatctgcctgggcgccaacaccatgggctacagcttccgcagcgccttcctgactgtgctgcctgaccccaagcccccaggcccccctgtggccagcagcagcagcgccaccagcctgccctggcctgtggtgattggcatcccagctggagctgtgttcatcctgggcaccctgctgctgtggctgtgccaggcccagaagaagccctgcaccccagccccagccccacccctgcccggccacaggcctcctggaacagcccgggacagaagtggggacaaggacctgcccagcctggccgccctgtctgctggccctggggtgggcctgtgtgaggagcacggcagccctgctgccccccagcaccccaccgtggtggtggccccagacctgtgcaacttcatgtag

SEQ ID NO: 152462 - DNA, 1131 bp, Artificial Sequence
  Description of Artificial Sequence: Synthetic coding sequence
atgcagtggaccagcctgctgctgctggccggcctcttcagcctgagccaggcccagtatgaagatgacccccactggtggttccactacctgcggagccagcagagcacctactatgacccctatgacccctacccctatgagacctatgagccctacccctatggagtggatgagggccctgcctacacctacggcagccccagccccccagacccccgggactgcccccaggagtgtgactgcccccccaacttccccacagccatgtactgtgacaacagaaacctgaagtacctgccctttgtgcccagcaggatgaagtatgtgtacttccagaacaaccagatcaccagcatccaggagggcgtgtttgacaatgccaccggcctgctgtggatcgccctgcacggcaaccagatcaccagtgacaaggtgggcaggaaggtgttcagcaagctgcggcacctggagcggctgtacctggaccacaacaacctgaccaggatgcctggccccctgcccaggagcctgcgggagctgcacctggaccacaaccagatcagccgggtgcccaacaatgccctggagggcctggagaacctgacagccctgtacctgcagcacaatgagatccaggaggtgggcagctccatgaggggcctgcggagcctcatcctgctggacctgagctacaaccacctgaggaaggtgcctgatggcctgcccagcgccctggagcagctgtacatggagcacaacaacgtgtacacagtgcctgacagctacttccggggggcccccaagctgctgtatgtgcggctgagccacaacagcctgaccaacaacggcctggccagcaacaccttcaacagcagcagcctgctggagctggacctgagctacaaccagctgcagaagatcccccctgtgaacaccaacctggagaacctgtacctgcagggcaaccgcatcaatgagttcagcatcagcagcttctgcaccgtggtggatgtggtgaacttcagcaagctgcaggtgctgcggctggatggaaatgagatcaagaggtctgccatgccagcagatgcccccctgtgcctgcggctggccagcctcatcgagatctag

SEQ ID NO: 152463 - DNA, 1092 bp, Artificial Sequence
  Description of Artificial Sequence: Synthetic coding sequence
atgcagtggaccagcctgctgctgctggccggcctcttcagcctgagccaggcccagtatgaagatgacccccactggtggttccactacctgcggagccagcagagcacctactatgacccctatgacccctacccctatgagacctatgagccctacccctatggagtggatgagggccctgcctacacctacggcagccccagccccccagacccccgggactgcccccaggagtgtgactgcccccccaacttccccccatttgtgcccagcaggatgaagtatgtgtacttccagaacaaccagatcaccagcatccaggagggcgtgtttgacaatgccaccggcctgctgtggatcgccctgcacggcaaccagatcaccagtgacaaggtgggcaggaaggtgttcagcaagctgcggcacctggagcggctgtacctggaccacaacaacctgaccaggatgcctggccccctgcccaggagcctgcgggagctgcacctggaccacaaccagatcagccgggtgcccaacaatgccctggagggcctggagaacctgacagccctgtacctgcagcacaatgagatccaggaggtgggcagctccatgaggggcctgcggagcctcatcctgctggacctgagctacaaccacctgaggaaggtgcctgatggcctgcccagcgccctggagcagctgtacatggagcacaacaacgtgtacacagtgcctgacagctacttccggggggcccccaagctgctgtatgtgcggctgagccacaacagcctgaccaacaacggcctggccagcaacaccttcaacagcagcagcctgctggagctggacctgagctacaaccagctgcagaagatcccccctgtgaacaccaacctggagaacctgtacctgcagggcaaccgcatcaatgagttcagcatcagcagcttctgcaccgtggtggatgtggtgaacttcagcaagctgcaggtgctgcggctggatggaaatgagatcaagaggtctgccatgccagcagatgcccccctgtgcctgcggctggccagcctgattgagatctag

SEQ ID NO: 152464 - DNA, 594 bp, Artificial Sequence
  Description of Artificial Sequence: Synthetic coding sequence
atgaagatgaccctcatcggcggcagcaccaccagcgctgccagcagcccccccaccaccatccccatgaccctgaccaggatgaggcccaccagcctgacccccatgggctggatgaagggccagcccacccccacagccctgcaccccctgcagatcccagccacagcccccaggtctgccacagcccaccccaccagcacagccatgtactgtgacaacagaaacctgaagtacctgccctttgtgcccagcaggatgaagtatgtgtacttccagaacaaccagatcaccagcatccaggagggcgtgtttgacaatgccaccggcctgctgtggatcgccctgcacggcaaccagatcaccagtgacaaggtgggcaggaaggtgttcagcaagctgcggcacctggagcggctgtacctggaccacaacaacctgaccaggatgcctggccccctgcccaggagcctgcgggagctgcacctggaccacaaccagatcagccgggtgcccaacaatgccctggagggccgcaccagccggccctgcaccagcaacaccatgaggagcaggaagtgggccgtgccctag

SEQ ID NO: 152465 - DNA, 2025 bp, Artificial Sequence
  Description of Artificial Sequence: Synthetic coding sequence
atggtggtggcccaccccacagccacagccaccaccacccccacagccaccgtgacagccaccgtggtgatgaccacagccaccatggacctgcgggactggctgttcctgtgctacggcctcatcgccttcctgacagaggtgattgacagcaccacctgccccagcgtgtgccgctgtgacaatggcttcatctactgcaatgaccggggcctgaccagcatcccagctgacatcccagatgatgccaccaccctgtacctgcagaacaaccagatcaacaatgccggcatcccccaggacctgaagaccaaggtgaatgtgcaggtgatctacctgtatgaaaatgacctggatgagttccccatcaacctgcccaggagcctgcgggagctgcacctgcaggacaacaacgtgaggaccatcgcccgggacagcctggcccgcatccccctgctggagaagctgcacctggatgacaacagcgtgtccacagtgtccattgaggaggatgcctttgctgacagcaagcagctgaagctgctcttcctgagcaggaaccacctgagcagcatccccagcggcctgccccacaccctggaggagctgcggctggatgacaaccgcatcagcaccatccccctgcacgccttcaagggcctgaacagcctgcggcggctggtgctggatggcaacctgctggccaaccagagaattgctgatgacaccttcagccggctgcagaacctgacagagctgagcctggtgaggaacagcctggccgccccacccctgaacctgcccagcgcccacctgcagaagctgtacctgcaggacaatgccatcagccacatcccctacaacaccctggccaagatgagggagctggagcggctggacctgagcaacaacaacctgaccaccctgccccggggcctgtttgatgacctgggcaacctggcccagctgctgctgaggaacaacccctggttctgtggctgcaacctgatgtggctgcgggactgggtgaaggcccgggctgctgtggtgaatgtgcggggcctgatgtgccagggccctgagaaggtgcggggcatggccatcaaggacatcaccagcgagatggatgaatgttttgaaacaggcccccagggcggcgtggccaatgctgctgccaagaccacagccagcaaccacgccagcgccaccaccccccagggcagcctcttcaccctgaaggccaagaggcctggcctgcggctgcctgacagcaacatcgactaccccatggccactggagatggagccaagaccctggccatccacgtgaaggccctgacagctgacagcatccgcatcacctggaaggccaccctgcctgccagcagcttccggctgtcctggctgcggctgggccacagccctgctgtgggcagcatcacagagaccctggtgcagggcgacaagacagagtacctgctgacagccctggagcccaagagcacctacatcatctgcatggtgaccatggagaccagcaatgcctacgtggctgatgagacccctgtgtgtgccaaggccgagacagctgacagctatggccccaccaccaccctgaaccaggagcagaatgccggccccatggccagcctgcccctggccggcatcattggaggagctgtggccctggtgttcctgttcctggtgctgggcgccatctgctggtacgtgcaccaggccggggagctgctgacccgggagcgggcctacaacagaggcagcaggaagaaggatgactacatggagagcggcaccaagaaggacaacagcatcctggagatccggggccctggcctgcagatgctgcccatcaacccctaccgggccaaggaggagtatgtggtgcacaccatcttccccagcaatggcagcagcctgtgcaaggccacccacaccatcggctacggcaccacccggggctacagagatggcggcatcccagacatcgactacagctacacctag

SEQ ID NO: 152466 - DNA, 1983 bp, Artificial Sequence
  Description of Artificial Sequence: Synthetic coding sequence
atgggcctgcagaccaccaagtggcccagccatggagccttcttcctgaagtcctggctgatcatcagcctgggcctgtacagccaggtgtccaagctgctggcctgccccagcgtgtgccgctgtgacaggaactttgtgtactgcaatgaaagaagcctgacctctgtgcccctgggcatccctgagggcgtgacagtgctgtacctgcacaacaaccagatcaacaatgccggcttccctgctgagctgcacaacgtgcagagcgtgcacacagtgtacctgtatggcaaccagctggatgagttccccatgaacctgcccaagaatgtgcgggtgctgcacctgcaggagaacaacatccagaccatcagcagagctgccctggcccagctgctgaagctggaggagctgcacctggatgacaacagcatcagcacagtgggcgtggaggatggagccttccgggaggccatcagcctgaagctgctcttcctgagcaagaaccacctgagctctgtgcctgtgggcctgcctgtggacctgcaggagctgcgggtggatgaaaatagaattgctgtgatcagtgacatggccttccagaacctgaccagcctggagcggctcatcgtggatggcaacctgctgaccaacaagggcattgctgagggcaccttcagccacctgaccaagctgaaggagttcagcatcgtgaggaacagcctgagccaccccccaccagacctgcccggcacccacctgatccggctgtacctgcaggacaaccagatcaaccacatccccctgacagccttcagcaacctgaggaagctggagcggctggacatcagcaacaaccagctgaggatgctgacccagggcgtgtttgacaacctgagcaacctgaagcagctgacagccaggaacaacccctggttctgtgactgcagcatcaagtgggtgacagagtggctgaagtacatccccagcagcctgaatgtgcggggcttcatgtgccagggccctgagcaggtgcggggcatggctgtgcgggagctgaacatgaacctgctgagctgccccaccaccaccccaggcctgcccctcttcaccccagcccccagcacagccagccccaccacccagccccccaccctgagcatccccaaccccagccgcagctacaccccacccacccccaccaccagcaagctgcccaccatcccagactgggatggccgggagcgggtgaccccacccatcagcgagcgcatccagctgagcatccactttgtgaatgacaccagcatccaggtgtcctggctgagcctcttcaccgtgatggcctacaagctgacctgggtgaagatgggccacagcctggtgggcggcatcgtgcaggagcgcatcgtgtctggagagaagcagcacctgagcctggtgaacctggagcccaggagcacctaccgcatctgcctggtgcccctggatgccttcaactacagagctgtggaggacaccatctgcagcgaggccaccacccacgccagctacctgaacaacggcagcaacacagccagcagccatgagcagaccaccagccacagcatgggcagccccttcctgctggccggcctgattggaggagctgtgatctttgtgctggtggtgctgctgagcgtcttctgctggcacatgcacaagaagggccgctacaccagccagaagtggaagtacaacagaggaagaaggaaggatgactactgtgaggccggcaccaagaaggacaacagcatcctggagatgacagagaccagcttccagatcgtgtccctgaacaatgaccagctgctgaagggggacttccggctgcagcccatctacaccccaaatggaggcatcaactacacagactgccacatccccaacaacatgagatactgcaacagctctgtgcctgacctggagcactgccacacctag

SEQ ID NO: 152467 - DNA, 942 bp, Artificial Sequence
  Description of Artificial Sequence: Synthetic coding sequence
atggctgtgcgggagctgaacatgaacctgctgagctgccccaccaccaccccaggcctgcccctcttcaccccagcccccagcacagccagccccaccacccagccccccaccctgagcatccccaaccccagccgcagctacaccccacccacccccaccaccagcaagctgcccaccatcccagactgggatggccgggagcgggtgaccccacccatcagcgagcgcatccagctgagcatccactttgtgaatgacaccagcatccaggtgtcctggctgagcctcttcaccgtgatggcctacaagctgacctgggtgaagatgggccacagcctggtgggcggcatcgtgcaggagagaattgtgtctggagagaagcagcacctgagcctggtgaacctggagcccaggagcacctaccgcatctgcctggtgcccctggatgccttcaactacagagctgtggaggacaccatctgcagcgaggccaccacccacgccagctacctgaacaacggcagcaacacagccagcagccatgagcagaccaccagccacagcatgggcagccccttcctgctggccggcctcatcggcggcgctgtgatctttgtgctggtggtgctgctgtctgtgttctgctggcacatgcacaagaagggccgctacaccagccagaagtggaagtacaacagaggccgcaggaaggatgactactgtgaggccggcaccaagaaggacaacagcatcctggagatgacagagaccagcttccagatcgtgtccctgaacaatgaccagctgctgaagggggacttccggctgcagcccatctacacccccaacggcggcatcaactacacagactgccacatccccaacaacatgagatactgcaacagctctgtgcctgacctggagcactgccacacctag

SEQ ID NO: 152468 - DNA, 1983 bp, Artificial Sequence; identical to SEQ ID NO: 152466
  Description of Artificial Sequence: Synthetic coding sequence

SEQ ID NO: 152469 - DNA, 1950 bp, Artificial Sequence
  Description of Artificial Sequence: Synthetic coding sequence
atgatctctgctgcctggagcatcttcctgattggcaccaagattggcctcttcctgcaggtggcccccctgtctgtgatggccaagagctgccccagcgtgtgccgctgtgatgctggcttcatctactgcaatgaccgcttcctgaccagcatccccaccggcatcccagaagatgccaccaccctgtacctgcagaacaaccagatcaacaatgccggcatccccagcgacctgaagaacctgctgaaggtggagcgcatctacctgtaccacaacagcctggatgagttccccaccaacctgcccaagtatgtgaaggagctgcacctgcaggagaacaacatccgcaccatcacctatgacagcctgagcaagatcccctacctggaggagctgcacctggatgacaacagcgtgtctgctgtgtccattgaggagggcgccttccgggacagcaactacctgcggctgctcttcctgagcaggaaccacctgagcaccatcccctggggcctgcccaggaccatcgaggagctgcggctggatgacaaccgcatcagcaccatcagcagccccagcctgcagggcctgaccagcctgaagaggctggtgctggatggcaacctgctgaacaaccacggcctgggggacaaggtgttcttcaacctggtgaacctgacagagctgagcctggtgaggaacagcctgacagctgcccctgtgaacctgcccggcaccaacctgaggaagctgtacctgcaggacaaccacatcaacagagtgcccccaaatgccttctcctacctgcggcagctgtaccgcctggacatgagcaacaacaacctgagcaacctgccccagggcatctttgatgacctggacaacatcacccagctgatcctgaggaacaacccctggtactgcggctgcaagatgaagtgggtgcgggactggctgcagagcctgcctgtgaaggtgaatgtgcggggcctgatgtgccaggcccctgagaaggtgcggggcatggccatcaaggacctgaatgctgagctgtttgactgcaaggacagcggcatcgtgtccaccatccagatcaccacagccatccccaacacagtgtacccagcccagggccagtggccagcccctgtgaccaagcagcctgacatcaagaaccccaagctgaccaaggaccaccagaccaccggcagccccagcaggaagaccatcaccatcaccgtgaagtctgtgaccagtgacaccatccacatctcctggaagctggccctgcccatgacagccctgcggctgtcctggctgaagctgggccacagccctgccttcggcagcatcacagagaccatcgtgactggagagaggtctgagtacctggtgacagccctggagccagacagcccctacaaggtgtgcatggtgcccatggagaccagcaacctgtacctgtttgatgagacccctgtgtgcattgaaacagaaacagcccccctgaggatgtacaaccccaccaccaccctgaaccgggagcaggagaaggagccctacaagaaccccaacctgcccctggccgccatcattggaggagctgtggccctggtgaccatcgccctgctggccctggtgtgctggtacgtgcacagaaatggcagcctcttcagcaggaactgtgcctacagcaaaggaagaagaaggaaggatgattatgcagaggccggcaccaagaaggacaacagcatcctggagatccgggagaccagcttccagatgctgcccatcagcaatgagcccatcagcaaggaggagtttgtgatccacaccatcttcccccccaacggcatgaacctgtacaagaacaaccacagcgagagcagcagcaacagaagctacagagattctggcatcccagacagcgaccacagccacagctag

SEQ ID NO: 152470 - DNA, 1950 bp, Artificial Sequence; identical to SEQ ID NO: 152469
  Description of Artificial Sequence: Synthetic coding sequence

SEQ ID NO: 152471 - DNA, 1884 bp, Artificial Sequence
  Description of Artificial Sequence: Synthetic coding sequence
atgatctctgctgcctggagcatcttcctgattggcaccaagattggcctcttcctgcaggtggcccccctgtctgtgatggccaagagctgccccagcgtgtgccgctgtgatgctggcttcatctactgcaatgaccgcttcctgaccagcatccccaccggcatcccagaagatgccaccaccctgtacctgcagaacaaccagatcaacaatgccggcatccccagcgacctgaagaacctgctgaaggtggagcgcatctacctgtaccacaacagcctggatgagttccccaccaacctgcccaagtatgtgaaggagctgcacctgcaggagaacaacatccgcaccatcacctatgacagcctgagcaagatcccctacctggaggagctgcacctggatgacaacagcgtgtctgctgtgtccattgaggagggcgccttccgggacagcaactacctgcggctgctcttcctgagcaggaaccacctgagcaccatcccctggggcctgcccaggaccatcgaggagctgcggctggatgacaaccgcatcagcaccatcagcagccccagcctgcagggcctgaccagcctgaagaggctggtgctggatggcaacctgctgaacaaccacggcctgggggacaaggtgttcttcaacctggtgaacctgacagagctgagcctggtgaggaacagcctgacagctgcccctgtgaacctgcccggcaccaacctgaggaagctgtacctgcaggacaaccacatcaacagagtgcccccaaatgccttctcctacctgcggcagctgtaccgcctggacatgagcaacaacaacctgagcaacctgccccagggcatctttgatgacctggacaacatcacccagctgatcctgaggaacaacccctggtactgcggctgcaagatgaagtgggtgcgggactggctgcagagcctgcctgtgaaggtgaatgtgcggggcctgatgtgccaggcccctgagaaggtgcggggcatggccatcaaggacctgaatgctgagctgtttgactgcaaggacagcggcatcgtgtccaccatccagatcaccacagccatccccaacacagtgtacccagcccagggccagtggccagcccctgtgaccaagcagcctgacatcaagaaccccaagctgaccaaggaccaccagaccaccggcagccccagcaggaagaccatcaccatcaccgtgaagtctgtgaccagtgacaccatccacatctcctggaagctggccctgcccatgacagccctgcggctgtcctggctgaagctgggccacagccctgccttcggcagcatcacagagaccatcgtgactggagagaggtctgagtacctggtgacagccctggagccagacagcccctacaaggtgtgcatggtgcccatggagaccagcaacctgtacctgtttgatgagacccctgtgtgcattgaaacagaaacagcccccctgaggatgtacaaccccaccaccaccctgaaccgggagcaggagaaggagccctacaagaaccccaacctgcccctggccgccatcattggaggagctgtggccctggtgaccatcgccctgctggccctggtgtgctggtacgtgcacagaaatggcagcctcttcagcaggaactgtgcctacagcaaaggaagaagaaggaaggatgattatgcagaggccggcaccaagaaggacaacagcatcctggagatccgggagaccagcttccagatgctgcccatcagcaatgagcccatcagcaaggaggagtttgtgatccacaccatcttcccccccaacggcatgaacctgtacaagcagagccagtag

SEQ ID NO: 152472 - DNA, 402 bp, Artificial Sequence
  Description of Artificial Sequence: Synthetic coding sequence
atgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccaccagcagcatctggctgggcggggagcccatcagcagcgagcacctgcacagagctgtgtctgtgaatgatgaggacctgctggtgcgcatcctgcagggcggctag

SEQ ID NO: 152473 - DNA, 849 bp, Artificial Sequence
  Description of Artificial Sequence: Synthetic coding sequence
atgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccaccagcagcatctggctgggcggggagcccatcagcagcgagcacctgcacagagctgtgtctgtgaatgatgaggacctgctggtgcgcatcctgcagggcggccgggtgaaggtggatgtgcccaacaagtttggcttcaccgccctgatggtggccgcccagaagggctacaccagcctgatgctggcctgctacgccggccacctggatgtggtgaagtacctgcggagacatggagcctcctggcaggcccgggacctgggcggctgcacagccctgcactgggccgcagatggcggccactgcagcgtcatcgagtggatgatcaaggatggctgtgaggtggatgtggtggacaccggcagcggctggacccccctgatgagggtgtctgctgtgtctggcaaccagagggtggccagcctgctgattgatgctggggccaacgtgaatgtgaaggacagaaatggcaagacccccctgatgtctgtggtgtccctgctggaggagaggaagaagaagcagaggcccaagaagagctgtgtgtgctag

SEQ ID NO: 152474 - DNA, 1116 bp, Artificial Sequence
  Description of Artificial Sequence: Synthetic coding sequence
ctgcagaagcagaagatcatgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccacccggcccagcctgagcaagagcctggtgaagatccgcatggtgacctctgtgctgcacggccccccaacagaaaatactggagagcccatcagcagcgagcacctgcacagagctgtgtctgtgaatgatgaggacctgctggtgcgcatcctgcagggcggccgggtgaaggtggatgtgcccaacaagtttggcttcaccgccctgatggtggccgcccagaagggctacacccggctggtgaagatcctggtgtccaatggaacagatgtgaacctgaagaatggcagcggcaaggacagcctgatgctggcctgctacgccggccacctggatgtggtgaagtacctgcggagacatggagcctcctggcaggcccgggacctgggcggctgcacagccctgcactgggccgcagatggcggccactgcagcgtcatcgagtggatgatcaaggatggctgtgaggtggatgtggtggacaccggcagcggctggacccccctgatgagggtgtctgctgtgtctggcaaccagagggtggccagcctgctgattgatgctggggccaacgtgaatgtgaaggacagaaatggcaagacccccctgatggtggccgtgctgaacaaccacgaggagctggtgcagctgctgctggacaagggagcagatgcctctgtgaagaatgaatttgggaagggcgtgctggagatggcccgggtgtttgaccggcagagcgtggtgtccctgctggaggagaggaagaagaagcagaggcccaagaagagctgtgtgtgctag

SEQ ID NO: 152475 - DNA, 1038 bp, Artificial Sequence
  Description of Artificial Sequence: Synthetic coding sequence
atggagccccagaagatcatgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccacccgggagcccatcagcagcgagcacctgcacagagctgtgtctgtgaatgatgaggacctgctggtgcgcatcctgcagggcggccgggtgaaggtggatgtgcccaacaagtttggcttcaccgccctgatggtggccgcccagaagggctacacccggctggtgaagatcctggtgtccaatggaacagatgtgaacctgaagaatggcagcggcaaggacagcctgatgctggcctgctacgccggccacctggatgtggtgaagtacctgcggagacatggagcctcctggcaggcccgggacctgggcggctgcacagccctgcactgggccgcagatggcggccactgcagcgtcatcgagtggatgatcaaggatggctgtgaggtggatgtggtggacaccggcagcggctggacccccctgatgagggtgtctgctgtgtctggcaaccagagggtggccagcctgctgattgatgctggggccaacgtgaatgtgaaggacagaaatggcaagacccccctgatggtggccgtgctgaacaaccacgaggagctggtgcagctgctgctggacaagggagcagatgcctctgtgaagaatgaatttgggaagggcgtgctggagatggcccgggtgtttgaccggcagagcgtggtgtccctgctggaggagaggaagaagaagcagaggcccaagaagagctgtgtgtgctag

SEQ ID NO: 152476 - DNA, 1020 bp, Artificial Sequence
  Description of Artificial Sequence: Synthetic coding sequence
atgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccacccgggagcccatcagcagcgagcacctgcacagagctgtgtctgtgaatgatgaggacctgctggtgcgcatcctgcagggcggccgggtgaaggtggatgtgcccaacaagtttggcttcaccgccctgatggtggccgcccagaagggctacacccggctggtgaagatcctggtgtccaatggaacagatgtgaacctgaagaatggcagcggcaaggacagcctgatgctggcctgctacgccggccacctggatgtggtgaagtacctgcggagacatggagcctcctggcaggcccgggacctgggcggctgcacagccctgcactgggccgcagatggcggccactgcagcgtcatcgagtggatgatcaaggatggctgtgaggtggatgtggtggacaccggcagcggctggacccccctgatgagggtgtctgctgtgtctggcaaccagagggtggccagcctgctgattgatgctggggccaacgtgaatgtgaaggacagaaatggcaagacccccctgatggtggccgtgctgaacaaccacgaggagctggtgcagctgctgctggacaagggagcagatgcctctgtgaagaatgaatttgggaagggcgtgctggagatggcccgggtgtttgaccggcagagcgtggtgtccctgctggaggagaggaagaagaagcagaggcccaagaagagctgtgtgtgctag

SEQ ID NO: 152477 - DNA, 375 bp, Artificial Sequence
  Description of Artificial Sequence: Synthetic coding sequence
atgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccacccgggagcccatcagcagcgagcacctgcacagagctgtgtctgtgaatgatgaggacctgctggtgcgcatcctgtag

SEQ ID NO: 152478 - DNA, 402 bp, Artificial Sequence; identical to SEQ ID NO: 152472
  Description of Artificial Sequence: Synthetic coding sequence

SEQ ID NO: 152479 - DNA, 441 bp, Artificial Sequence
  Description of Artificial Sequence: Synthetic coding sequence
atgccacccagcaagccccacccccctgtggtgggcaaggtgacccaccacagcattgagctgtactgggacctggagaagaaggccaagaggcagggcccccaggagcagtggttccgcttcagcattgaggaggaggaccccaagatgcacacctacggcatcatctacacaggctacgccaccaagcacgtggtggagggcctggagcccaggaccctgtaccgcttccggctgaaggtgaccagccccagcggagaatgtgagtacagccccctggtgtctgtgtccaccaccagcgagtacagcgaccggccccacagccccctgagccgctccatggagatgaccagcaacctggagaagatcttctgcctgagctttggcctgaccaggagcagaaatgacaccatcttcaagcactgcaacaacatctgctag

SEQ ID NO: 152480 - DNA, 600 bp, Artificial Sequence
  Description of Artificial Sequence: Synthetic coding sequence
tgagagcccatcagcagcgagcacctgcacagagctgtgtctgtgaatgatgaggacctgctggtgcgcatcctgcagggcggccgggtgaaggtggatgtgcccaacaagtttggcttcaccgccctgatggtggccgcccagaagggctacacccggctggtgaagatcctggtgtccaatggaacagatgtgaacctgaagaatggaagtggcaaggacagcctgatgctggcctgctacgccggccacctggatgtggtgaagtacctgcggcggcacggggcctcctggcaggcccgggacctgggcggctgcacagccctgcactgggccgcagatggcggccactgcagcgtgattgagtggatgatcaaggatggctgtgaggtggatgtggtggacaccggcagcggctggacccccctgatgagggtgtctgctgtgtctggcaaccagagggtggccagcctgctgattgatgctggggccaacgtgaatgtgaaggacagaaatggcaagacccccctgatgtctgtggtgtccctgctggaggagaggaagaagaagcagaggcccaagaagagctgtgtgtgctag

SEQ ID NO: 152481 - DNA, 735 bp, Artificial Sequence
  Description of Artificial Sequence: Synthetic coding sequence
atggaggtgactggagtgtctgcccccaccgtgaccgtcttcatcagcagcagcctgaacaccttccgctctgagaagcgctacagccgcagcctgaccatcgccgagttcaagtgcaagctggagctgctggtgggcagccctgccagctgcatggagctggagctgtatggagtggatgacaagttctacagcaagctggaccaggaggatgccctgctgggcagctaccctgtggatgatggctgccgcatccacgtgattgaccacagcggggcccggctgggggagtatgaagatgtgtcccgggtggagaagtacaccatcagccaggaggcctatgaccagaggcaggacacagtgcgctccttcctgaagaggagcaagctgggccgctacaatgaggaggagcgggcccagcaggaggccgaggccgcccagaggctggccgaggagaaggcccaggccagcagcatccctgtgggcagccgctgtgaggtgcgggccgccggccagagcccccggcggggcaccgtgatgtatgtgggcctgacagacttcaagccaggctactggattggagtgcgctatgatgagcccctgggcaagaatgatggctctgtgaatggcaagcgctactttgagtgccaggccaagtacggggcctttgtgaagccagctgtggtgacagtgggggacttcccagaagaagattatggcctggatgagatctag

SEQ ID NO: 152482 - DNA, 1497 bp, Artificial Sequence
  Description of Artificial Sequence: Synthetic coding sequence
atggacagccagaaggaggccctgcagaggatcatcagcaccctggccaacaagaatgatgagatccagaacttcatcgacaccctgcaccacaccctgaagggcgtgcaggagaacagcagcaacatcctgtctgagctggatgaggagtttgacagcctgtacagcatcctggatgaggtgaaggagagcatgatcaactgcatcaagcaggagcaggccaggaagagccaggagctgcagagccagatcagccagtgcaacaatgccctggagaacagcgaggagctgctggagtttgccaccaggagcctggacatcaaggagcctgaggagttcagcaaggccgcccggcagatcaaggacagagtgaccatggccagcgccttccggctgagcctgaagcccaaggtgtctgacaacatgacccacctgatggtggacttcagccaggagcggcagatgctgcagaccctgaagttcctgcctgtgcccaaggcccctgagattgatcctgtggagtgcctggtggccgacaacagcgtgacagtggcctggaggatgcctgaggaggacaacaagattgaccacttcatcctggagcacaggaagaccaactttgatggcctgccccgggtgaaggatgagcgctgctgggagatcatcgacaacatcaagggcacagagtacaccctgagcggcctgaagtttgacagcaagtacatgaacttccgggtgcgggcctgcaacaaggctgtggccggggagtacagcgaccctgtgaccctggagaccaaggccctgaacttcaacctggacaacagcagcagccacctgaacctgaaggtggaggacacctgtgtggagtgggaccccactggaggcaagggccaggagagcaagatcaagggcaaggagaacaagggccgcagcggcacccccagccccaagaggacctctgtgggcagcaggcctcctgctgtgcggggcagccgggaccgcttcaccggggagagctacacagtgctgggggacacagccatcgagagcggccagcactactgggaggtgaaggcccagaaggactgcaagagctacagcgtgggcgtggcctacaagaccctgggcaagtttgaccagctgggcaagaccaacacctcctggtgcatccacgtgaacaactggctgcagaacacctttgctgccaagcacaacaacaaggtgaaggccctggatgtgacagtgcctgagaagattggagtcttctgtgactttgatggcggccagctgtccttctatgatgccaacagcaagcagctgctgtacagcttcaagaccaagttcacccagcctgtgctgcccggcttcatggtgtggtgtggcggcctgagcctgagcacaggcatgcaggtgcccagcgctgtgaggaccctgcagaagtcagaaaatggcatgacaggcagcgccagcagcctgaacaacgtggtgacccagtag

SEQ ID NO: 152483 - DNA, 438 bp, Artificial Sequence
  Description of Artificial Sequence: Synthetic coding sequence
atggacagccagaaggaggccctgcagaggatcatcagcaccctggccaacaagaatgatgagatccagaacttcatcgacaccctgcaccacaccctgaagggcgtgcaggagaacagcagcaacatcctgtctgagctggatgaggagtttgacagcctgtacagcatcctggatgaggtgaaggagagcatgatcaactgcatcaagcaggagcaggccaggaagagccaggagctgcagagccagatcagccagtgcaacaatgccctggagaacagcgaggagctgctggagtttgccaccaggagcctggacatcaaggagcctgaggagttcagcaaggtgcacaagaactgcatcaacaccctgaacaagggcagctgcatcttcaagaaggccttcctgttcttcttctcctttggcttcctgtactag

SEQ ID NO: 152484 - DNA, 1593 bp, Artificial Sequence
  Description of Artificial Sequence: Synthetic coding sequence
atggacagccagaagtactgcttcaaggaaaatgaaaatgtgacagtggacaaggcctgcttcctgatcagcaacatcaccatcggccctgagagcatcaacctgcagcaggaggccctgcagaggatcatcagcaccctggccaacaagaatgatgagatccagaacttcatcgacaccctgcaccacaccctgaagggcgtgcaggagaacagcagcaacatcctgtctgagctggatgaggagtttgacagcctgtacagcatcctggatgaggtgaaggagagcatgatcaactgcatcaagcaggagcaggccaggaagagccaggagctgcagagccagatcagccagtgcaacaatgccctggagaacagcgaggagctgctggagtttgccaccaggagcctggacatcaaggagcctgaggagttcagcaaggccgcccggcagatcaaggacagagtgaccatggccagcgccttccggctgagcctgaagcccaaggtgtctgacaacatgacccacctgatggtggacttcagccaggagcggcagatgctgcagaccctgaagttcctgcctgtgcccaaggcccctgagattgatcctgtggagtgcctggtggccgacaacagcgtgacagtggcctggaggatgcctgaggaggacaacaagattgaccacttcatcctggagcacaggaagaccaactttgatggcctgccccgggtgaaggatgagcgctgctgggagatcatcgacaacatcaagggcacagagtacaccctgagcggcctgaagtttgacagcaagtacatgaacttccgggtgcgggcctgcaacaaggctgtggccggggagtacagcgaccctgtgaccctggagaccaaggccctgaacttcaacctggacaacagcagcagccacctgaacctgaaggtggaggacacctgtgtggagtgggaccccactggaggcaagggccaggagagcaagatcaagggcaaggagaacaagggccgcagcggcacccccagccccaagaggacctctgtgggcagcaggcctcctgctgtgcggggcagccgggaccgcttcaccggggagagctacacagtgctgggggacacagccatcgagagcggccagcactactgggaggtgaaggcccagaaggactgcaagagctacagcgtgggcgtggcctacaagaccctgggcaagtttgaccagctgggcaagaccaacacctcctggtgcatccacgtgaacaactggctgcagaacacctttgctgccaagcacaacaacaaggtgaaggccctggatgtgacagtgcctgagaagattggagtcttctgtgactttgatggcggccagctgtccttctatgatgccaacagcaagcagctgctgtacagcttcaagaccaagttcacccagcctgtgctgcccggcttcatggtgtggtgtggcggcctgagcctgagcacaggcatgcaggtgcccagcgctgtgaggaccctgcagaagtcagaaaatggcatgacaggcagcgccagcagcctgaacaacgtggtgacccagtag

SEQ ID NO: 152485 - DNA, 1152 bp, Artificial Sequence
  Description of Artificial Sequence: Synthetic coding sequence
atggccagcgccttccggctgagcctgaagcccaaggtgtctgacaacatgacccacctgatggtggacttcagccaggagcggcagatgctgcagaccctgaagttcctgcctgtgcccaaggcccctgagattgatcctgtggagtgcctggtggccgacaacagcgtgacagtggcctggaggatgcctgaggaggacaacaagattgaccacttcatcctggagcacaggaagaccaactttgatggcctgccccgggtgaaggatgagcgctgctgggagatcatcgacaacatcaagggcacagagtacaccctgagcggcctgaagtttgacagcaagtacatgaacttccgggtgcgggcctgcaacaaggctgtggccggggagtacagcgaccctgtgaccctggagaccaaggccctgaacttcaacctggacaacagcagcagccacctgaacctgaaggtggaggacacctgtgtggagtgggaccccaccggcggcaagggccaggagagcaagatcaagggcaaggaaaataaaggatctgtgcacgtgaccagcctgaagaagcacaccagcggcacccccagccccaagaggacctctgtgggcagccggcccccagctgtgcggggcagccgggaccgcttcaccggggagagctacacagtgctgggggacacagccattgaaagtggccagcactactgggaggtgaaggcccagaaggactgcaagagctacagcgtgggcgtggcctacaagaccctgggcaagtttgaccagctgggcaagaccaacacctcctggtgcatccacgtgaacaactggctgcagaacacctttgctgccaagcacaacaacaaggtgaaggccctggatgtgacagtgcctgagaagattggagtcttctgtgactttgatggcggccagctgtccttctatgatgccaacagcaagcagctgctgtacagcttcaagaccaagttcacccagcctgtgctgcccggcttcatggtgtggtgtggcggcctgagcctgagcacaggcatgcaggtgcccagcgctgtgaggaccctgcagaagtcagaaaatggcatgactggaagtgccagcagcctgaacaacgtggtgacccagtag

SEQ ID NO: 152486 - DNA, 5685 bp, Artificial Sequence
  Description of Artificial Sequence: Synthetic coding sequence
atggcccctgaggccggggccaccctgcgggccccccggcggctgtcctgggccgccctgctgctgctggccgccctgctgcctgtggccagcagcgctgctgcctctgtggaccaccccctgaagcccaggcatgtgaagctgctgagcaccaagatgggcctgaaggtgacctgggacccccccaaggatgccaccagcaggcctgtggagcactacaacatcgcctacggcaagagcctgaagagcctgaagtacatcaaggtgaatgctgagacctacagcttcctgattgaagatgtggagcccggggtggtgtactttgtgctgctgacagctgagaaccacagcggcgtgtccaggcctgtgtacagagctgagagccccccaggaggagagtggattgaaattgatggcttccccatcaagggccctggccccttcaatgaaacagtgacagagaaggaggtgcccaacaagcccctgcgggtgcgggtgcgcagcagtgatgaccggctgtctgtggcctggaaggccccccggctgagcggggccaagagccccaggaggagccggggcttcctgctgggctacggggagagcggcaggaagatgaactacgtgcccctgaccagagatgagaggacccatgagatcaagaagctggccagcgagagcgtgtatgtggtgtccctgcagagcatgaacagccagggccgcagccagcctgtgtacagagctgccctgaccaagaggaagatcagtgaagaagatgagctggatgtgcctgatgacatctctgtgcgggtgatgagcagccagagcgtgctggtgtcctgggtggaccctgtgctggagaagcagaagaaggtggtggccagccggcagtacacagtgcgctaccgggagaagggggagctggcccgctgggactacaagcagatcgccaacagaagagtgctgattgaaaatctcatcccagacacagtgtatgaatttgctgtgcgcatcagccagggcgagagagatggcaagtggagcacctctgtgttccagaggaccccagagagcgcccccaccacagcccctgagaacctgaatgtgtggcctgtgaatggcaagcccaccgtggtggccgcctcctgggatgccctgcctgagacagagggcaaggtgaaggagtacatcctgtcctatgccccagccctgaagccctttggagccaagagcctgacctacccaggggacaccaccagcgccctggtggatggcctgcagcctggagagcgctacctgttcaagatccgggccaccaacagaagaggcctgggcccccacagcaaggccttcatcgtggccatgcccaccaccagcaaggcagatgtggagcagaacacagaagataatggcaagccagagaagccagagcccagcagccccagcccccgggccccagccagcagccagcaccccagcgtgcctgccagcccccagggcagaaatgccaaggacctgctgctggacctgaagaacaagatcctggccaacggcggggcccccaggaagccccagctgcgggccaagaaggccgaggagctggacctgcagagcacagagatcactggagaggaggagctgggcagccgggaggacagccccatgagccccagcgacacccaggaccagaagaggaccctgcggccccccagccgccacggccacagcgtggtggcccctggccgcacagctgtgcgggccaggatgcctgccctgccccggcgggagggcgtggacaagccaggcttcagcctggccacccagcccaggcctggggcccctccttctgccagcgccagccctgcccaccacgccagcacccagggcaccagccaccggcccagcctgcctgccagcctgaatgacaatgacctggtggacagtgatgaagatgaaagagctgtgggcagcctgcaccccaagggggcctttgcccagcccaggcctgccctgagccccagccggcagagccccagctctgtgctgcgggacaggagctctgtgcaccctggggccaagccagccagccctgcccggaggaccccccacagcggggctgctgaggaggacagcagcgccagcgccccacccagccggctgagcccccctcatggaggcagcagccggctgctgcccacccagccccacctgagcagccccctgagcaagggcggcaaggatggagaagatgccccagccaccaacagcaatgcccccagccgcagcaccatgagcagctctgtgagcagccacctgagcagcaggacccaggtgtctgagggcgctgaggccagtgatggagagagccatggagatggagacagagaagatggcggccggcaggccgaggccacagcccagaccctgcgggcccggcctgccagcggccacttccacctgctgcggcacaagccctttgctgccaacggccgcagccccagccgcttcagcatcggccggggcccccggctgcagcccagcagcagcccccagagcacagtgcccagccgggcccacccccgggtgcccagccacagcgacagccaccccaagctgagcagcggcatccatggagatgaggaggatgagaagcccctgcctgccaccgtggtgaatgaccacgtgcccagcagcagccggcagcccatcagccggggctgggaggacctgcggcgcagcccccagagaggagccagcctgcacaggaaggagcccatccctgagaaccccaagagcactggagctgacacccacccccagggcaagtacagcagcctggccagcaaggcccaggatgtgcagcagagcacagatgctgacacagagggccacagccccaaggcccagcccggcagcacagacagacatgccagccctgcccggcccccagctgcccggagccagcagcaccccagcgtgcccaggaggatgaccccaggccgggccccccagcagcagcccccacctcctgtggccaccagccagcaccaccctggcccccagagcagagatgctggccgcagccccagccagccccggctgagcctgacccaggccggccggccccggcccaccagccagggccgcagccacagcagcagtgacccctacacagccagcagccggggcatgctgcccacagccctgcagaaccaggatgaagatgcccagggcagctatgatgatgacagcacagaggtggaggcccaggatgtgcgggccccagcccatgctgcccgggccaaggaggccgccgccagcctgcccaagcaccagcaggtggagagccccactggagctggagctggaggagaccacaggagccagaggggccacgccgccagccctgcccggcccagcaggcctgggggcccccagagccgggcccgggtgcccagccgggccgcccctgggaagtctgagccccccagcaagaggcccctgagcagcaagagccagcagagcgtgtctgcagaagatgatgaggaggaggatgctggcttcttcaagggcggcaaggaggacctgctgagcagctctgtgcccaagtggcccagcagcagcaccccccggggcggcaaggatgctgatggcagcctggccaaggaggagcgggagcccgccatcgccctggccccccggggcggcagcctggcccctgtgaagaggcccctgcccccacctcctggcagcagcccccgggccagccacgtgcccagccggctgccccccaggtctgctgccaccgtgtcccctgtggccggcacccacccctggccccagtacaccacccgggcccctcctggccacttcagcaccacccccatgctgagcctgcggcagaggatgatgcacgcccgcttcaggaaccccctgagccggcagcctgcccggcccagctaccggcagggctacaacggccggcccaacgtggagggcaaggtgctgcccggcagcaatggcaagcccaacggccagaggatcatcaatggcccccagggcaccaagtgggtggtggacctggaccggggcctggtgctgaatgctgagggccgctacctgcaggacagccacggcaaccccctgcgcatcaagctgggcggagatggccgcaccatcgtggacctggagggcacccctgtggtgtccccagatggcctgcccctgtttggccagggccgccacggcacccccctggccaatgcccaggacaagcccatcctgagcctgggcggcaagcccctggtgggcctggaggtgatcaagaagaccacccacccccccaccaccaccatgcagcccaccaccaccaccacccccctgcccaccaccaccaccccccggcccaccacagccaccaccaggaggaccaccaccaccaggaggaccaccacccggcggcccaccaccaccgtgaggaccaccaccaggaccaccaccaccaccacccccacccccaccacccccatccccacctgccccccaggcaccctggagagacatgatgatgatggcaacctgatcatgagcagcaatggcatcccagaatgttatgcagaggaggatgagttcagcggcctggagacagacacagctgtgcccacagaggaggcctacgtgatctatgatgaagattatgaatttgagaccagccggccccccaccaccacagagcccagcaccacagccaccacccccagggtcatccctgaggagggcgccatcagcagcttccctgaggaggagtttgacctggccggcaggaagagatttgtggccccctacgtgacctacctgaacaaggaccccagcgccccctgcagcctgacagatgccctggaccacttccaggtggacagcctggatgagatcatccccaatgacctgaagaagagtgacctgcccccccagcacgcccccaggaacatcaccgtggtggccgtggagggctgccacagctttgtgattgtggactgggacaaggccaccccaggagatgtggtgacaggctacctggtgtacagcgccagctatgaggacttcatccggaacaagtggagcacccaggccagctctgtgacccacctgcccatcgagaacctgaagcccaacacccgctactacttcaaggtgcaggcccagaacccccacggctacggccccatcagccccagcgtgtcctttgtgacagaaagtgacaaccccctgctggtggtgcggcccccaggaggagagcccatctggatcccctttgccttcaagcatgaccccagctacacagactgccacggccggcagtatgtgaagaggacctggtacaggaagtttgtgggcgtggtgctgtgcaacagcctgcgctacaagatctacctgagtgacaacctgaaggacaccttctacagcattggagacagctggggcagaggagaggaccactgccagtttgtggacagccacctggatggccgcacaggcccccagagctatgtggaggccctgcccaccatccagggctactaccggcagtaccggcaggagcctgtgcgctttggaaacatcggcttcggcaccccctactactacgtgggctggtatgaatgtggggtgtccatccctgggaagtggtag

SEQ ID NO: 152487 - DNA, 5496 bp, Artificial Sequence
  Description of Artificial Sequence: Synthetic coding sequence
atggcccctgaggccggggccaccctgcgggccccccggcggctgtcctgggccgccctgctgctgctggccgccctgctgcctgtggccagcagcgctgctgcctctgtggaccaccccctgaagcccaggcatgtgaagctgctgagcaccaagatgggcctgaaggtgacctgggacccccccaaggatgccaccagcaggcctgtggagcactacaacatcgcctacggcaagagcctgaagagcctgaagtacatcaaggtgaatgctgagacctacagcttcctgattgaagatgtggagcccggggtggtgtactttgtgctgctgacagctgagaaccacagcggcgtgtccaggcctgtgtacagagctgagagccccccaggaggagagtggattgaaattgatggcttccccatcaagggccctggccccttcaatgaaacagtgacagagaaggaggtgcccaacaagcccctgcgggtgcgggtgcgcagcagtgatgaccggctgtctgtggcctggaaggccccccggctgagcggggccaagagccccaggaggagccggggcttcctgctgggctacggggagagcggcaggaagatgaactacgtgcccctgaccagagatgagaggacccatgagatcaagaagctggccagcgagagcgtgtatgtggtgtccctgcagagcatgaacagccagggccgcagccagcctgtgtacagagctgccctgaccaagaggaagatcagtgaagaagatgagctggatgtgcctgatgacatctctgtgcgggtgatgagcagccagagcgtgctggtgtcctgggtggaccctgtgctggagaagcagaagaaggtggtggccagccggcagtacacagtgcgctaccgggagaagggggagctggcccgctgggactacaagcagatcgccaacagaagagtgctgattgaaaatctcatcccagacacagtgtatgaatttgctgtgcgcatcagccagggcgagagagatggcaagtggagcacctctgtgttccagaggaccccagagagcgcccccaccacagcccctgagaacctgaatgtgtggcctgtgaatggcaagcccaccgtggtggccgcctcctgggatgccctgcctgagacagagggcaaggtgaaggccagcaaggcagatgtggagcagaacacagaggacaacgggaagccagagaagccagagcccagcagccccagcccccgggccccagccagcagccagcaccccagcgtgcctgccagcccccagggcagaaatgccaaggacctgctgctggacctgaagaacaagatcctggccaatggaggagcccccaggaagccccagctgcgggccaagaaggccgaggagctggacctgcagagcacagagatcaccggggaggaggagctgggcagccgggaggacagccccatgagccccagcgacacccaggaccagaagaggaccctgcggccccccagcagacatggccacagcgtggtggcccctggccgcacagctgtgcgggccaggatgcctgccctgccccggcgggagggcgtggacaagccaggcttcagcctggccacccagcccaggcctggggccccacccagcgccagcgccagccctgcccaccacgccagcacccagggcaccagccaccggcccagcctgcctgccagcctgaatgacaatgacctggtggacagtgatgaagatgaaagagctgtgggcagcctgcaccccaagggggcctttgcccagcccaggcctgccctgagccccagccggcagagccccagctctgtgctgcgggacaggagctctgtgcaccctggggccaagccagccagccctgcccggaggaccccccacagcggggctgctgaggaggacagcagcgccagcgccccacccagccggctgagccccccccacggcggcagcagccggctgctgcccacccagccccacctgagcagccccctgagcaaaggaggcaaggatggagaagatgccccagccaccaacagcaatgcccccagccgcagcaccatgagcagctctgtgagcagccacctgagcagcaggacccaggtgtctgagggcgctgaggccagtgatggagagagccatggagatggagaccgggaggatggcggccggcaggccgaggccacagcccagaccctgcgggcccggcctgccagcggccacttccacctgctgcggcacaagccctttgctgccaacggccgcagccccagccgcttcagcatcggccggggcccccggctgcagcccagcagcagcccccagagcacagtgcccagccgggcccacccccgggtgcccagccacagcgacagccaccccaagctgagcagcggcatccatggagatgaagaagatgagaagcccctgcctgccaccgtggtgaatgaccacgtgcccagcagcagccggcagcccatcagccggggctgggaggacctgcggcgcagcccccagagaggagccagcctgcacaggaaggagcccatccctgagaaccccaagagcactggagctgacacccacccccagggcaagtacagcagcctggccagcaaggcccaggatgtgcagcagagcacagatgctgacacagagggccacagccccaaggcccagcccggcagcacagacagacatgccagccctgcccggcccccagctgcccggagccagcagcaccccagcgtgcccaggaggatgaccccaggccgggccccccagcagcagcccccacctcctgtggccaccagccagcaccaccctggcccccagagcagagatgctggccgcagccccagccagccccggctgagcctgacccaggccggccggccccggcccaccagccagggccgcagccacagcagcagtgacccctacacagccagcagccggggcatgctgcccacagccctgcagaaccaggatgaagatgcccagggcagctatgatgatgacagcacagaggtggaggcccaggatgtgcgggccccagcccacgccgcccgggccaaggaggccgccgccagcctgcccaagcaccagcaggtggagagccccaccggggccggggccggcggggaccacaggagccagaggggccatgctgccagccctgcccggcccagcaggcctgggggcccccagagccgggcccgggtgcccagcagagctgcccctgggaagtctgagccccccagcaagaggcccctgagcagcaagagccagcagagcgtgtctgcagaagatgatgaggaggaggatgctggcttcttcaagggcggcaaggaggacctgctgagcagctctgtgcccaagtggcccagcagcagcaccccccggggcggcaaggatgctgatggcagcctggccaaggaggagcgggagcccgccatcgccctggccccccggggcggcagcctggcccctgtgaagaggcccctgcccccacctcctggcagcagcccccgggccagccacgtgcccagccggctgcccccaagatctgctgccaccgtgtcccctgtggccggcacccacccctggccccagtacaccacccgggcccctcctggccacttcagcaccacccccatgctgagcctgcggcagaggatgatgcacgcccgcttcaggaaccccctgagccggcagcctgcccggcccagctaccggcagggctacaacggccggcccaacgtggagggcaaggtgctgcccggcagcaatggcaagcccaacggccagaggatcatcaatggcccccagggcaccaagtgggtggtggacctggaccggggcctggtgctgaatgctgagggccgctacctgcaggacagccacggcaaccccctgcgcatcaagctgggcggagatggccgcaccatcgtggacctggagggcacccctgtggtgtccccagatggcctgcccctgtttggccagggcagacatggcacccccctggccaatgcccaggacaagcccatcctgagcctgggcggcaagcccctggtgggcctggaggtgatcaagaagaccacccacccccccaccaccaccatgcagcccaccaccaccaccacccccctgcccaccaccaccaccccccggcccaccacagccaccaccaggaggaccaccaccaccaggaggaccaccacccggcggcccaccaccaccgtgaggaccaccaccaggaccaccaccaccaccacccccacccccaccacccccatccccacctgccccccaggcaccctggagagacatgatgatgatggcaacctgatcatgagcagcaatggcatccctgagtgctacgcagaagaagatgagttcagcggcctggagacagacacagctgtgcccacagaggaggcctacgtgatctatgatgaggactatgaatttgagaccagcaggcctcccaccaccacagagcccagcaccacagccaccacccccagggtcatccctgaggagggcgccatcagcagcttccctgaggaggagtttgacctggccggcaggaagagatttgtggccccctacgtgacctacctgaacaaggaccccagcgccccctgcagcctgacagatgccctggaccacttccaggtggacagcctggatgagatcatccccaatgacctgaagaagagtgacctgcccccccagcacgcccccaggaacatcaccgtggtggccgtggagggctgccacagctttgtgattgtggactgggacaaggccaccccaggagatgtggtgacaggctacctggtgtacagcgccagctatgaggacttcatccggaacaagtggagcacccaggccagctctgtgacccacctgcccatcgagaacctgaagcccaacacccgctactacttcaaggtgcaggcccagaacccccacggctacggccccatcagccccagcgtgtcctttgtgacagaaagtgacaaccccctgctggtggtgcggcccccaggaggagagcccatctggatcccctttgccttcaagcatgaccccagctacacagactgccacggccggcagtatgtgaagaggacctggtacaggaagtttgtgggcgtggtgctgtgcaacagcctgcgctacaagatctacctgagtgacaacctgaaggacaccttctacagcatcggggacagctggggccgcggggaggaccactgccagtttgtggacagccacctggatggccgcacaggcccccagagctatgtggaggccctgcccaccatccagggctactaccggcagtaccggcaggagcctgtgcgcttcggcaacattggatttggcaccccctactactacgtgggctggtatgaatgtggggtgtccatccctgggaagtggtag

SEQ ID NO: 152488 - DNA, 3615 bp, Artificial Sequence
  Description of Artificial Sequence: Synthetic coding sequence
atgtatgtgaccatgatgatgacagaccagatccccctggagctgccccccctgctgaatggagaggtggccatgatgccccacctggtgaatggagatgctgcccagcaggtgatcctggtgcaggtgaaccctggagagaccttcaccatccgggcagaagatggcaccctgcagtgcatccagggccctgctgaggtgcccatgatgagccccaacggcagcatcccccccatccacgtgcccccaggctacatcagccaggtgattgaggacagcactggagtgagaagagtggtggtgaccccccagagccctgagtgctacccacccagctaccccagcgccatgagccccacccaccacctgcccccctacctgacccaccacccccacttcatccacaacagccacacagcctactacccacctgtgacaggccctggggacatgccaccccagttcttcccccagcaccacctgccccacaccatctacggggagcaggagatcatccccttctacggcatgagcacctacatcacccgggaggaccagtacagcaagccaccccacaagaagctgaaggaccggcagattgaccggcagaaccggctgaacagcccccccagcagcatctacaagagcagctgcaccaccgtgtacaacggctacggcaagggccacagcggcggcagcggcggcggcggcagcggcagcggccctggcatcaagaagacagaaagaagagcccggagcagccccaagagcaatgacagcgacctgcaggagtatgagctggaggtgaagagggtgcaggacatcctgtctggaattgagaagccccaggtgagcaacatccaggcccgggctgtggtgctgtcctgggcccctcctgtgggcctgagctgtggcccccacagcggcctgtccttcccctacagctatgaggtggccctgagtgacaagggcagagatggcaagtacaagatcatctacagcggggaggagctggagtgcaacctgaaggacctgcggcctgccacagactaccacgtgcgggtgtatgccatgtacaacagcgtgaagggcagctgcagcgagcctgtgtccttcaccacccacagctgtgcccctgagtgccccttcccccccaagctggcccacaggagcaagagcagcctgaccctgcagtggaaggcccccatcgacaatggcagcaagatcaccaactacctgctggagtgggatgagggcaagagaaattctggcttccggcagtgcttcttcggcagccagaagcactgcaagctgaccaagctgtgcccagccatgggctacaccttccggctggccgccagaaatgacatcggcaccagcggctacagccaggaggtggtgtgctacaccctgggcaacatcccccagatgcccagcgccccccggctggtgcgggccggcatcacctgggtgaccctgcagtggagcaagccagagggctgcagccctgaggaggtgatcacctacaccctggagatccaggaggatgaaaatgacaacctcttccaccccaagtacacaggagaggacctgacctgcaccgtgaagaacctgaagaggagcacccagtacaagttccggctgacagccagcaacacagagggcaagagctgccccagcgaggtgctggtgtgcaccaccagcccagaccggcccggcccccccacccggcccctggtgaagggccctgtgaccagccacggcttctctgtgaagtgggacccccccaaggacaatggaggcagcgagatcctgaagtacctgctggagatcacagatggcaacagcgaggccaaccagtgggaggtggcctacagcggcagcgccacagagtacaccttcacccacctgaagccaggcaccctgtacaagctgcgggcctgctgcatcagcactggaggccacagccagtgcagcgagagcctgcctgtgaggaccctgagcatcgcccctggccagtgccggcccccccgggtgctgggccggcccaagcacaaggaggtgcacctggagtgggatgtgcctgccagcgagagcggctgtgaggtgtctgagtacagcgtggagatgacagagccagaagatgtggccagcgaggtgtaccacggccctgagctggagtgcaccgtgggcaacctgctgcccggcaccgtgtaccgcttccgggtgcgggccctgaatgatggcggctacggcccctacagtgatgtgtctgagatcaccacagctgctggccccccaggccagtgcaaggccccctgcatcagctgcaccccagatggctgtgtgctggtgggctgggagagcccagacagcagtggagctgacatcagcgagtaccgcctggagtggggagaagatgaggagagcctggagctgatctaccacggcacagacaccaggtttgagatccgggacctgctgcctgctgcccagtactgctgccgcctgcaggccttcaaccaggccggggccggcccctacagcgagctggtgctgtgccagaccccagccagcgccccagaccctgtgtccaccctgtgtgtgctggaggaggagcccctggatgcctacccagacagccccagcgcctgcctggtgctgaactgggaggagccctgcaacaacggcagcgagatcctggcctacaccatcgacctgggggacaccagcatcaccgtgggcaacaccaccatgcacgtgatgaaggacctgctgcctgagaccacctaccgcatccgcatccaggccatcaatgaaattggagctggccccttcagccagttcatcaaggccaagacccggcccctgccccccctgcccccccggctggagtgtgccgctgctggcccccagagcctgaagctgaagtggggagacagcaacagcaagacccatgctgctgaagatattgtgtacaccctgcagctggaggacaggaacaagcgcttcatcagcatctaccggggccccagccacacctacaaggtgcagaggctgacagagttcacctgctacagcttccgcatccaggccgccagcgaggccggggagggccccttcagcgagacctacaccttcagcaccaccaagtctgtgccccccaccatcaaggccccccgggtgacccagctggagggcaacagctgtgagatcctgtgggagaccgtgcccagcatgaagggggaccctgtgaactacatcctgcaggtgctggtgggccgggagagcgagtacaagcaggtgtacaagggggaggaggccaccttccagatcagcggcctgcagaccaacacagactaccgcttccgggtgtgtgcctgccgccgctgcctggacaccagccaggagctgagcggggccttcagccccagcgctgcctttgtgctgcagaggtctgaggtgatgctgaccggggacatgggcagcctggatgaccccaagatgaagtccatgatgcccacagatgagcagtttgctgccatcatcgtgctgggctttgccaccctgagcatcctgtttgccttcatcctgcagtacttcctgatgaagtag

SEQ ID NO: 152489 - DNA, 216 bp, Artificial Sequence
  Description of Artificial Sequence: Synthetic coding sequence
atgtatgtgaccatgatgatgacagaccagatccccctggagctgccccccctgctgaatggagaggtggccatgatgccccacctggtgaatggagatgctgcccagcaggtgatcctggtgcaggtgaaccctggagagaccttcaccatccgggcagaagatggcaccctgcagtgcatccaggaggtgaatgtgaagaggcactgcctgtag

SEQ ID NO: 152490 - DNA, 3615 bp, Artificial Sequence; identical to SEQ ID NO: 152488
  Description of Artificial Sequence: Synthetic coding sequence

SEQ ID NO: 152491 - DNA, 3615 bp, Artificial Sequence; identical to SEQ ID NO: 152488
  Description of Artificial Sequence: Synthetic coding sequence

SEQ ID NO: 152492 - DNA, 627 bp, Artificial Sequence
  Description of Artificial Sequence: Synthetic coding sequence
atgttcaccaaggagaagatctggagcgaggtgatcctggtgcaggtgaaccctggagagaccttcaccatccgggcagaagatggcaccctgcagtgcatccagggccctgctgaggtgcccatgatgagccccaacggcagcatcccccccatccacgtgcccccaggctacatcagccaggtgattgaggacagcactggagtgcggcgggtggtggtgaccccccagagccctgagtgctacccacccagctaccccagcgccatgagccccacccaccacctgcccccctacctgacccaccacccccacttcatccacaacagccacacagcctactacccacctgtgactggacctggggacatgccaccccagttcttcccccagcaccacctgccccacaccatctatggagagcaggagatcatccccttctacggcatgagcacctacatcacccgggaggaccagtacagcaagccaccccacaagaagctgaaggaccggcagattgaccggcagaaccggctgaacagcccccccagcagcatctacaagagcagctgcaccaccgtgtacaacggctacggcaagggccacagcggcggcagcggcggctag

SEQ ID NO: 152493 - DNA, 705 bp, Artificial Sequence
  Description of Artificial Sequence: Synthetic coding sequence
atgcccagcggctgccacagcagccccccatctggcctgcggggggacatggccagcctggtgcccctgagcccctacctgagccccaccgtgctgctgctggtgtcctgtgacctgggctttgtgcgggctgacaggcctcccagccctgtgaatgtgacagtgacccacctgcgggccaacagcgccaccgtgtcctgggatgtgcctgagggcaacatcgtcatcggctacagcatcagccagcagaggcagaatggacctggccagagggtcatccgggaggtgaacaccaccacccgggcctgtgccctgtggggcctggccgaggacagcgactacacagtgcaggtgcgcagcatcggcctgcggggggagagccccccaggcccccgggtgcacttccgcaccctgaagggcagtgaccggctgcccagcaacagcagcagccctggggacatcaccgtggagggcctggatggagagcggcccctgcagacaggagaggtggtgatcatcgtggtggtgctgctgatgtgggccgccgtcatcggcctcttctgccggcagtatgacatcatcaaggacaatgacagcaacaacaaccccaaggagaagggcaagggccctgagcagagcccccagggccggcctgtgggcacccggcagaagaagagccccagcatcaacaccattgatgtgtag

SEQ ID NO: 152494 - DNA, 2478 bp, Artificial Sequence
  Description of Artificial Sequence: Synthetic coding sequence
atggtgggcaagagccagcagacagatgtgattgagaagaagaagcacatggccatccccaagagcagcagccccaaggccacccacagaattggcaacaccagcggcagcaagggcagctacagcgccaaggcctatgagagcatccgggtgtcctctgagctgcagcagacctggaccaagaggaagcacggccaggagatgaccagcaagagcctgcagacagacaccatcgtggaggagaagaaggaggtgaagctggtggaggagaccgtggtgcctgaggagaagtctgcagatgtgcgggaggccgccatcgagctgcctgagagcgtgcaggatgtggagatcccccccaacatccccagcgtgcagctgaagatggacaggagccagcagaccagcaggacaggctactggaccatgatgaacatcccccctgtggagaaggtggacaaggagcagcagacctacttcagcgagagcgagatcgtggtgatcagcaggccagacagcagcagcaccaagagcaaagaagatgccctgaagcacaagagcagcggcaagatctttgccagcgagcaccctgagttccagcctgccaccaacagcaatgaggagatcggccagaagaacatcagcaggaccagcttcacccaggagaccaagaagggcccccctgtgctgctggaggatgagctgcgggaggaggtgacagtgcctgtggtgcaggagggcagcgctgtgaagaaggtggccagcgctgagattgagccccccagcacagagaagtttcctgccaagatccagccccccctggtggaggaggccacagccaaggccgagcccaggcctgctgaggagacccacgtgcaggtgcagcccagcacagaggagaccccagatgctgaggccgccacagctgtggctgaaaattctgtgaaggtgcagcccccacctgctgaggaggcccccctggtggagttccctgctgagatccagcccccatctgctgaggagagccccagcgtggagctgctggccgagatcctgccccccagcgctgaggagagccccagcgaggagcccccagctgagatcctgcccccacctgctgagaagagccccagcgtggagctgctgggggagatccgcagccccagcgcccagaaggcccccatcgaggtgcagcccctgcctgctgagggcgccctggaggaggccccagccaaggtggagccccccaccgtggaggagaccctggctgatgtgcagcccctgctgcctgaggaggccccccgggaggaggcccgggagctgcagctgagcacagccatggagaccccagctgaggaggcccccacagagttccagagccccctgcccaaggagaccacagctgaggaggccagcgctgagatccagctgctggccgccacagagcccccagcagatgagaccccagctgaggcccggagccccctgtctgaggagaccagcgctgaggaggcccacgccgaggtgcagagccccctggccgaggagaccacagctgaggaggccagcgctgagatccagctgctggccgccatcgaggccccagcagatgagaccccagctgaggcccagagccccctgtctgaggagaccagcgctgaggaggccccagctgaggtgcagagccccagcgccaagggcgtgtccattgaggaggcccccctggagctgcagccccccagcggggaggagaccacagctgaggaggccagcgctgccatccagctgctggccgccacagaggccagcgctgaggaggccccagctgaggtgcagcccccacctgctgaggaggccccagctgaggtgcagcccccacctgctgaggaggccccagctgaggtgcagcccccacctgctgaggaggccccagctgaggtgcagcccccacctgctgaggaggccccagctgaggtgcagcccccacctgctgaggaggccccagctgaggtgcagcccccacctgctgaggaggccccagctgaggtgcagagcctgcctgctgaggagacccccatcgaggagaccctggccgctgtgcacagccccccagcagatgatgtgcctgctgaggaggcctctgtggacaagcacagccccccagctgacctgctgctgacagaggagttccccatcggggaggccagcgctgaggtgagccccccaccttctgagcagaccccagaagatgaggccctggtggagaatgtgtccacagagttccagagcccccaggtggccggcatcccagctgtgaagctgggctctgtggtgctggagggggaggccaagtttgaggaggtgtccaagatcaacagcgtgctgaaggacctgagcaacaccaatgatggccaggcccccaccctggagattgagagcgtcttccacatcgagctgaagcagaggcctcctgagctgtag

SEQ ID NO: 152495 - DNA, 2157 bp, Artificial Sequence
  Description of Artificial Sequence: Synthetic coding sequence
atggtgggcaagagccagcagacagatgtgattgagaagaagaagcacatggccatccccaagagcagcagccccaaggccacccacagaattggcaacaccagcggcagcaagggcagctacagcgccaaggcctatgagagcatccgggtgtcctctgagctgcagcagacctggaccaagaggaagcacggccaggagatgaccagcaagagcctgcagacagacaccatcgtggaggagaagaaggaggtgaagctggtggaggagaccgtggtgcctgaggagaagtctgcagatgtgcgggaggccgccatcgagctgcctgagagcgtgcaggatgtggagatcccccccaacatccccagcgtgcagctgaagatggacaggagccagcagaccagcaggacaggctactggaccatgatgaacatcccccctgtggagaaggtggacaaggagcagcagacctacttcagcgagagcgagatcgtggtgatcagcaggccagacagcagcagcaccaagagcaaagaagatgccctgaagcacaagagcagcggcaagatctttgccagcgagcaccctgagttccagcctgccaccaacagcaatgaggagatcggccagaagaacatcagcaggaccagcttcacccaggagaccaagaagggcccccctgtgctgctggaggatgagctgcgggaggaggtgacagtgcctgtggtgcaggagggcagcgctgtgaagaaggtggccagcgctgagattgagccccccagcacagagaagtttcctgccaagatccagccccccctggtggaggaggccacagccaaggccgagcccaggcctgctgaggagacccacgtgcaggtgcagcccagcacagaggagaccccagatgctgaggccgccacagctgtggctgaaaattctgtgaaggtgcagcccccacctgctgaggaggcccccctggtggagttccctgctgagatccagcccccatctgctgaggagagccccagcgtggagctgctggccgagatcctgccccccagcgctgaggagagccccagcgaggagcccccagctgagatcctgcccccacctgctgagaagagccccagcgtggagctgctgggggagatccgcagccccagcgcccagaaggcccccatcgaggtgcagcccctgcctgctgagggcgccctggaggaggccccagccaaggtggagccccccaccgtggaggagaccctggctgatgtgcagcccctgctgcctgaggaggccccccgggaggaggcccgggagctgcagctgagcacagccatggagaccccagctgaggaggcccccacagagttccagagccccctgcccaaggagaccacagctgaggaggccagcgctgagatccagctgctggccgccacagagaccagcgctgaggaggccccagctgaggtgcagagccccagcgctgaggaggccccagctgaggtgcagcccccacctgctgaggaggccccagctgaggtgcagcccccacctgctgaggaggccccagctgaggtgcagcccccacctgctgaggaggccccagctgaggtgcagcccccacctgctgaggaggccccagctgaggtgcagcccccacctgctgaggaggccccagctgaggtgcagcccccacctgctgaggaggccccagctgaggtgcagagcctgcctgctgaggagacccccatcgaggagaccctggccgctgtgcacagccccccagcagatgatgtgcctgctgaggaggcctctgtggacaagcacagccccccagctgacctgctgctgacagaggagttccccatcggggaggccagcgctgaggtgtccccaccacccagcgagcagaccccagaagatgaggccctggtggagaatgtgtccacagagttccagagcccccaggtggccggcatcccagctgtgaagctgggctctgtggtgctggagggggaggccaagtttgaggaggtgtccaagatcaacagcgtgctgaaggacctgagcaacaccaatgatggccaggcccccaccctggagattgaatctgtgttccacatcgagctgaagcagaggcctcctgagctgtag

SEQ ID NO: 152496 - DNA, 2052 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgccggggcggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaaggacattgatgaatgtgagagcggcatccacaactgcctgcctgacttcatctgccagaacaccctgggcagcttccgctgccggcccaagctgcagtgcaagagcggcttcatccaggatgccctgggcaactgcatcgacatcaatgaatgtctgagcatcagcgccccctgccccatcggccacacctgcatcaacacagagggcagctacacctgccagaagaatgtgcccaactgtggccggggctaccacctgaatgaggagggcacccgctgtgtggatgtggatgaatgtgcccccccagctgagccctgtgggaagggccaccgctgtgtgaacagccctggcagcttccgctgtgagtgcaagacaggctactactttgatggcatcagcaggatgtgtgtggatgtgaatgaatgccagcgctacccaggccgcctgtgtggccacaagtgtgagaacaccctgggcagctacctgtgcagctgcagcgtgggcttccggctgtctgtggatggccgcagctgtgaggacatcaatgaatgtagcagcagcccctgcagccaggagtgtgccaacgtgtatggcagctaccagtgctactgccggcggggctaccagctgagtgatgtggatggagtgacctgtgaggacattgatgaatgtgccctgcccactggaggccacatctgcagctaccgctgcatcaacatccctggcagcttccagtgcagctgccccagcagcggctaccgcctggccccaaatggaagaaactgccaggacattgatgaatgtgtgacaggcatccacaactgcagcatcaatgagacctgcttcaacatccagggcggcttccgctgcctggcctttgaatgtcctgagaactacagaagatctgctgccacccgctgtgagcggctgccctgccatgaaaatcgggagtgcagcaagctgcccctgcgcatcacctactaccacctgtccttccccaccaacatccaggccccagctgtggtgttcaggatgggccccagcagcgctgtgcctggggacagcatgcagctggccatcaccggcggcaatgaggagggcttcttcaccaccaggaaggtgagcccccacagcggcgtggtggccctgaccaagcctgtgcctgagccccgggacctgctgctgactgtgaagatggacctgagcagacatggaacagtgagcagctttgtggccaagctgttcatctttgtgtctgctgagctgtag

SEQ ID NO: 152497 - DNA, 2112 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgccggggcggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaaggacattgatgaatgtgagagcggcatccacaactgcctgcctgacttcatctgccagaacaccctgggcagcttccgctgccggcccaagctgcagtgcaagagcggcttcatccaggatgccctgggcaactgcatcgacatcaatgaatgtctgagcatcagcgccccctgccccatcggccacacctgcatcaacacagagggcagctacacctgccagaagaatgtgcccaactgtggccggggctaccacctgaatgaggagggcacccgctgtgtggatgtggatgaatgtgcccccccagctgagccctgtgggaagggccaccgctgtgtgaacagccctggcagcttccgctgtgagtgcaagacaggctactactttgatggcatcagcaggatgtgtgtggatgtgaatgaatgccagcgctacccaggccgcctgtgtggccacaagtgtgagaacaccctgggcagctacctgtgcagctgcagcgtgggcttccggctgtctgtggatggccgcagctgtgaggacatcaatgaatgtagcagcagcccctgcagccaggagtgtgccaacgtgtatggcagctaccagtgctactgccggcggggctaccagctgagtgatgtggatggagtgacctgtgaggacattgatgaatgtgccctgcccactggaggccacatctgcagctaccgctgcatcaacatccctggcagcttccagtgcagctgccccagcagcggctaccgcctggccccaaatggaagaaactgccaggacattgatgaatgtgtgacaggcatccacaactgcagcatcaatgagacctgcttcaacatccagggcggcttccgctgcctggcctttgaatgtcctgagaactacagaagatctgctgccaccctgcagcaggagaagacagacacagtgcgctgcatcaagagctgccggcccaatgatgtgacctgtgtgtttgatcctgtgcacaccatcagccacacagtcatcagcctgcccaccttccgggagttcaccaggcctgaggagatcatcttcctgcgggccatcaccccaccccacccagccagccaggccaacatcatctttgacatcacagagggcaacctgcgggacagctttgacatcatcaagcgctacatggatggcatgacagtgggcgtggtgcggcaggtgcggcccatcgtgggccccttccacgctgtgctgaagctggagatgaactacgtggtgggcggcgtggtgagccacagaaatgtggtgaatgtgcacatctttgtgtctgagtactggttctag

SEQ ID NO: 152498 - DNA, 1701 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgccggggcggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaaggacattgatgaatgtgagagcggcatccacaactgcctgcctgacttcatctgccagaacaccctgggcagcttccgctgccggcccaagctgcagtgcaagagcggcttcatccaggatgccctgggcaactgcatcgacatcaatgaatgtctgagcatcagcgccccctgccccatcggccacacctgcatcaacacagagggcagctacacctgccagaagaatgtgcccaactgtggccggggctaccacctgaatgaggagggcacccgctgtgtggatgtggatgaatgtgcccccccagctgagccctgtgggaagggccaccgctgtgtgaacagccctggcagcttccgctgtgagtgcaagacaggctactactttgatggcatcagcaggatgtgtgtggatgtgaatgaatgccagcgctacccaggccgcctgtgtggccacaagtgtgagaacaccctgggcagctacctgtgcagctgcagcgtgggcttccggctgtctgtggatggccgcagctgtgaggacatcaatgaatgtagcagcagcccctgcagccaggagtgtgccaacgtgtatggcagctaccagtgctactgccggcggggctaccagctgagtgatgtggatggagtgacctgtgaggacattgatgaatgtgccctgcccactggaggccacatctgcagctaccgctgcatcaacatccctggcagcttccagtgcagctgccccagcagcggctaccgcctggccccaaatggaagaaactgccaggacattgatgaatgtgtgacaggcatccacaactgcagcatcaatgagacctgcttcaacatccagggcggcttccgctgcctggcctttgaatgtcctgagaactacagaagatctgctgccacctag

SEQ ID NO: 152499 - DNA, 2112 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgccggggcggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaaggacattgatgaatgtgagagcggcatccacaactgcctgcctgacttcatctgccagaacaccctgggcagcttccgctgccggcccaagctgcagtgcaagagcggcttcatccaggatgccctgggcaactgcatcgacatcaatgaatgtctgagcatcagcgccccctgccccatcggccacacctgcatcaacacagagggcagctacacctgccagaagaatgtgcccaactgtggccggggctaccacctgaatgaggagggcacccgctgtgtggatgtggatgaatgtgcccccccagctgagccctgtgggaagggccaccgctgtgtgaacagccctggcagcttccgctgtgagtgcaagacaggctactactttgatggcatcagcaggatgtgtgtggatgtgaatgaatgccagcgctacccaggccgcctgtgtggccacaagtgtgagaacaccctgggcagctacctgtgcagctgcagcgtgggcttccggctgtctgtggatggccgcagctgtgaggacatcaatgaatgtagcagcagcccctgcagccaggagtgtgccaacgtgtatggcagctaccagtgctactgccggcggggctaccagctgagtgatgtggatggagtgacctgtgaggacattgatgaatgtgccctgcccactggaggccacatctgcagctaccgctgcatcaacatccctggcagcttccagtgcagctgccccagcagcggctaccgcctggccccaaatggaagaaactgccaggacattgatgaatgtgtgacaggcatccacaactgcagcatcaatgagacctgcttcaacatccagggcggcttccgctgcctggcctttgaatgtcctgagaactacagaagatctgctgccacccagaagagcaagaagggccggcagaacaccccagctggcagcagcaaagaagactgccgggtgctgccctggaagcagggcctggaggacacccacctggatgcctacctgccctgctgccgccgcttcaccaggcctgaggagatcatcttcctgcgggccatcaccccaccccacccagccagccaggccaacatcatctttgacatcacagagggcaacctgcgggacagctttgacatcatcaagcgctacatggatggcatgacagtgggcgtggtgcggcaggtgcggcccatcgtgggccccttccacgctgtgctgaagctggagatgaactacgtggtgggcggcgtggtgagccacagaaatgtggtgaatgtgcacatctttgtgtctgagtactggttctag

SEQ ID NO: 152500 - DNA, 2166 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcagagctgtgggcctggccagcctgtgccaggacctgaatggagcctgggccgtgtggaaggtgggccgggccagccaggccgagggcacagccagcgcccgggcccagaggcggggcatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgccggggcggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaaggacattgatgaatgtgagagcggcatccacaactgcctgcctgacttcatctgccagaacaccctgggcagcttccgctgccggcccaagctgcagtgcaagagcggcttcatccaggatgccctgggcaactgcatcgacatcaatgaatgtctgagcatcagcgccccctgccccatcggccacacctgcatcaacacagagggcagctacacctgccagaagaatgtgcccaactgtggccggggctaccacctgaatgaggagggcacccgctgtgtggatgtggatgaatgtgcccccccagctgagccctgtgggaagggccaccgctgtgtgaacagccctggcagcttccgctgtgagtgcaagacaggctactactttgatggcatcagcaggatgtgtgtggatgtgaatgaatgccagcgctacccaggccgcctgtgtggccacaagtgtgagaacaccctgggcagctacctgtgcagctgcagcgtgggcttccggctgtctgtggatggccgcagctgtgaggacatcaatgaatgtagcagcagcccctgcagccaggagtgtgccaacgtgtatggcagctaccagtgctactgccggcggggctaccagctgagtgatgtggatggagtgacctgtgaggacattgatgaatgtgccctgcccactggaggccacatctgcagctaccgctgcatcaacatccctggcagcttccagtgcagctgccccagcagcggctaccgcctggccccaaatggaagaaactgccaggacattgatgaatgtgtgacaggcatccacaactgcagcatcaatgagacctgcttcaacatccagggcggcttccgctgcctggcctttgaatgtcctgagaactacagaagatctgctgccacccgctgtgagcggctgccctgccatgaaaatcgggagtgcagcaagctgcccctgcgcatcacctactaccacctgtccttccccaccaacatccaggccccagctgtggtgttcaggatgggccccagcagcgctgtgcctggggacagcatgcagctggccatcaccggcggcaatgaggagggcttcttcaccaccaggaaggtgagcccccacagcggcgtggtggccctgaccaagcctgtgcctgagccccgggacctgctgctgactgtgaagatggacctgagcagacatggaacagtgagcagctttgtggccaagctgttcatctttgtgtctgctgagctgtag

SEQ ID NO: 152501 - DNA, 570 bp, Artificial Sequence
  Description of Artificial Sequence: Synthetic coding sequence
atgaacagctacacccggggcagcagaagacccagcgccaaggccgccagccctgctgcctctgtgaccagccgggtgagccccagcggccctggggtgcctgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgcaggtag

SEQ ID NO: 152502 - DNA, 81 bp, Artificial Sequence
  Description of Artificial Sequence: Synthetic coding sequence
atggccacccaccagaaggactgcagcctgccctatgccacagagagcaaggagtgcaggatggtgcaggagcagtgctag

SEQ ID NO: 152503 - DNA, 1806 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgccggggcggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaaggacattgatgaatgtgagagcggcatccacaactgcctgcctgacttcatctgccagaacaccctgggcagcttccgctgccggcccaagctgcagtgcaagagcggcttcatccaggatgccctgggcaactgcatcgacatcaatgaatgtctgagcatcagcgccccctgccccatcggccacacctgcatcaacacagagggcagctacacctgccagaagaatgtgcccaactgtggccggggctaccacctgaatgaggagggcacccgctgtgtggatgtggatgaatgtgcccccccagctgagccctgtgggaagggccaccgctgtgtgaacagccctggcagcttccgctgtgagtgcaagacaggctactactttgatggcatcagcaggatgtgtgtggatgtgaatgaatgccagcgctacccaggccgcctgtgtggccacaagtgtgagaacaccctgggcagctacctgtgcagctgcagcgtgggcttccggctgtctgtggatggccgcagctgtgaggacatcaatgaatgtagcagcagcccctgcagccaggagtgtgccaacgtgtatggcagctaccagtgctactgccggcggggctaccagctgagtgatgtggatggagtgacctgtgaggacattgatgaatgtgccctgcccactggaggccacatctgcagctaccgctgcatcaacatccctggcagcttccagtgcagctgccccagcagcggctaccgcctggccccaaatggaagaaactgccaggacattgatgaatgtgtgacaggcatccacaactgcagcatcaatgagacctgcttcaacatccagggcggcttccgctgcctggcctttgaatgtcctgagaactacagaagatctgctgccacccagaagagcaagaagggccggcagaacaccccagctggcagcagcaaagaagactgccgggtgctgccctggaagcagggcctggaggacacccacctggatgcctag

SEQ ID NO: 152504 - DNA, 198 bp, Artificial Sequence
  Description of Artificial Sequence: Synthetic coding sequence
atggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagtag

SEQ ID NO: 152505 - DNA, 546 bp, Artificial Sequence
  Description of Artificial Sequence: Synthetic coding sequence
tgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagactggaggcggcccctgcaagcagcagtgccgggacacaggagatgaggtggtgtgcagctgctttgtgggctaccagctgctgagtgatggagtgtcctgtgaagatgtgaatgaatgcatcaccggcagccacagctgccgcctgggggagagctgcatcaacacagtgggcagcttccgctgccagagggacagcagctgtggcaccggctatgagctgacagaggacaacagctgcaagtag

SEQ ID NO: 152506 - DNA, 420 bp, Artificial Sequence
  Description of Artificial Sequence: Synthetic coding sequence
atggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagacagacaagatcatcgaggtggaggaggagcaggaggacccctacctgaatgaccgctgcaggtag

SEQ ID NO: 152507 - DNA, 519 bp, Artificial Sequence
  Description of Artificial Sequence: Synthetic coding sequence
atggagcgggccgcccccagccggcgggtgcccctgcccctgctgctgctgggcggcctggccctgctggccgccggcgtggatgctgatgtgctgctggaggcctgctgtgctgatggccacaggatggccacccaccagaaggactgcagcctgccctatgccacagagagcaaggagtgcaggatggtgcaggagcagtgctgccacagccagctggaggagctgcactgtgccaccggcatcagcctggccaatgagcaggacagatgtgccacccctcatggagacaatgccagcctggaggccacctttgtgaagcgctgctgccactgctgcctgctgggccgggccgcccaggcccagggccagagctgtgagtacagcctgatggtgggctaccagtgtggccaggtgttccaggcctgctgcgtgaagagccaggagaccggggacctggatgtgggcggcctgcaggagactggaggcggcccctgcaagcagcagtgccgggactag

SEQ ID NO: 152508 - DNA, 3555 bp, Artificial Sequence
  Description of Artificial Sequence: Synthetic coding sequence
atggtgctgctgtgggagcctgctggggcctggctggccctgggcctggccctggccctgggccccagcgtggccgctgctgccccccggcaggactgcaccggggtggagtgcccccccctggagaactgcatcgaggaggccctggagcccggggcctgctgtgccacctgtgtgcagcagggctgtgcctgtgagggctaccagtactatgactgcctgcagggcggctttgtgcggggccgggtgcctgctggccagagctactttgtggactttggcagcacagaatgtagctgccccccaggcggcggcaagatcagctgccagttcatgctgtgcccagagctgccccccaactgcatcgaggccgtggtggtggccgacagctgcccccagtgtggccaggtgggctgtgtgcacgccggccacaagtatgctgctggccacacagtgcacctgcccccctgccgggcctgccactgcccagatgctggaggagagctgatctgctaccagctgcccggctgccacggcaacttcagtgatgctgaggagggggaccctgagcggcactatgaggacccctacagctatgaccaggaggtggccgaggtggaggccgccacagccctgggcggggaggtgcaggccggggctgtgcaggccggggccggcggccccccagctgccctgggcggcggcagccagcccctgagcaccatccaggccccaccctggccagctgtgctgccccggcccacagctgctgctgccctgggccccccagcccctgtgcaggccaaggcccggcgggtgacagaagattctgaggaggaggaggaggaggaggaggagcgggaggagatggctgtgacagagcagctggccgccggcggccaccggggcctggatggcctgcccaccacagccccagctggccccagcctgcccatccaggaggagcgggcagaggccggggcccgggcagaggccggggcccggcctgaggagaacctgatcctggatgcccaggccaccagccgcagcactggacctgagggcgtgacccacgcccccagcctgggcaaggccgccctggtgcccacccaggccgtgcccggcagcccccgggaccctgtgaagcccagcccccacaacatcctgagcaccagcctgcctgatgctgcctggatcccccccacccgggaggtgcccaggaagccccaggtgctgccccacagccacgtggaggaggacacagaccccaacagcgtgcacagcatccccaggagcagccctgagggcagcaccaaggacctgattgagacctgctgtgccgccggccagcagtgggccatcgacaatgatgagtgcctggagatccctgagagcggcacagaggacaacgtgtgcaggacagcccagaggcactgctgcgtgtcctacctgcaggagaagagctgcatggccggcgtgctgggcgccaaggagggggagacctgtggggctgaagataatgacagctgtggcatcagcctgtacaagcagtgctgtgactgctgcggcctgggcctgcgggtgcgggcagagggccagagctgtgagagcaaccccaacctgggctacccctgcaaccacgtgatgctgagctgctgtgagggggaggagcccctcatcgtgcctgaggtgagaagacctcctgagcctgctgctgcccccaggagagtgtctgaggccgagatggccggccgggaggccctgagcctgggcacagaggccgagctgcccaacagcctgcctggagatgaccaggatgaatgtctgctgctgcccggggagctgtgccagcacctgtgcatcaacacagtgggcagctaccactgtgcctgcttccctggcttcagcctgcaggatgatggccgcacctgcaggcctgagggccaccccccccagcctgaggccccccaggagcccgccctgaagtctgagttcagccaggtggccagcaacaccatccccctgcccctgccccagcccaacacctgcaaggacaatggcccctgcaagcaggtgtgcagcacagtgggcggcagcgccatctgcagctgcttccctggctacgccatcatggctgatggagtgtcctgtgaggacatcaatgaatgtgtgacagacctgcacacctgcagcagaggagagcactgtgtgaacaccctgggcagcttccactgctacaaggccctgacctgtgagcccggctacgccctgaaggatggagaatgtgaagatgtggatgaatgtgccatgggcacccacacctgccagcccggcttcctgtgccagaacaccaagggcagcttctactgccaggcccggcagcgctgcatggatggcttcctgcaggaccctgagggcaactgtgtggacatcaatgaatgtaccagcctgtctgagccctgcaggcctggcttcagctgcatcaacacagtgggcagctacacctgccagaggaaccccctcatctgtgcccggggctaccacgccagtgatgatggcaccaagtgtgtggatgtgaatgaatgtgagaccggggtgcaccgctgtggggagggccaggtgtgccacaacctgcccggcagctaccgctgtgactgcaaggccggcttccagagagatgccttcggccggggctgcattgatgtgaatgaatgctgggccagccctggccgcctgtgccagcacacctgtgagaacaccctgggcagctaccgctgcagctgtgccagcggcttcctgctggccgcagatggcaagagatgtgaagatgtgaatgaatgtgaggcccagcgctgcagccaggagtgtgccaacatctacggcagctaccagtgctactgccggcagggctaccagctggctgaagatggccacacctgcacagacattgatgaatgtgcccagggcgccggcatcctgtgcaccttccgctgcctgaatgtgcccggcagctaccagtgtgcctgcccagagcagggctacaccatgacagccaacggccgcagctgcaaggatgtggatgaatgtgccctgggcacccacaactgcagcgaggccgagacctgccacaacatccagggcagcttccgctgcctgcgctttgaatgtcctcccaactacgtgcaggtgtccaagaccaagtgtgagaggaccacctgccacgacttcctggagtgccagaacagccctgcccgcatcacccactaccagctgaacttccagacaggcctgctggtgcctgcccacatcttccgcatcggccctgccccagccttcaccggggacaccatcgccctgaacatcatcaagggaaatgaggagggctacttcggcacccggcggctgaatgcctacacaggagtggtgtacctgcagagagctgtgctggagccccgggactttgccctggatgtggagatgaagctgtggaggcagggctctgtgaccaccttcctggccaagatgcacatcttcttcaccacctttgccctgtag

SEQ ID NO: 152509 - DNA, 3696 bp, Artificial Sequence
  Description of Artificial Sequence: Synthetic coding sequence
atggtgctgctgtgggagcctgctggggcctggctggccctgggcctggccctggccctgggccccagcgtggccgctgctgccccccggcaggactgcaccggggtggagtgcccccccctggagaactgcatcgaggaggccctggagcccggggcctgctgtgccacctgtgtgcagcagggctgtgcctgtgagggctaccagtactatgactgcctgcagggcggctttgtgcggggccgggtgcctgctggccagagctactttgtggactttggcagcacagaatgtagctgccccccaggcggcggcaagatcagctgccagttcatgctgtgcccagagctgccccccaactgcatcgaggccgtggtggtggccgacagctgcccccagtgtggccaggtgggctgtgtgcacgccggccacaagtatgctgctggccacacagtgcacctgcccccctgccgggcctgccactgcccagatgctggaggagagctgatctgctaccagctgcccggctgccacggcaacttcagtgatgctgaggagggggaccctgagcggcactatgaggacccctacagctatgaccaggaggtggccgaggtggaggccgccacagccctgggcggggaggtgcaggccggggctgtgcaggccggggccggcggccccccagctgccctgggcggcggcagccagcccctgagcaccatccaggccccaccctggccagctgtgctgccccggcccacagctgctgctgccctgggccccccagcccctgtgcaggccaaggcccggcgggtgacagaagattctgaggaggaggaggaggaggaggaggagcgggaggagatggctgtgacagagcagctggccgccggcggccaccggggcctggatggcctgcccaccacagccccagctggccccagcctgcccatccaggaggagcgggcagaggccggggcccgggcagaggccggggcccggcctgaggagaacctgatcctggatgcccaggccaccagccgcagcactggacctgagggcgtgacccacgcccccagcctgggcaaggccgccctggtgcccacccaggccgtgcccggcagcccccgggaccctgtgaagcccagcccccacaacatcctgagcaccagcctgcctgatgctgcctggatcccccccacccgggaggtgcccaggaagccccaggtgctgccccacagccacgtggaggaggacacagaccccaacagcgtgcacagcatccccaggagcagccctgagggcagcaccaaggacctgattgagacctgctgtgccgccggccagcagtgggccatcgacaatgatgagtgcctggagatccctgagagcggcacagaggacaacgtgtgcaggacagcccagaggcactgctgcgtgtcctacctgcaggagaagagctgcatggccggcgtgctgggcgccaaggagggggagacctgtggggctgaagataatgacagctgtggcatcagcctgtacaagcagtgctgtgactgctgcggcctgggcctgcgggtgcgggcagagggccagagctgtgagagcaaccccaacctgggctacccctgcaaccacgtgatgctgagctgctgtgagggggaggagcccctcatcgtgcctgaggtgagaagacctcctgagcctgctgctgcccccaggagagtgtctgaggccgagatggccggccgggaggccctgagcctgggcacagaggccgagctgcccaacagcctgcctggagatgaccaggatgaatgtctgctgctgcccggggagctgtgccagcacctgtgcatcaacacagtgggcagctaccactgtgcctgcttccctggcttcagcctgcaggatgatggccgcacctgcaggcctgagggccaccccccccagcctgaggccccccaggagcccgccctgaagtctgagttcagccaggtggccagcaacaccatccccctgcccctgccccagcccaacacctgcaaggacaatggcccctgcaagcaggtgtgcagcacagtgggcggcagcgccatctgcagctgcttccctggctacgccatcatggctgatggagtgtcctgtgaggaccaggatgagtgcctgatgggcgcccatgactgcagccggcggcagttctgtgtgaacaccctgggcagcttctactgtgtgaaccacacagtgctgtgtgctgatggctacatcctgaatgcccacaggaaatgtgtggacatcaatgaatgtgtgacagacctgcacacctgcagcagaggagagcactgtgtgaacaccctgggcagcttccactgctacaaggccctgacctgtgagcccggctacgccctgaaggatggagaatgtgaagatgtggatgaatgtgccatgggcacccacacctgccagcccggcttcctgtgccagaacaccaagggcagcttctactgccaggcccggcagcgctgcatggatggcttcctgcaggaccctgagggcaactgtgtggacatcaatgaatgtaccagcctgtctgagccctgccggcccggcttcagctgcatcaacacagtgggcagctacacctgccagaggaaccccctcatctgtgcccggggctaccacgccagtgatgatggcaccaagtgtgtggatgtgaatgaatgtgaaacaggagtgcaccgctgtggggagggccaggtgtgccacaacctgcccggcagctaccgctgtgactgcaaggccggcttccagagagatgccttcggccggggctgcattgatgtgaatgaatgctgggccagccctggccgcctgtgccagcacacctgtgagaacaccctgggcagctaccgctgcagctgtgccagcggcttcctgctggccgcagatggcaagagatgtgaagatgtgaatgaatgtgaggcccagcgctgcagccaggagtgtgccaacatctacggcagctaccagtgctactgccggcagggctaccagctggccgaggatggccacacctgcacagacattgatgaatgtgcccagggcgccggcatcctgtgcaccttccgctgcctgaatgtgcccggcagctaccagtgtgcctgcccagagcagggctacaccatgacagccaacggccgcagctgcaaggatgtggatgaatgtgccctgggcacccacaactgcagcgaggccgagacctgccacaacatccagggcagcttccgctgcctgcgctttgagtgcccccccaactacgtgcaggtgtccaagaccaagtgtgagaggaccacctgccacgacttcctggagtgccagaacagccctgcccgcatcacccactaccagctgaacttccagacaggcctgctggtgcctgcccacatcttcagaattggccctgccccagccttcaccggggacaccatcgccctgaacatcatcaagggaaatgaggagggctacttcggcacccggcggctgaatgcctacacaggagtggtgtacctgcagagagctgtgctggagccccgggactttgccctggatgtggagatgaagctgtggaggcagggctctgtgaccaccttcctggccaagatgcacatcttcttcaccacctttgccctgtag

SEQ ID NO: 152510 - DNA, 480 bp, Artificial Sequence
  Description of Artificial Sequence: Synthetic coding sequence
atggtgctgctgtgggagcctgctggggcctggctggccctgggcctggccctggccctgggccccagcgtggccgctgctgccccccggcaggactgcaccggggtggagtgcccccccctggagaactgcatcgaggaggccctggagcccggggcctgctgtgccacctgtgtgcagcagggctgtgcctgtgagggctaccagtactatgactgcctgcagggcggctttgtgcggggccgggtgcctgctggccagagctactttgtggactttggcagcacagaatgtagctgccccccaggcggcggcaagatcagctgccagttcatgctgtgcccagagctgccccccaactgcatcgaggccgtggtggtggccgacagctgcccccagtgtggccaggtgggctgtgtgcacgccggccacaagtatgctgctggccacacagtgcacctgcccccctgccgggcctag

SEQ ID NO: 152511 - DNA, 3696 bp, Artificial Sequence; identical to SEQ ID NO: 152509
  Description of Artificial Sequence: Synthetic coding sequence

SEQ ID NO: 152512 - DNA, 3633 bp, Artificial Sequence
  Description of Artificial Sequence: Synthetic coding sequence
atggagaccagcctgagcctggagagcggccaccacggcagctaccgccgcggggacaggcctggcctggcctggaccatggtgctgctgtgggagcctgctggggcctggctggccctgggcctggccctggccctgggccccagcgtggccgctgctgccccccggcaggactgcaccggggtggagtgcccccccctggagaactgcatcgaggaggccctggagcccggggcctgctgtgccacctgtgtgcagcagggctgtgcctgtgagggctaccagtactatgactgcctgcagggcggctttgtgcggggccgggtgcctgctggccagagctactttgtggactttggcagcacagaatgtagctgccccccaggcggcggcaagatcagctgccagttcatgctgtgcccagagctgccccccaactgcatcgaggccgtggtggtggccgacagctgcccccagtgtggccaggtgggctgtgtgcacgccggccacaagtatgctgctggccacacagtgcacctgcccccctgccgggcctgccactgcccagatgctggaggagagctgatctgctaccagctgcccggctgccacggcaacttcagtgatgctgaggagggggaccctgagcggcactatgaggacccctacagctatgaccaggaggtggccgaggtggaggccgccacagccctgggcggggaggtgcaggccggggctgtgcaggccggggccggcggccccccagctgccctgggcggcggcagccagcccctgagcaccatccaggccccaccctggccagctgtgctgccccggcccacagctgctgctgccctgggccccccagcccctgtgcaggccaaggcccggcgggtgacagaagattctgaggaggaggaggaggaggaggaggagcgggaggagatggctgtgacagagcagctggccgccggcggccaccggggcctggatggcctgcccaccacagccccagctggccccagcctgcccatccaggaggagcgggcagaggccggggcccgggcagaggccggggcccggcctgaggagaacctgatcctggatgcccaggccaccagccgcagcactggacctgagggcgtgacccacgcccccagcctgggcaaggccgccctggtgcccacccaggccgtgcccggcagcccccgggaccctgtgaagcccagcccccacaacatcctgagcaccagcctgcctgatgctgcctggatcccccccacccgggaggtgcccaggaagccccaggtgctgccccacagccacgtggaggaggacacagaccccaacagcgtgcacagcatccccaggagcagccctgagggcagcaccaaggacctgattgagacctgctgtgccgccggccagcagtgggccatcgacaatgatgagtgcctggagatccctgagagcggcacagaggacaacgtgtgcaggacagcccagaggcactgctgcgtgtcctacctgcaggagaagagctgcatggccggcgtgctgggcgccaaggagggggagacctgtggggctgaagataatgacagctgtggcatcagcctgtacaagcagtgctgtgactgctgcggcctgggcctgcgggtgcgggcagagggccagagctgtgagagcaaccccaacctgggctacccctgcaaccacgtgatgctgagctgctgtgagggggaggagcccctcatcgtgcctgaggtgagaagacctcctgagcctgctgctgcccccaggagagtgtctgaggccgagatggccggccgggaggccctgagcctgggcacagaggccgagctgcccaacagcctgcctggagatgaccaggatgaatgtctgctgctgcccggggagctgtgccagcacctgtgcatcaacacagtgggcagctaccactgtgcctgcttccctggcttcagcctgcaggatgatggccgcacctgcaggcctgagggccaccccccccagcctgaggccccccaggagcccgccctgaagtctgagttcagccaggtggccagcaacaccatccccctgcccctgccccagcccaacacctgcaaggacaatggcccctgcaagcaggtgtgcagcacagtgggcggcagcgccatctgcagctgcttccctggctacgccatcatggctgatggagtgtcctgtgaggacatcaatgaatgtgtgacagacctgcacacctgcagcagaggagagcactgtgtgaacaccctgggcagcttccactgctacaaggccctgacctgtgagcccggctacgccctgaaggatggagaatgtgaagatgtggatgaatgtgccatgggcacccacacctgccagcccggcttcctgtgccagaacaccaagggcagcttctactgccaggcccggcagcgctgcatggatggcttcctgcaggaccctgagggcaactgtgtggacatcaatgaatgtaccagcctgtctgagccctgcaggcctggcttcagctgcatcaacacagtgggcagctacacctgccagaggaaccccctcatctgtgcccggggctaccacgccagtgatgatggcaccaagtgtgtggatgtgaatgaatgtgagaccggggtgcaccgctgtggggagggccaggtgtgccacaacctgcccggcagctaccgctgtgactgcaaggccggcttccagagagatgccttcggccggggctgcattgatgtgaatgaatgctgggccagccctggccgcctgtgccagcacacctgtgagaacaccctgggcagctaccgctgcagctgtgccagcggcttcctgctggccgcagatggcaagagatgtgaagatgtgaatgaatgtgaggcccagcgctgcagccaggagtgtgccaacatctacggcagctaccagtgctactgccggcagggctaccagctggctgaagatggccacacctgcacagacattgatgaatgtgcccagggcgccggcatcctgtgcaccttccgctgcctgaatgtgcccggcagctaccagtgtgcctgcccagagcagggctacaccatgacagccaacggccgcagctgcaaggatgtggatgaatgtgccctgggcacccacaactgcagcgaggccgagacctgccacaacatccagggcagcttccgctgcctgcgctttgaatgtcctcccaactacgtgcaggtgtccaagaccaagtgtgagaggaccacctgccacgacttcctggagtgccagaacagccctgcccgcatcacccactaccagctgaacttccagacaggcctgctggtgcctgcccacatcttccgcatcggccctgccccagccttcaccggggacaccatcgccctgaacatcatcaagggaaatgaggagggctacttcggcacccggcggctgaatgcctacacaggagtggtgtacctgcagagagctgtgctggagccccgggactttgccctggatgtggagatgaagctgtggaggcagggctctgtgaccaccttcctggccaagatgcacatcttcttcaccacctttgccctgtag

SEQ ID NO: 152513 - DNA, 1347 bp, Artificial Sequence
  Description of Artificial Sequence: Synthetic coding sequence
atgcctggcatcaagaggatcctgactgtgaccatcctggccctgtgcctgcccagccctggaaatgcccaggcccagtgcaccaatggatttgacctggaccggcagagcggccagtgcctggacattgatgaatgtaggaccatccctgaggcctgccgcggggacatgatgtgtgtgaaccagaatggaggctacctgtgcatccccaggaccaaccctgtgtaccggggcccctacagcaacccctacagcaccccctacagcggcccctacccagctgctgccccacccctgagcgcccccaactaccccaccatcagccggcccctcatctgccgcttcggctaccagatggatgagagcaaccagtgtgtggatgtggatgaatgtgccacagacagccaccagtgcaaccccacccagatctgcatcaacacagaaggaggctacacctgcagctgcacagatggctactggctgctggagggccagtgcctggacattgatgaatgtagatatggctactgccagcagctgtgtgccaacgtgcccggcagctacagctgcacctgcaaccctggcttcaccctgaatgaagatggccgcagctgccaggatgtgaatgaatgtgccacagagaacccctgtgtgcagacctgtgtgaacacctacggcagcttcatctgccgctgtgaccccggctatgagctggaggaggatggagtgcactgcagcgacatggatgagtgcagcttcagcgagttcctgtgccagcatgaatgtgtgaaccagcccggcacctacttctgcagctgccccccaggctacatcctgctggatgacaacagaagctgccaggacatcaatgaatgtgagcacaggaaccacacctgcaacctgcagcagacctgctacaacctgcagggcggcttcaagtgcatcgaccccatccgctgtgaggagccctacctgcgcatcagtgacaaccgctgcatgtgcccagcagaaaatcctggctgccgggaccagcccttcaccatcctgtacagagacatggatgtggtgtctggccgctctgtgcctgctgacatcttccagatgcaggccaccacccgctacccaggggcctactacatcttccagatcaagtctggaaatgaaggccgggagttctacatgaggcagacaggccccatcagcgccaccctggtgatgacccggcccatcaagggcccccgggagatccagctggacctggagatgatcaccgtgaacacagtcatcaacttccggggcagcagcgtcatccggctgcgcatctacgtgtcccagtaccccttctag

SEQ ID NO: 152514 - DNA, 276 bp, Artificial Sequence
  Description of Artificial Sequence: Synthetic coding sequence
atgcctggcatcaagaggatcctgactgtgaccatcctggccctgtgcctgcccagccctggaaatgcccaggcccagtgcaccaatggatttgacctggaccggcagagcggccagtgcctggacattgatgaatgtaggaccatccctgaggcctgccgcggggacatgatgtgtgtgaaccagaatggaggctacctgtgcatccccaggaccaaccctgtgtaccggggcccctacagcaacccctacagcaccccctacagcggcccctag

SEQ ID NO: 152515 - DNA, 1320 bp, Artificial Sequence
  Description of Artificial Sequence: Synthetic coding sequence
atggtgcccagcagcccccgggccctcttcctgctgctgctgatcctggcctgcccagagccccgggccagccagaactgcctgagcaagcagcagctgctgagcgccatccggcagctgcagcagctgctgaagggccaggagaccaggtttgctgagggcatccgccacatgaagagccggctggccgccctgcagaacagcgtgggccgggtgggcccagatgccctgcctgtgtcctgcccagccctgaacaccccagcagatggcaggaagtttggcagcaagtacctggtggaccacgaggtgcacttcacctgcaaccctggcttccggctggtgggccccagctctgtggtgtgcctgcccaacggcacctggacaggagagcagccccactgccggggcatcagtgaatgtagcagccagccctgccagaatggaggcacctgtgtggagggcgtgaaccagtaccgctgcatctgccccccaggccgcactggaaaccgctgccagcaccaggcccagacagctgcccctgagggctctgtggccggggacagcgccttcagccgggccccccgctgtgcccaggtggagcgggcccagcactgcagctgtgaggccggcttccacctgagcggggctgctggggacagcgtgtgccaggatgtgaatgaatgtgagctgtatggccaggagggccggccccggctgtgcatgcacgcctgtgtgaacaccccaggcagctaccgctgcacctgccctgggggctaccgcaccctggctgatggcaagagctgtgaagatgtggatgaatgtgtgggcctgcagcctgtgtgcccccagggcaccacctgcatcaacacaggaggcagcttccagtgtgtgtccccagagtgcccagagggcagcggaaatgtgtcctatgtgaagaccagccccttccagtgtgagaggaacccctgccccatggacagccggccctgccgccacctgcccaagaccatctccttccactacctgagcctgcccagcaacctgaagacccccatcaccctcttcaggatggccacagccagcgcccctggccgggccggccccaacagcctgcgctttggaattgtgggcggcaacagccggggccactttgtgatgcagaggagtgaccggcagacaggagacctgatcctggtgcagaacctggagggcccccagaccctggaggtggatgtggacatgtctgagtacctggaccgctccttccaggccaaccacgtgtccaaggtgaccatctttgtgagcccctatgacttctag

SEQ ID NO: 152516 - DNA, 1182 bp, Artificial Sequence
  Description of Artificial Sequence: Synthetic coding sequence
atggtgcccagcagcccccgggccctcttcctgctgctgctgatcctggcctgcccagagccccgggccagccagaactgcctgagcaagcagcagctgctgagcgccatccggcagctgcagcagctgctgaagggccaggagaccaggtttgctgagggcatccgccacatgaagagccggctggccgccctgcagaacagcgtgggccgggtgggcccagatgccctgcctgtgtcctgcccagccctgaacaccccagcagatggcaggaagtttggcagcaagtacctggtggaccacgaggtgcacttcacctgcaaccctggcttccggctggtgggccccagctctgtggtgtgcctgcccaacggcacctggacaggagagcagccccactgccggggcatcagtgaatgtagcagccagccctgccagaatggaggcacctgtgtggagggcgtgaaccagtaccgctgcatctgccccccaggccgcactggaaaccgctgccagcaccaggcccagacagatgtgaatgaatgtgagctgtatggccaggagggccggccccggctgtgcatgcacgcctgtgtgaacaccccaggcagctaccgctgcacctgccctgggggctaccgcaccctggctgatggcaagagctgtgaagatgtggatgaatgtgtgggcctgcagcctgtgtgcccccagggcaccacctgcatcaacacaggaggcagcttccagtgtgtgtccccagagtgcccagagggcagcggaaatgtgtcctatgtgaagaccagccccttccagtgtgagaggaacccctgccccatggacagccggccctgccgccacctgcccaagaccatctccttccactacctgagcctgcccagcaacctgaagacccccatcaccctcttcaggatggccacagccagcgcccctggccgggccggccccaacagcctgcgctttggaattgtgggcggcaacagccggggccactttgtgatgcagaggagtgaccggcagacaggagacctgatcctggtgcagaacctggagggcccccagaccctggaggtggatgtggacatgtctgagtacctggaccgctccttccaggccaaccacgtgtccaaggtgaccatctttgtgagcccctatgacttctag

SEQ ID NO: 152517 - DNA, 942 bp, Artificial Sequence
  Description of Artificial Sequence: Synthetic coding sequence
atggagctggacagagctgtgggcgtgctgggcgccgccaccctgctgctgtccttcctgggcatggcctgggccctgcaggccgctgacacctgcccagaggtgaagatggtgggcctggagggcagtgacaagctgaccatcctgcggggctgccccggcctgcccggggcccctggccccaagggggaggccggcaccaacgggaagagaggagagcggggccccccaggccccccaggcaaggccggccccccaggccccaatggagcccctggagagccccagccctgcctgaccggccccaggacctgcaaggacctgctggaccggggccacttcctgagcggctggcacaccatctacctgcctgactgccggcccctgactgtgctgtgtgacatggacacagatggcggcggctggacagtgttccagaggagagtggatggctctgtggacttctacagagactgggccacctacaagcagggcttcggcagccggctgggggagttctggctgggcaatgacaacatccacgccctgacagcccagggcaccagcgagctgcgggtggacctggtggactttgaggacaactaccagtttgccaagtaccgctccttcaaggtggctgatgaggccgagaagtacaacctggtgctgggcgcctttgtggagggcagcgctggggacagcctgaccttccacaacaaccagagcttcagcaccaaggaccaggacaatgacctgaacacaggcaactgtgctgtgatgttccagggcgcctggtggtacaagaactgccacgtgagcaacctgaatggccgctacctgcggggcacccacggcagctttgccaacggcatcaactggaagagcggcaagggctacaactacagctacaaggtgtctgagatgaaggtgcggcctgcctag

SEQ ID NO: 152518 - DNA, 828 bp, Artificial Sequence
  Description of Artificial Sequence: Synthetic coding sequence
atggagctggacagagctgtgggcgtgctgggcgccgccaccctgctgctgtccttcctgggcatggcctgggccctgcaggccgctgacacctgccctggagagcggggccccccaggccccccaggcaaggccggccccccaggccccaatggagcccctggagagccccagccctgcctgaccggccccaggacctgcaaggacctgctggaccggggccacttcctgagcggctggcacaccatctacctgcctgactgccggcccctgactgtgctgtgtgacatggacacagatggcggcggctggacagtgttccagaggagagtggatggctctgtggacttctacagagactgggccacctacaagcagggcttcggcagccggctgggggagttctggctgggcaatgacaacatccacgccctgacagcccagggcaccagcgagctgcgggtggacctggtggactttgaggacaactaccagtttgccaagtaccgctccttcaaggtggctgatgaggccgagaagtacaacctggtgctgggcgcctttgtggagggcagcgctggggacagcctgaccttccacaacaaccagagcttcagcaccaaggaccaggacaatgacctgaacacaggcaactgtgctgtgatgttccagggcgcctggtggtacaagaactgccacgtgagcaacctgaatggccgctacctgcggggcacccacggcagctttgccaacggcatcaactggaagagcggcaagggctacaactacagctacaaggtgtctgagatgaaggtgcggcctgcctag

SEQ ID NO: 152519 - DNA, 564 bp, Artificial Sequence
  Description of Artificial Sequence: Synthetic coding sequence
atggagctgagcggggccaccatggcccggggcctggccgtgctgctggtgctcttcctgcacatcaagaacctgcctgcccaggccgctgacacctgcccagaggtgaaggtggtgggcctggagggcagtgacaagctgaccatcctgcggggctgccccggcctgcccggggcccctggccccaagggggaggccggcgtgattggagagcggggggagcggggcctgcccggggcccctgggaaggccggccctgtgggccccaagggagatgctggccagagccagagctgtgccaccggccccaggaactgcaaggacctgctggaccggggctacttcctgagcggctggcacaccatctacctgcctgactgccggcccctgactgtgctgtgtgacatggacacagatggcggcggctggacagtgttccagaggaggatggatggctctgtggacttctacagagactgggccgcctacaagcagggcttcggcagccagctgggggagttctggctgggcaatgacaacatccacgccctgacagcccagtag

SEQ ID NO: 152520 - DNA, 981 bp, Artificial Sequence
  Description of Artificial Sequence: Synthetic coding sequence
atggagctgagcggggccaccatggcccggggcctggccgtgctgctggtgctcttcctgcacatcaagaacctgcctgcccaggccgctgacacctgcccagaggtgaaggtggtgggcctggagggcagtgacaagctgaccatcctgcggggctgccccggcctgcccggggcccctggccccaagggggaggccggcgtgattggagagcggggggagcggggcctgcccggggcccctgggaaggccggccctgtgggccccaagggggacagaggagagaagggcatgagaggagagaagggagatgctggccagagccagagctgtgccaccggccccaggaactgcaaggacctgctggaccggggctacttcctgagcggctggcacaccatctacctgcctgactgccggcccctgactgtgctgtgtgacatggacacagatggcggcggctggacagtgttccagaggaggatggatggctctgtggacttctacagagactgggccgcctacaagcagggcttcggcagccagctgggggagttctggctgggcaatgacaacatccacgccctgacagcccagggcagcagcgagctgcgggtggacctggtggactttgagggcaaccaccagtttgccaagtacaagagcttcaaggtggctgatgaagctgagaagtacaagctggtgctgggcgcctttgtgggcggcagcgctggcaacagcctgaccggccacaacaacaacttcttcagcaccaaggaccaggacaatgatgtgagcagcagcaactgtgccgagaagttccagggcgcctggtggtatgctgactgccacgccagcaacctgaatggcctgtacctgatgggcccccatgagagctatgccaacggcatcaactggagcgctgccaagggctacaagtacagctacaaggtgtctgagatgaaggtgcggcctgcctag

SEQ ID NO: 152521 - DNA, 1083 bp, Artificial Sequence
  Description of Artificial Sequence: Synthetic coding sequence
atggagctgagcggggccaccatggcccggggcctggccgtgctgctggtgctcttcctgcacatcaagaacctgcctgcccaggccgctgacacctgcccagaggtgaaggtggtgggcctggagggcagtgacaagctgaccatcctgcggggctgccccggcctgcccggggcccctggccccaagggggaggccggcgtgattggagagcggggggagcggggcctgcccggggcccctgggaaggccggccctgtgggccccaagggggacagaggagagaagggcatgagaggagagaagggagatgctggccagagccagagctgtgccaccggccccaggaactgcaaggacctgctggaccggggctacttcctgagcggctggcacaccatctacctgcctgactgccggcccctgactgtgctgtgtgacatggacacagatggcggcggctggacagtgttccagaggaggatggatggctctgtggacttctacagagactgggccgcctacaagcagggcttcggcagccagacccacagccatgatgcccacagctgcccctttgcccccagctctgtgaagccaccccacgcccacaacctgacccggggccgcatcatgttcctgaacatgttcaccctgggccagaagagcttcaccagcttcaacgtgtgcttcctgaacaccagcggctttgaccacttccctgtgtctgtggcccggcaggtgttcccctggaacctggtgtcccgggaggagagcggccccctcttcagccgctggcactaccgctgcagcggccgcctgagtgacttctgtgaggacttccccccacctgtgattgacaccggccgcagcagccccccaccacccagcctgccccacccccccatgccccacagccagcacttcaccctgctggagaagggccactttggagtgcagaagaccctgaccaagaagggggagagcctggtgggcaccttcctgctgcccaccacagctgagttcatgctgtgggccggctggctgctgggccgggacaagcacctggccctgaccaagtag

SEQ ID NO: 152522 - DNA, 900 bp, Artificial Sequence
  Description of Artificial Sequence: Synthetic coding sequence
atggacctgctgtggatcctgcccagcctgtggctgctgctgctgggcggccctgcctgcctgaagacccaggagcaccccagctgccccggcccccgggagctggaggccagcaaggtggtgctgctgcccagctgccctggggcccctggcagccctggagagaagggggcccctggcccccagggccccccaggccccccaggcaagatgggccccaagggggagcccggggaccctgtgaacctgctgcgctgccaggagggccccaggaactgccgggagctgctgagccagggcgccaccctgagcggctggtaccacctgtgcctgcctgagggccgggccctgcccgtcttctgtgacatggacacagaaggaggcggctggctggtgttccagaggcggcaggacggctctgtggacttcttccgctcctggagcagctaccgggccggcttcggcaaccaggagagcgagttctggctgggcaatgaaaacctgcaccagctgaccctgcagggcaactgggagctgcgggtggagctggaggacttcaatggaaacagaacatttgcccactacgccaccttccggctgctgggggaggtggaccactaccagctggccctgggcaagttcagcgagggcacagctggggacagcctgagcctgcacagcggccggcccttcaccacctatgatgctgaccatgacagcagcaacagcaactgtgccgtcatcgtgcacggggcctggtggtacgccagctgctaccgcagcaacctgaatggccgctatgctgtgtctgaggccgccgcccacaagtatggaattgactgggccagcggccggggcgtgggccacccctaccgccgggtgaggatgatgctgaggtag

SEQ ID NO: 152523 - DNA, 867 bp, Artificial Sequence
  Description of Artificial Sequence: Synthetic coding sequence
atggacctgctgtggatcctgcccagcctgtggctgctgctgctgggcggccctgcctgcctgaagacccaggagcaccccagctgccccggcccccgggagctggaggccagcaaggtggtgctgctgcccagctgccctggggcccctggcagccctggagagaagggggcccctggcccccagggccccccaggccccccaggcaagatgggccccaagggggagcccggccccaggaactgccgggagctgctgagccagggcgccaccctgagcggctggtaccacctgtgcctgcctgagggccgggccctgcctgtgttctgtgacatggacacagagggcggcggctggctggtgttccagaggcggcaggacggctctgtggacttcttccgctcctggagcagctacagagctggctttggaaaccaggagagcgagttctggctgggcaatgaaaacctgcaccagctgaccctgcagggcaactgggagctgcgggtggagctggaggacttcaacggcaacagaacatttgcccactacgccaccttccggctgctgggggaggtggaccactaccagctggccctgggcaagttcagcgagggcacagctggggacagcctgagcctgcacagcggccggcccttcaccacctatgatgctgaccatgacagcagcaacagcaactgtgctgtgattgtgcatggagcctggtggtacgccagctgctaccgcagcaacctgaatggccgctatgctgtgtctgaggccgccgcccacaagtatggcatcgactgggccagcggccggggcgtgggccacccctacagaagagtgaggatgatgctgaggtag

SEQ ID NO: 152524 - DNA, 300 bp, Artificial Sequence
  Description of Artificial Sequence: Synthetic coding sequence
atggacacagaaggaggcggctggctggtgttccagaggcggcaggacggctctgtggacttcttccgctcctggagcagctaccgggccggcttcggcaaccaggagagcgagttctggctgggcaatgaaaacctgcaccagctgaccctgcagggcaactgggagctgcgggtggagctggaggacttcaatggaaacagaacatttgcccactacgccaccttccggctgctgggggaggtggaccactaccagctggccctgggcaagttcagcgagggcacagctggggagtag

SEQ ID NO: 152525 - DNA, 2094 bp, Artificial Sequence
  Description of Artificial Sequence: Synthetic coding sequence
atggccgagaccagccctgagcccagcggccagctggtggtgcacagtgatgcccacagcgacacagtgctggccagctttgaggaccagaggaagaagggcttcctgtgtgacatcaccctcatcgtggagaatgtgcacttccgggcccacaaggccctgctggccgccagcagcgagtacttctccatgatgtttgctgaggagggggagatcggccagagcatctacatgctggagggcatggtggccgacaccttcggcatcctgctggagttcatctacacaggctacctgcacgccagcgagaagagcacagagcagatcctggccacagcccagttcctgaaggtgtatgacctggtgaaggcctacacagacttccagaacaaccacagcagccccaagcccaccaccctgaacacagctggggcccctgtggtggtgatcagcaacaagaagaatgacccccccaagaggaagaggggccggcccaagaaggtgaacaccctgcaggaggagaagtctgagctggccgctgaggaggagatccagctgcgggtgaacaacagcgtgcagaaccggcagaactttgtggtgaagggggacagcggcgtgctgaatgagcagattgctgccaaggagaaggaggagagcgagcccacctgtgagcccagccgggaggaggagatgcctgtggagaaggatgaaaattatgaccccaagacagaagatggccaggccagccagagccgctacagcaagaggcgcatctggaggtctgtgaagctgaaggactacaagctggtgggggaccaggaggaccacggcagcgccaagaggatctgtggccgcaggaagaggcctgggggccctgaggcccgctgcaaggactgtgggaaggtgttcaagtacaaccacttcctggccatccaccagaggagccacactggagagcggcccttcaagtgcaatgaatgtgggaaaggatttgcccagaagcacagcctgcaggtgcacaccaggatgcacactggagagcggccctacacctgcaccgtgtgcagcaaggccctgaccaccaagcacagcctgctggagcacatgagcctgcacagcggccagaagagcttcacctgtgaccagtgtgggaagtacttcagccagaaccggcagctgaagagccactacagagtgcacacaggccacagcctgcctgagtgcaaggactgccacaggaagttcatggatgtgtcccagctgaagaagcacctgcggacccacactggagagaagcccttcacctgtgagatctgtgggaagagcttcaccgccaagagcagcctgcagacccacatccgcatccacagaggagagaagccctacagctgtggcatctgtgggaagagcttcagtgacagcagcgccaagaggaggcactgcatcctgcacacaggcaagaagcccttcagctgcccagagtgcaacctgcagtttgcccggctggacaacctgaaggcccacctgaagatccacagcaaggagaagcacgccagtgatgccagcagcatcagcggcagcagcaacacagaggaggtgaggaacatcctgcagctgcagccctaccagctgagcaccagcggggagcaggagatccagctgctggtgacagattctgtgcacaacatcaacttcatgcctggccccagccagggcatcagcatcgtgacagctgagagcagccagaacatgacagctgaccaggccgccaacctgaccctgctgacccagcagcctgagcagctgcagaacctgatcctgagcgcccagcaggagcagacagagcacatccagagcctgaacatgattgagagccagatgggccccagccagacagagcctgtgcacgtgatcaccctgagcaaggagaccctggagcacctgcacgcccaccaggagcagacagaggagctgcacctggccaccagcaccagtgaccctgcccagcacctgcagctgacccaggagcccggccccccaccacccacccaccacgtgccccagcccacccccctgggccaggagcagagctag

SEQ ID NO: 152526 - DNA, 420 bp, Artificial Sequence
  Description of Artificial Sequence: Synthetic coding sequence
atgggccagaagggcagcagcggcctcttccgggctgtgtctgccttcggcgtggtgggctttgtgcgcttcctggagggctactacatcgtgctgatcaccaagaggaggaagatggctgacatcggcggccacgccatctacaaggtggaggacaccaacatgatctacatccccaatgacagcgtgcgggtgacccacccagatgaggcccgctacctgcgcatcttccagaatgtggacctgagcagcaacttctacttctcctacagctatgacctgagccacagcctgcagtacaacctgactgtgctgaggatgcccctggagatgctgaagtctgagatgacccagaaccggcaggagagctttgacatctttgaagatgagggcctcatcacccagggcggcagcggctag

SEQ ID NO: 152527 - DNA, 411 bp, Artificial Sequence
  Description of Artificial Sequence: Synthetic coding sequence
tgactgtttgaggagctgtatgaggaccacggggacaccctgagcctgcagtatggaggcagccagctggtgcaccgggtgaagacctacaggaagatcgccccctggacccagcacagcaaggacatcatgcagaccctgagccgctactacagcaatgccttcagtgatgctgaccggcaggacagcatcaacctcttcctgggcgtcttccaccccacagagggcaagccccacctgtgggagctgcccacagacttctacctgcaccacaagaacaccatgaggctgctgcccaccaggaggagctacacctactggtggaccccagaggtgatcaagcacctgcccctgccctatgatgagggcttcctggcccggagccctgccaacctggagtgcagcaactag

SEQ ID NO: 152528 - DNA, 300 bp, Artificial Sequence
  Description of Artificial Sequence: Synthetic coding sequence
atgaccagcagcgcccgggacttcatgcccaagacagtgggcatcgaccccagccccttcaccgtgaggaagccagatgagaccgggaagtctgtgctgggcaacaagagcaaccgggaggaggccgtgctgcagaggaagacagctgccagcgcccctcctcctccttctgaggaggccgtgagcagcagcagtgaagatgattctggaacagaccgggaggaggagggctctgtgtcccagaggagcacccctgtgaagatgacagatgctggggacagcgccaaggtgacagaatag

SEQ ID NO: 152529 - DNA, 1806 bp, Artificial Sequence
  Description of Artificial Sequence: Synthetic coding sequence
atgacaggctacctgcgcatcttccagaatgtggacctgagcagcaacttctacttctcctacagctatgacctgagccacagcctgcagtacaacctgactgtgctgaggatgcccctggagatgctgaagtctgagatgacccagaaccggcaggagagctttgacatctttgaagatgagggcctcatcacccagggcggctctgtggaccaggccgacccctttgcccacgtggccgccctgcactttgaccagatgttccagagatttggcagccccatcatcatcctgaacctggtgaaggagcgggagaagaggaagcatgagcgcatcctgtctgaggagctggtggccgctgtgacctacctgaaccagttcctgcccccagagcacaccatcgtgtacatcccctgggacatggccaagtacaccaagagcaagctgtgcaatgtgctggaccggctgaatgtgattgctgagagcgtggtgaagaagacaggcttctttgtgaacagaccagacagctactgcagcatcctgcggccagatgagaagtggaatgagctgggcggctgtgtgatccccaccggccgcctgcagacaggcatcctgcggaccaactgtgtggactgcctggacaggaccaacacagcccagttcatggtgggcaaatgtgccctggcctaccagctgtacagcctgggcctgattgacaagcccaacctgcagtttgacacagatgctgtgcggctgtttgaggagctgtatgaggaccacggggacaccctgagcctgcagtatggaggcagccagctggtgcaccgggtgaagacctacaggaagatcgccccctggacccagcacagcaaggacatcatgcagaccctgagccgctactacagcaatgccttcagtgatgctgaccggcaggacagcatcaacctcttcctgggcgtcttccaccccacagagggcaagccccacctgtgggagctgcccacagacttctacctgcaccacaagaacaccatgaggctgctgcccaccaggaggagctacacctactggtggaccccagaggtgatcaagcacctgcccctgccctatgatgaagtcatctgtgctgtgaacctgaagaagctgattgtgaagaagttccacaagtatgaggaggagattgacatccacaatgagttcttccggccctatgagctgagcagctttgatgacaccttctgcctggccatgaccagcagcgcccgggacttcatgcccaagacagtgggcatcgaccccagccccttcaccgtgaggaagccagatgagaccgggaagtctgtgctgggcaacaagagcaaccgggaggaggccgtgctgcagaggaagacagctgccagcgcccctcctcctccttctgaggaggccgtgagcagcagcagtgaagatgattctggaacagaccgggaggaggagggctctgtgtcccagaggagcacccctgtgaagatgacagatgctggggacagcgccaaggtgacagaaaatgtggtgcagcccatgaaggagctgtatggcatcaacctgagtgatggcctgtctgaggaggacttcagcatctacagcaggacccccatcagcgccttcagccaggacaacatctatgaggtgcagcccccccgggtggacaggaagagcacagagatcttccaggcccacatccaggccagccagggcatcatgcagcccctgggcaaggaggacagctccatgtaccgggagtacatccggaaccgctacctgtag

SEQ ID NO: 152530 - DNA, 714 bp, Artificial Sequence
  Description of Artificial Sequence: Synthetic coding sequence
atgagatacttcctggtgggcagcaacaatgctgagaccaagtacagagtgctgaagattgacagaacagagcccaaggacctggtgatcattgatgacagacatgtgtacacccagcaggaggtgcgggagctgctgggccgcctggacctgggcaacagaaccaagatgggccagaagggcagcagcggcctcttccgggctgtgtctgccttcggcgtggtgggctttgtgcgcttcctggagggctactacatcgtgctgatcaccaagaggaggaagatggctgacatcggcggccacgccatctacaaggtggaggacaccaacatgatctacatccccaatgacagcgtgcgggtgacccacccagatgaggcccgctacctgcgcatcttccagaatgtggacctgagcagcaacttctacttctcctacagctatgacctgagccacagcctgcagtacaacctgactgtgctgaggatgcccctggagatgctgaagtctgagatgacccagaaccggcaggagagctttgacatctttgaagatgagggcctcatcacccagggcggcagcggcgtgtttggcatctgcagcgagccctacatgaagtatgtgtggaatggagagctgctggacatcatcaagagcacagtgcaccgggactggctgctgtacatcatccacggcttctgtggccagagctag

SEQ ID NO: 152531 - DNA, 969 bp, Artificial Sequence
  Description of Artificial Sequence: Synthetic coding sequence
ctctaccaggtgtccacccatgagcagagcgagagcgcccacggccgcacaggccccagcactggaggccggcagaggagcagacatgagcaggcccgggacagcagccgccacagcgccagccaggagggccaggacaccatccggggccaccctggcagcagcagaggaggccggcagggcagccactatgagcagagcgtggacagcagcggccacagcggcagccaccacagccacaccaccagccaggagaggagtgatgtgtcccggggccagagcggcagccgctctgtgtcccggcagaccagaaatgagaagcagagcggagatggcagccgccacagcggcagccgccaccacgaggccagcagcagagctgacagcagccgccacagccaggtgggccagggccagagcagcggccccaggaccagcaggaaccagggcagctctgtgtcccaggacagcgacagccagggccacagcgaggacagcgagcggcgcagcggcagcgccagcaggaaccaccacggcagcgcccaggagcagagcagagatggcagccgccaccccaggagccaccatgaagatcgggccggccacggccacagcgctgagagcagccggcagagcggcacccaccacgccgagaacagcagcggcggccaggccgccagcagccatgagcaggcccggagcagcgctggggagcggcacggcagccaccaccagcagagcgctgacagcagccgccacagcggcatcggccacggccaggccagcagcgctgtgcgggacagcggccaccggggcagcagcggcagccaggccagtgacagcgagggccacagcgaggacagcgacacccagagcgtgtctgcccacggccaggccggcccccaccagcagagccaccaggagagcacccggggccgctctgctggccgcagcggccgctctggatag

SEQ ID NO: 152532 - DNA, 969 bp, Artificial Sequence
  Description of Artificial Sequence: Synthetic coding sequence
ctctaccaggtgtccacccatgagcagagcgagagcagccacggctggacaggccccagcacccggggccggcagggcagcagacatgagcaggcccaggacagcagccgccacagcgccagccaggacggccaggacaccatccggggccaccctggcagcagcagaggaggccggcagggctaccaccacgagcacagcgtggacagcagcggccacagcggcagccaccacagccacaccaccagccagggccgcagtgatgccagccggggccagagcggcagccgcagcgccagcaggaccaccagaaatgaggagcagagcggagatggcagccgccacagcggcagccgccaccacgaggccagcacccatgctgacatcagccgccacagccaggccgtgcagggccagagcgagggcagccgccgcagccggcggcagggcagctctgtgtcccaggacagcgacagcgagggccacagcgaggacagcgagcgctggagcggcagcgccagcaggaaccaccggggctctgtgcaggagcagagcagacatggcagccgccaccccaggagccaccatgaagatcgggccggccacggccacagcgctgacaggagccggcagagcggcaccaggcatgctgagaccagcagcggcggccaggccgccagcagccatgagcaggcccggagcagccctggagagcggcacggcagccgccaccagcagagcgctgacagcagccgccacagcggcatcccccggggccaggccagcagcgctgtgcgggacagccgccactggggcagcagcggcagccaggccagtgacagcgagggccacagcgaggagagtgacacccagagcgtgtctggccacggccaggccggcccccaccagcagagccaccaggagagcgcccgggacagaagtggcggccgcagcggccgctctggatag

SEQ ID NO: 152533 - DNA, 12186 bp, Artificial Sequence
  Description of Artificial Sequence: Synthetic coding sequence
atgagcaccctgctggagaacatctttgccatcatcaacctcttcaagcagtacagcaagaaggacaagaacacagacaccctgagcaagaaggagctgaaggagctgctggagaaggagttccggcagatcctgaagaacccagatgatcctgacatggtggatgtgttcatggaccacctggacatcgaccacaacaagaagattgacttcacagagttcctgctgatggtgttcaagctggcccaggcctactatgagagcaccaggaaggagaacctgcccatcagcggccacaagcacaggaagcacagccaccacgacaagcatgaggacaacaagcaggaggagaacaaggagaacaggaagaggcccagcagcctggagaggaggaacaacagaaaaggaaacaagggccgcagcaagagcccccgggagactggaggcaagagacatgagagcagcagcgagaagaaggagaggaagggctacagccccacccaccgggaggaggagtatggcaagaaccaccacaacagcagcaagaaggagaagaacaagacagagaacacccggctgggggacaacaggaagaggctgtctgagcggctggaggagaaggaggacaatgaggagggcgtgtatgactatgagaacacaggccgcatgacccagaagtggatccagagcggccacatcgccacctactacaccatccaggatgaggcctatgacaccacagacagcctgctggaggagaacaagatctatgaaagaagccgcagcagtgatggcaagagcagcagccaggtgaacagaagcagacatgagaacaccagccaggtgcccctgcaggagagcaggaccaggaagaggcggggcagccgggtgtcccaggaccgggacagcgagggccacagcgaggacagcgagcggcacagcggcagcgccagcaggaaccaccacggcagcgcctgggagcagagcagagatggcagccgccaccccaggagccatgatgaagatcgggccagccacggccacagcgctgacagcagccggcagagcggcaccaggcatgctgagaccagcagccggggccagacagccagcagccatgagcaggcccggagcagccctggagagcggcacggcagcggccaccagcagagcgctgacagcagccgccacagcgccaccggccggggccaggccagcagcgctgtgtctgaccggggccaccggggcagcagcggcagccaggccagtgacagcgagggccacagcgagaacagcgacacccagagcgtgtctggccacggcaaggccggcctgcggcagcagagccaccaggagagcacccggggccgcagcggggagaggagcggccgcagcggcagcagcctgtaccaggtgtccacccatgagcagcctgacagcgcccacggccgcacaggcaccagcactggaggccggcagggcagccaccacgagcaggcccgggacagcagccgccacagcgccagccaggagggccaggacaccatccggggccaccctggcagcagcagaggaggccggcagggcagccaccacgagcagagcgtgaacagaagtggccacagcggcagccaccacagccacaccaccagccagggccgcagtgatgccagccacggccagagcggcagccgcagcgccagccggcagaccagaaatgaggagcagagcggagatggcaccaggcacagcggcagccgccaccacgaggccagcagccaggccgacagcagccgccacagccaggtgggccagggccagagcagcggccccaggaccagcaggaaccagggcagctctgtgtcccaggacagcgacagccagggccacagcgaggacagcgagcgctggagcggcagcgccagcaggaaccaccacggcagcgcccaggagcagagcagagatggcagccgccaccccaggagccaccatgaagatcgggccggccacggccacagcgctgacagcagcaggaagagcggcaccaggcacacccagaacagcagcagcggccaggccgccagcagccatgagcaggcccggagcagcgctggggagcggcacggcagccgccaccagctgcagagcgctgacagcagccgccacagcggcactggacatggccaggccagcagcgctgtgcgggacagcggccaccggggcagcagcggcagccaggccacagacagcgagggccacagtgaagattctgacacccagagcgtgtctggccacggccaggccggccaccaccagcagagccaccaggagagcgcccgggacagaagtggagagaggagccgccgcagcggcagcttcctgtaccaggtgtccacccacaagcagagcgagagcagccacggctggacaggccccagcactggagtgcggcagggcagccaccacgagcaggcccgggacaacagccgccacagcgccagccaggacggccaggacaccatccggggccaccctggcagcagcagaagaggccggcagggcagccaccacgagcagagcgtggacaggagcggccacagcggcagccaccacagccacaccaccagccagggccgcagtgatgccagccggggccagagcggcagccgcagcgccagcaggaccaccagaaatgaggagcagagcagagatggcagccgccacagcggcagccgccaccacgaggccagcagccacgccgacatcagccgccacagccaggccggccagggccagagcgagggcagcaggaccagccggcggcagggcagctctgtgtcccaggacagcgacagcgagggccacagtgaagattctgagcgctggagcggcagcgccagcaggaaccaccggggcagcgcccaggagcagagccgccacggcagccgccaccccaggagccaccacgaggacagagctggccacggccacagcgctgacagcagccggcagagcggcacccctcatgctgagaccagcagcggcggccaggccgccagcagccatgagcaggcccggagcagccctggagagagacatggcagccgccaccagcagagcgctgacagcagccgccacagcggcatcccccggcggcaggccagcagcgctgtgcgggacagcggccactggggcagcagcggcagccaggccagtgacagcgagggccacagcgaggagagtgacacccagagcgtgtctggccacggccaggacggcccccaccagcagagccaccaggagagcgcccgggactggagcggcggccgcagcggccgcagcggcagcttcatctaccaggtgtccacccatgagcagagcgagagcgcccacggccgcaccaggaccagcacaggccggcggcagggcagccaccacgagcaggcccgggacagcagccgccacagcgccagccaggagggccaggacaccatccgggcccaccctggcagccggcggggcggccggcagggcagccaccacgagcagagcgtggacaggagcggccacagcggcagccaccacagccacaccaccagccagggccgcagtgatgccagccacggccagagcggcagccgcagcgccagccggcagaccaggaaggacaagcagagcggagatggcagccgccacagcggcagccgccaccacgaggccgcctcctgggccgacagcagccgccacagccaggtgggccaggagcagagcagcggcagcaggaccagccgccaccagggcagctctgtgtcccaggacagcgacagcgagcggcacagtgatgattctgagcggctgagcggcagcgccagcaggaaccaccacggcagcagccgggagcagagcagagatggcagccgccaccctggcttccaccaggaggaccgggccagccacggccacagcgctgacagcagccggcagagcggcacccaccacacagagagcagcagccacggccaggccgtgagcagccatgagcaggcccggagcagccctggagagagacatggcagccgccaccagcagagcgctgacagcagccgccacagcggcatcggccaccggcaggccagcagcgctgtgcgggacagcggccaccggggcagcagcggcagccaggtgaccaacagcgagggccacagtgaagattctgacacccagagcgtgtctgcccacggccaggccggcccccaccagcagagccacaaggagagcgcccggggccagagcggggagagcagcggccgcagccgctccttcctgtaccaggtgagcagccatgagcagagcgagagcacccacggccagacagcccccagcactggaggccggcagggcagcagacatgagcaggccaggaacagcagccgccacagcgccagccaggacggccaggacaccatccggggccaccctggcagcagccggggcggccggcagggcagctaccacgagcagagcgtggacaggagcggccacagcggctaccaccacagccacaccaccccccagggccgcagtgatgccagccacggccagagcggccccaggtctgccagccggcagaccagaaatgaggagcagagcggagatggcagccgccacagcggcagccgccaccacgagcccagcacccgggccggcagcagccgccacagccaggtgggccagggcgagagcgctggcagcaagaccagccggcggcagggcagctctgtgtcccaggaccgggacagcgagggccacagtgaagattctgaaagaagaagtgaaagtgccagcaggaaccactacggcagcgcccgggagcagagccgccacggcagcaggaaccccaggagccaccaggaggaccgggccagccacggccacagcgctgagagcagccggcagagcggcaccaggcatgctgagaccagcagcggcggccaggccgccagcagccaggagcaggcccggagcagccctggagagagacatggcagccgccaccagcagagcgctgacagcagcacagattctggaactggaagacggcaggacagctctgtggtgggggacagcggcaacagaggcagcagcggcagccaggccagtgacagcgagggccacagcgaggagagtgacacccagagcgtgtctgcccacggccaggccggcccccaccagcagagccaccaggagagcacccggggccagagcggggagaggagcggccgcagcggcagcttcctgtaccaggtgtccacccatgagcagagcgagagcgcccacggccgcacaggccccagcactggaggccggcagaggagcagacatgagcaggcccgggacagcagccgccacagcgccagccaggagggccaggacaccatccggggccaccctggcagcagccggggcggccggcagggcagccactatgagcagagcgtggacagcagcggccacagcggcagccaccacagccacaccaccagccaggagaggagtgatgtgtcccggggccagagcggcagccgctctgtgtcccggcagaccagaaatgagaagcagagcggagatggcagccgccacagcggcagccgccaccacgaggccagcagcagagctgacagcagccgccacagccaggtgggccagggccagagcagcggccccaggaccagcaggaaccagggcagctctgtgtcccaggacagcgacagccagggccacagtgaagattctgagcgctggagcggcagcgccagcaggaaccacctgggcagcgcctgggagcagagcagagatggcagccgccaccctggcagccaccacgaggacagagctggccacggccacagcgctgacagcagccggcagagcggcaccaggcacacagagagcagcagccggggccaggccgccagcagccatgagcaggcccggagcagcgctggggagagacatggcagccaccaccagctgcagagcgctgacagcagccgccacagcggcatcggccacggccaggccagcagcgctgtgcgggacagcggccaccggggctacagcggcagccaggccagtgacagcgagggccacagcgaggacagcgacacccagagcgtgtctgcccagggcaaggccggcccccaccagcagagccacaaggagagcgcccggggccagagcggggagagcagcggccgcagcggcagcttcctgtaccaggtgtccacccatgagcagagcgagagcacccacggccagagcgcccccagcactggaggccggcagggcagccactatgaccaggcccaggacagcagccgccacagcgccagccaggagggccaggacaccatccggggccaccctggccccagcagaggaggccggcagggcagccaccaggagcagagcgtggacagaagtggccacagcggcagccaccacagccacaccaccagccagggccgcagtgatgccagccggggccagagcggcagccgcagcgccagcaggaagacctatgacaaggagcagagcggagatggcagccgccacagcggcagccaccaccacgaggccagctcctgggccgacagcagccgccacagcctggtgggccagggccagagcagcggccccaggaccagccggccccggggcagctctgtgtcccaggacagcgacagcgagggccacagcgaggacagcgagcggcgcagcggcagcgccagcaggaaccaccacggcagcgcccaggagcagagcagagatggcagccgccaccccaggagccaccatgaagatcgggccggccacggccacagcgctgagagcagccggcagagcggcacccaccacgccgagaacagcagcggcggccaggccgccagcagccatgagcaggcccggagcagcgctggggagcggcacggcagccaccaccagcagagcgctgacagcagccgccacagcggcatcggccacggccaggccagcagcgctgtgcgggacagcggccaccggggcagcagcggcagccaggccagtgacagcgagggccacagcgaggacagcgacacccagagcgtgtctgcccacggccaggccggcccccaccagcagagccaccaggagagcacccggggccgctctgctggccgcagcggccgcagcggcagcttcctgtaccaggtgtccacccatgagcagagcgagagcgcccacggccgcacaggcaccagcactggaggccggcagggcagccaccacaagcaggcccgggacagcagccgccacagcaccagccaggagggccaggacaccatccacggccaccctggcagcagcagcggcggccggcagggcagccactatgagcagctggtggacagaagtggccacagcggcagccaccacagccacaccaccagccagggccgcagtgatgccagccacggccacagcggcagccgcagcgccagccggcagaccagaaatgatgagcagagcggagatggcagccgccacagcggcagccgccaccacgaggccagcagcagagctgacagcagcggccacagccaggtgggccagggccagagcgagggccccaggaccagcaggaactggggcagcagcttcagccaggacagcgacagccagggccacagcgaggacagcgagcgctggagcggcagcgccagcaggaaccaccacggcagcgcccaggagcagctgagagatggcagccgccaccccaggagccaccaggaggaccgggccggccacggccacagcgctgacagcagccggcagagcggcaccaggcacacccagaccagcagcggcggccaggccgccagcagccatgagcaggcccggagcagcgctggggagcggcacggcagccaccaccagcagagcgctgacagcagccgccacagcggcatcggccacggccaggccagcagcgctgtgcgggacagcggccaccggggctacagcggcagccaggccagtgacaatgaaggccacagcgaggacagcgacacccagagcgtgtctgcccacggccaggccggcagccaccagcagagccaccaggagagcgcccggggccgcagcggggagaccagcggccacagcggcagcttcctgtaccaggtgtccacccatgagcagagcgagagcagccacggctggacaggccccagcacccggggccggcagggcagcagacatgagcaggcccaggacagcagccgccacagcgccagccaggacggccaggacaccatccggggccaccctggcagcagcagaggaggccggcagggctaccaccacgagcacagcgtggacagcagcggccacagcggcagccaccacagccacaccaccagccagggccgcagtgatgccagccggggccagagcggcagccgcagcgccagcaggaccaccagaaatgaggagcagagcggagatggcagccgccacagcggcagccgccaccacgaggccagcacccatgctgacatcagccgccacagccaggccgtgcagggccagagcgagggcagccgccgcagccggcggcagggcagctctgtgtcccaggacagcgacagcgagggccacagcgaggacagcgagcgctggagcggcagcgccagcaggaaccaccacggcagcgcccaggagcagctgagagatggcagccgccaccccaggagccaccaggaggaccgggccggccacggccacagcgctgacagcagccggcagagcggcaccaggcacacccagaccagcagcggcggccaggccgccagcagccatgagcaggcccggagcagcgctggggagcggcacggcagccaccaccagcagagcgctgacagcagccgccacagcggcatcggccacggccaggccagcagcgctgtgcgggacagcggccaccggggctacagcggcagccaggccagtgacaatgaaggccacagcgaggacagcgacacccagagcgtgtctgcccacggccaggccggcagccaccagcagagccaccaggagagcgcccggggccgcagcggggagaccagcggccacagcggcagcttcctgtaccaggtgtccacccatgagcagagcgagagcagccacggctggacaggccccagcacccggggccggcagggcagcagacatgagcaggcccaggacagcagccgccacagcgccagccagtatggccaggacaccatccggggccaccctggcagcagcagaggaggccggcagggctaccaccacgagcacagcgtggacagcagcggccacagcggcagccaccacagccacaccaccagccagggccgcagtgatgccagccggggccagagcggcagccgcagcgccagcaggaccaccagaaatgaggagcagagcggggacagcagccgccacagcgtgagccgccaccacgaggccagcacccatgctgacatcagccgccacagccaggccgtgcagggccagagcgagggcagccgccgcagccggcggcagggcagctctgtgtcccaggacagcgacagcgagggccacagcgaggacagcgagcgctggagcggcagcgccagcaggaaccaccggggctctgtgcaggagcagagcagacatggcagccgccaccccaggagccaccatgaagatcgggccggccacggccacagcgctgacaggagccggcagagcggcaccaggcatgctgagaccagcagcggcggccaggccgccagcagccatgagcaggcccggagcagccctggagagcggcacggcagccgccaccagcagagcgctgacagcagccgccacagcggcatcccccggggccaggccagcagcgctgtgcgggacagccgccactggggcagcagcggcagccaggccagtgacagcgagggccacagcgaggagagtgacacccagagcgtgtctggccacggccaggccggcccccaccagcagagccaccaggagagcgcccgggacagaagtggcggccgcagcggccgcagcggcagcttcctgtaccaggtgtccacccatgagcagagcgagagcgcccacggccgcaccaggaccagcactggaagacggcagggcagccaccacgagcaggcccgggacagcagccgccacagcgccagccaggagggccaggacaccatccggggccaccctggcagcagccggcggggccggcagggcagccactatgagcagagcgtggacagaagtggccacagcggcagccaccacagccacaccaccagccagggccgcagtgatgccagccggggccagagcggcagccgcagcgccagccggcagaccagaaatgatgagcagagcggagatggcagccgccacagctggagccaccaccacgaggccagcacccaggccgacagcagccgccacagccagagcggccagggccagagcgctggccccaggaccagcaggaaccagggcagctctgtgtcccaggacagcgacagccagggccacagcgaggacagcgagcgctggagcggcagcgccagcaggaaccaccggggcagcgcccaggagcagagcagagatggcagccgccaccccaccagccaccatgaagatcgggccggccacggccacagcgctgagagcagccggcagagcggcacccaccacgccgagaacagcagcggcggccaggccgccagcagccatgagcaggcccggagcagcgctggggagcggcacggcagccaccaccagcagagcgctgacagcagccgccacagcggcatcggccacggccaggccagcagcgctgtgcgggacagcggccaccggggcagcagcggcagccaggccagtgacagcgagggccacagcgaggacagcgacacccagagcgtgtctgcccacggccaggccggcccccaccagcagagccaccaggagagcacccggggccgctctgctggccgcagcggccgcagcggcagcttcctgtaccaggtgtccacccatgagcagagcgagagcgcccacggccgggccggccccagcactggaggccggcagggcagcagacatgagcaggcccgggacagcagccgccacagcgccagccaggagggccaggacaccatccggggccaccctggcagcagaagaggaggccggcagggcagctaccacgagcagagcgtggacagaagtggccacagcggcagccaccacagccacaccaccagccagggccgcagtgatgccagccacggccagagcggcagccgcagcgccagccgggagaccagaaatgaggagcagagcggagatggcagccgccacagcggcagccgccaccacgaggccagcacccaggccgacagcagccgccacagccagagcggccagggcgagagcgctggcagccgccgcagccggcggcagggcagctctgtgtcccaggacagcgacagcgaggcctacccagaggacagcgagcggcgctctgagagcgccagcaggaaccaccacggcagcagccgggagcagagcagagatggcagccgccaccctggcagcagccaccgggacacagccagccacgtgcagagcagccctgtgcagagcgacagcagcacagccaaggagcacggccacttcagcagcctgagccaggacagcgcctaccacagcggcatccagagccggggcagcccccacagcagcagcagctaccactaccagagcgagggcacagagcggcagaagggccagagcggcctggtgtggaggcatggcagctatggcagcgctgactatgactatggagagagcggcttccgccacagccagcacggctctgtgtcctacaacagcaaccctgtggtgttcaaggagaggagtgacatctgcaaggccagcgccttcggcaaggaccacccccgctactatgccacctacatcaacaaggaccccggcctgtgtggccacagcagtgacatcagcaagcagctgggcttcagccagagccagcgctactactactatgaatag

SEQ ID NO: 152534 - DNA, 969 bp, Artificial Sequence
  Description of Artificial Sequence: Synthetic coding sequence
ctctaccaggtgtccacccatgagcagcctgacagcgcccacggccgcacaggcaccagcactggaggccggcagggcagccaccacgagcaggcccgggacagcagccgccacagcgccagccaggagggccaggacaccatccggggccaccctggcagcagcagaggaggccggcagggcagccaccacgagcagagcgtgaacagaagtggccacagcggcagccaccacagccacaccaccagccagggccgcagtgatgccagccacggccagagcggcagccgcagcgccagccggcagaccagaaatgaggagcagagcggagatggcaccaggcacagcggcagccgccaccacgaggccagcagccaggccgacagcagccgccacagccaggccggccagggccagagcgagggcagcaggaccagccggcggcagggcagctctgtgtcccaggacagcgacagcgagggccacagcgaggacagcgagcgctggagcggcagcgccagcaggaaccaccggggcagcgcccaggagcagagcagacatggcagccgccaccccaggagccaccatgaagatcgggccggccacggccacagcgctgacagcagccggcagagcggcacccctcatgctgagaccagcagcggcggccaggccgccagcagccatgagcaggcccggagcagccctggagagcggcacggcagccgccaccagcagagcgctgacagcagccgccacagcggcatcccccggcggcaggccagcagcgctgtgcgggacagcggccactggggcagcagcggcagccaggccagtgacagcgagggccacagcgaggagagtgacacccagagcgtgtctggccacggccaggacggcccccaccagcagagccaccaggagagcgcccgggactggagcggcggccgcagcggccgctctggatag

SEQ ID NO: 152535 - DNA, 3402 bp, Artificial Sequence
  Description of Artificial Sequence: Synthetic coding sequence
atgaggagccggggcagtgacacagagggcagcgcccagaagaagttccccaggcacaccaagggccacagcttccagggccccaagaacatgaagcaccggcagcaggacaaggacagccccagcgagagtgatgtgatcctgccctgccccaaggccgagaagccccacagcggaaatggccaccaggccgaggacctgagcagagatgacctgctcttcctgctgagcatcctggagggggagctgcaggccagagatgaagtcatcggcatcctgaaggccgagaagatggacctggccctgctggaggcccagtatggctttgtgacccccaagaaggtgctggaggccctgcagagagatgccttccaggccaagagcaccccctggcaggaggacatctatgagaagcccatgaatgagctggacaaggtggtggagaagcacaaggagagctaccgccgcatcctgggccagctgctggtggccgagaagagccggcggcagaccatcctggagctggaggaggagaagaggaagcacaaggagtacatggagaagagtgatgagttcatctgcctgctggagcaggagtgtgagcggctgaagaagctgattgaccaggagatcaagagccaggaggagaaggagcaggagaaggagaagagggtgaccaccctgaaggaggagctgaccaagctgaagagctttgccctgatggtggtggatgagcagcagaggctgacagcccagctgaccctgcagaggcagaagatccaggagctgaccaccaatgccaaggagacccacaccaagctggccctggccgaggcccgggtgcaggaggaggagcagaaggccacccggctggagaaggagctgcagacccagaccaccaagttccaccaggaccaggacaccatcatggccaagctgaccaatgaagacagccagaaccggcagctgcagcagaagctggccgccctgagccggcagattgatgagctggaggagaccaacagaagcctgaggaaggccgaggaggagctgcaggacatcaaggagaagatcagcaagggggagtatggaaatgccggcatcatggccgaggtggaggagctgaggaagagggtgctggacatggagggcaaggatgaggagctgatcaagatggaggagcagtgccgggacctgaacaagaggctggagcgggagaccctgcagagcaaggacttcaagctggaggtggagaagctgagcaagaggatcatggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagccctgtgcggcctgccagccccagcgcccccctgcaggacaacagaacccagggcctcatcaatggagccctgaacaagaccaccaacaaggtgaccagcagcatcaccatcacccccacagccacccccctgccccggcagagccagatcaccgtgagcaacatctacaactag

SEQ ID NO: 152536 - DNA, 3408 bp, Artificial Sequence
  Description of Artificial Sequence: Synthetic coding sequence
atgaggagccggggcagtgacacagagggcagcgcccagaagaagttccccaggcacaccaagggccacagcttccagggccccaagaacatgaagcaccggcagcaggacaaggacagccccagcgagagtgatgtgatcctgccctgccccaaggccgagaagccccacagcggaaatggccaccaggccgaggacctgagcagagatgacctgctcttcctgctgagcatcctggagggggagctgcaggccagagatgaagtcatcggcatcctgaaggccgagaagatggacctggccctgctggaggcccagtatggctttgtgacccccaagaaggtgctggaggccctgcagagagatgccttccaggccaagagcaccccctggcaggaggacatctatgagaagcccatgaatgagctggacaaggtggtggagaagcacaaggagagctaccgccgcatcctgggccagctgctggtggccgagaagagccggcggcagaccatcctggagctggaggaggagaagaggaagcacaaggagtacatggagaagagtgatgagttcatctgcctgctggagcaggagtgtgagcggctgaagaagctgattgaccaggagatcaagagccaggaggagaaggagcaggagaaggagaagagggtgaccaccctgaaggaggagctgaccaagctgaagagctttgccctgatggtggtggatgagcagcagaggctgacagcccagctgaccctgcagaggcagaagatccaggagctgaccaccaatgccaaggagacccacaccaagctggccctggccgaggcccgggtgcaggaggaggagcagaaggccacccggctggagaaggagctgcagacccagaccaccaagttccaccaggaccaggacaccatcatggccaagctgaccaatgaagacagccagaaccggcagctgcagcagaagctggccgccctgagccggcagattgatgagctggaggagaccaacagaagcctgaggaaggccgaggaggagctgcaggacatcaaggagaagatcagcaagggggagtatggaaatgccggcatcatggccgaggtggaggagctgaggaagagggtgctggacatggagggcaaggatgaggagctgatcaagatggaggagcagtgccgggacctgaacaagaggctggagcgggagaccctgcagagcaaggacttcaagctggaggtggagaagctgagcaagaggatcatggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagccctgtgcggcctgccagccccagcgcccccctgcaggacaacagaacccagggcctcatcaatggagccctgaacaagaccaccaacaaggtgaccagcagcatcaccatcacccccacagccacccccctgccccggcagagccagatcaccgtggagcccctgctgctgccccactag

SEQ ID NO: 152537 - DNA, 2682 bp, Artificial Sequence
  Description of Artificial Sequence: Synthetic coding sequence
atggtggtggatgagcagcagaggctgacagcccagctgaccctgcagaggcagaagatccaggagctgaccaccaatgccaaggagacccacaccaagctggccctggccgaggcccgggtgcaggaggaggagcagaaggccacccggctggagaaggagctgcagacccagaccaccaagttccaccaggaccaggacaccatcatggccaagctgaccaatgaagacagccagaaccggcagctgcagcagaagctggccgccctgagccggcagattgatgagctggaggagaccaacagaagcctgaggaaggccgaggaggagctgcaggacatcaaggagaagatcagcaagggggagtatggaaatgccggcatcatggccgaggtggaggagctgaggaagagggtgctggacatggagggcaaggatgaggagctgatcaagatggaggagcagtgccgggacctgaacaagaggctggagcgggagaccctgcagagcaaggacttcaagctggaggtggagaagctgagcaagaggatcatggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagccctgtgcggcctgccagccccagcgcccccctgcaggacaacagaacccagggcctcatcaatggagccctgaacaagaccaccaacaaggtgaccagcagcatcaccatcacccccacagccacccccctgccccggcagagccagatcaccgtgagcaacatctacaactag

SEQ ID NO: 152538 - DNA, 768 bp, Artificial Sequence
  Description of Artificial Sequence: Synthetic coding sequence
atgaggagccggggcagtgacacagagggcagcgcccagaagaagttccccaggcacaccaagggccacagcttccagggccccaagaacatgaagcaccggcagcaggacaaggacagccccagcgagagtgatgtgatcctgccctgccccaaggccgagaagccccacagcggaaatggccaccaggccgaggacctgagcagagatgacctgctcttcctgctgagcatcctggagggggagctgcaggccagagatgaagtcatcggcatcctgaaggccgagaagatggacctggccctgctggaggcccagtatggctttgtgacccccaagaaggtgctggaggccctgcagagagatgccttccaggccaagagcaccccctggcaggaggacatctatgagaagcccatgaatgagctggacaaggtggtggagaagcacaaggagagctaccgccgcatcctgggccagctgctggtggccgagaagagccggcggcagaccatcctggagctggaggaggagaagaggaagcacaaggagtacatggagaagagtgatgagttcatctgcctgctggagcaggagtgtgagcgctggagcctggccctgctgccccggctggagtgcaatggcatgatcctggcccactgcaacctgtgcctgctgggcagcagtgacagccctgccagcgccttccaggtggccggcatcaccggcaccaggcaccacgcccagctggtgtttgtgttcctgtag

SEQ ID NO: 152539 - DNA, 2640 bp, Artificial Sequence
  Description of Artificial Sequence: Synthetic coding sequence
atggtggtggatgagcagcagaggctgacagcccagctgaccctgcagaggcagaagatccaggagctgaccaccaatgccaaggagacccacaccaagctggccctggccgaggcccgggtgcaggaggaggagcagaaggccacccggctggagaaggagctgcagacccagaccaccaagttccaccaggaccaggacaccatcatggccaagctgaccaatgaagacagccagaaccggcagctgcagcagaagctggccgccctgagccggcagattgatgagctggaggagaccaacagaagcctgaggaaggccgaggaggagctgcaggacatcaaggagaagatcagcaagggggagtatggaaatgccggcatcatggccgaggtggaggagctgatcaagatggaggagcagtgccgggacctgaacaagaggctggagcgggagaccctgcagagcaaggacttcaagctggaggtggagaagctgagcaagaggatcatggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagccctgtgcggcctgccagccccagcgcccccctgcaggacaacagaacccagggcctcatcaatggagccctgaacaagaccaccaacaaggtgaccagcagcatcaccatcacccccacagccacccccctgccccggcagagccagatcaccgtgagcaacatctacaactag

SEQ ID NO: 152540 - DNA, 2688 bp, Artificial Sequence
  Description of Artificial Sequence: Synthetic coding sequence
atggtggtggatgagcagcagaggctgacagcccagctgaccctgcagaggcagaagatccaggagctgaccaccaatgccaaggagacccacaccaagctggccctggccgaggcccgggtgcaggaggaggagcagaaggccacccggctggagaaggagctgcagacccagaccaccaagttccaccaggaccaggacaccatcatggccaagctgaccaatgaagacagccagaaccggcagctgcagcagaagctggccgccctgagccggcagattgatgagctggaggagaccaacagaagcctgaggaaggccgaggaggagctgcaggacatcaaggagaagatcagcaagggggagtatggaaatgccggcatcatggccgaggtggaggagctgaggaagagggtgctggacatggagggcaaggatgaggagctgatcaagatggaggagcagtgccgggacctgaacaagaggctggagcgggagaccctgcagagcaaggacttcaagctggaggtggagaagctgagcaagaggatcatggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagccctgtgcggcctgccagccccagcgcccccctgcaggacaacagaacccagggcctcatcaatggagccctgaacaagaccaccaacaaggtgaccagcagcatcaccatcacccccacagccacccccctgccccggcagagccagatcaccgtggagcccctgctgctgccccactag

SEQ ID NO: 152541 - DNA, 2136 bp, Artificial Sequence
  Description of Artificial Sequence: Synthetic coding sequence
atggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagccctgtgcggcctgccagccccagcgcccccctgcaggacaacagaacccagggcctcatcaatggagccctgaacaagaccaccaacaaggtgaccagcagcatcaccatcacccccacagccacccccctgccccggcagagccagatcaccgtggagcccctgctgctgccccactag

SEQ ID NO: 152542 - DNA, 2514 bp, Artificial Sequence
  Description of Artificial Sequence: Synthetic coding sequence
atggtggtggatgagcagcagaggctgacagcccagctgaccctgcagaggcagaagatccaggagctgaccaccaatgccaaggagacccacaccaagctggccctggccgaggcccgggtgcaggaggaggagcagaaggccacccggctggagaaggagctgcagacccagaccaccaagttccaccaggaccaggacaccatcatggccaagctgaccaatgaagacagccagaaccggcagctgcagcagaagctggccgccctgagccggcagattgatgagctggaggagaccaacagaagcctgaggaaggccgaggaggagctgcaggacatcaaggagaagatcagcaagggggagtatggaaatgccggcatcatggccgaggtggaggagctgaggaagagggtgctggacatggagggcaaggatgaggagctgatcaagatggaggagcagtgccgggacctgaacaagaggctggagcgggagaccctgcagagcaaggacttcaagctggaggtggagaagctgagcaagaggatcatggccctggagaagctggaggatgccttcaacaagagcaagcaggagtgctacagcctgaagtgcaacctggagaaggagaggatgaccaccaagcagctgagccaggagctggagagcctgaaggtgcgcatcaaggagctggaggccatcgagagccggctggagaagacagagttcaccctgaaggaggacctgaccaagctgaagaccctgactgtgatgtttgtggatgagaggaagaccatgtctgagaagctgaagaagacagaggacaagctgcaggccgccagcagccagctgcaggtggagcagaacaaggtgaccaccgtgacagagaagctgattgaggagaccaagagggccctgaagagcaagacagatgtggaggagaagatgtacagcgtgaccaaggagagagatgacctgaagaacaagctgaaggccgaggaggagaagggaaatgacctgctgagccgggtgaacatgctgaagaaccggctgcagagcctggaggccatcgagaaggacttcctgaagaacaagctgaaccaggacagcggcaagagcaccacagccctgcaccaggagaacaacaagatcaaggagctgagccaggaggtggagcggctgaagctgaagctgaaggacatgaaggccattgaagatgacctgatgaagacagaagatgaatatgagaccctggagaggagatatgccaatgaaagagacaaggcccagttcctgagcaaggagctggagcacgtgaagatggagctggccaagtacaagctggccgagaagacagagaccagccatgagcagtggctgttcaagaggctgcaggaggaggaggccaagagcggccacctgagccgggaggtggatgccctgaaggagaagatccacgagtacatggccacagaagatctcatctgccacctgcagggcgaccacagcgtgctgcagaagaagctgaaccagcaggagaacagaaacagagacctgggccgggagattgagaacctgaccaaggagctggagcgctaccgccacttcagcaagagcctgcggcccagcctgaatggccgccgcatcagtgacccccaggtgttcagcaaggaggtgcagacagaggccgtggacaatgaacctccagactacaagagcctcatccccctggagagagctgtgatcaatggccagctgtatgaggagagcgagaaccaggatgaggaccccaatgatgagggctctgtgctgtccttcaagtgcagccagagcaccccctgccctgtgaacaggaagctgtggatcccctggatgaagagcaaggagggccacctgcagaatggcaagatgcagaccaagcccaatgccaactttgtgcagcccggggacctggtgctgagccacaccccaggccagcccctgcacatcaaggtgaccccagaccacgtgcagaacacagccaccctggagatcaccagccccaccacagagagcccccacagctacaccagcacagctgtgatccccaactgtggcacccccaagcagaggatcaccatcctgcagaatgccagcatcacccctgtgaagagcaagaccagcacagaggacctgatgaacctggagcagggcatgagccccatcaccatggccacctttgcccgggcccagaccccagagagctgtggcagcctgaccccagagaggaccatgagccccatccaggtgctggccgtgacaggcagcgccagcagccctgagcagggccgcagccctgagcccacagagatcagcgccaagcacgccatcttccgggtgtccccagaccggcagagctcctggcagttccagaggagcaacagcaacagcagcagcgtcatcaccacagaggacaacaagatccacatccacctgggcagcccctacatgcaggccgtggccagcccctag

SEQ ID NO: 152543 - DNA, 7944 bp, Artificial Sequence
  Description of Artificial Sequence: Synthetic coding sequence
atgagcagcagccacagccgggccggccagagcgctgctggagctgcccctgggggcggcgtggacaccagagatgctgagatgcctgccacagagaaggacctggctgaagatgccccctggaagaagatccagcagaacaccttcacccgctggtgcaatgagcacctgaagtgtgtgtccaagagaattgccaacctgcagacagacctgagtgatggcctgcggctcatcgccctgctggaggtgctgagccagaagaagatgcacaggaagcacaaccagaggcccaccttccggcagatgcagctggagaatgtgtctgtggccctggagttcctggaccgggagagcatcaagctggtgtccattgacagcaaggccatcgtggatggcaacctgaagctgatcctgggcctcatctggaccctcatcctgcactacagcatctccatgcccatgtgggatgaggaggaggatgaggaggccaagaagcagacccccaagcagaggctgctgggctggatccagaacaagctgccccagctgcccatcaccaacttcagccgggactggcagagcggccgggccctgggcgccctggtggacagctgtgcccctggcctgtgcccagactgggacagctgggatgccagcaagcctgtgaccaatgcccgggaggccatgcagcaggctgatgactggctgggcatcccccaggtgatcaccccagaggagatcgtggaccccaacgtggatgagcacagcgtgatgacctacctgagccagttccccaaggccaagctgaagccaggggcccccctgcggcccaagctgaaccccaagaaggcccgggcctacggccctggcatcgagcccaccggcaacatggtgaagaagagagctgagttcaccgtggagaccaggtctgctggccagggcgaggtgctggtgtatgtggaggaccctgctggccaccaggaggaggccaaggtgacagccaacaatgacaagaacagaaccttctctgtgtggtacgtgcctgaggtgacaggcacccacaaggtgacagtgctgtttgctggccagcacatcgccaagagcccctttgaggtgtatgtggacaagagccagggagatgccagcaaggtgacagcccagggccctggcctggagcccagcggcaacatcgccaacaagaccacctactttgagatcttcaccgctggagctggcactggagaggtggaggtggtgatccaggaccccatgggccagaagggcaccgtggagccccagctggaggcccggggggacagcacctaccgctgcagctaccagcccaccatggagggcgtgcacacagtgcacgtgacctttgctggggtgcccatccccaggagcccctacacagtgacagtgggccaggcctgcaaccccagcgcctgcagagctgtgggccggggcctgcagcccaagggcgtgcgggtgaaggagacagctgacttcaaggtgtacaccaagggggccggcagcggggagctgaaggtgacagtgaagggccccaagggggaggagcgggtgaagcagaaggacctgggagatggagtgtatggctttgagtactaccccatggtgcccggcacctacatcgtgaccatcacctggggcggccagaacatcggccgcagcccctttgaggtgaaggtgggcacagaatgtggcaaccagaaggtgcgggcctggggccctggcctggagggcggcgtggtgggcaagtctgctgactttgtggtggaggccatcggagatgatgtgggcaccctgggcttctctgtggagggccccagccaggccaagattgaatgtgatgacaagggagatggcagctgtgatgtgcgctactggccccaggaggccggggagtatgctgtgcacgtgctgtgcaacagcgaggacatccggctgagccccttcatggctgacatcagagatgccccccaggacttccacccagacagagtgaaggcccggggccctggcctggagaagacaggagtggccgtgaacaagccagctgagttcaccgtggatgccaagcatggaggcaaggcccccctgcgggtgcaggtgcaggacaatgaaggctgccctgtggaggccctggtgaaggacaatggaaatggcacctacagctgcagctatgtgcccaggaagcctgtgaagcacacagccatggtgtcctggggcggcgtgtccatccccaacagccccttccgggtgaatgtgggcgccggcagccaccccaacaaggtgaaggtgtatggccctggggtggccaagacaggcctgaaggcccacgagcccacctacttcaccgtggactgtgccgaggccggccagggagatgtgtccatcggcatcaagtgtgcccctggggtggtgggccctgctgaggccgacatcgactttgacatcatcagaaatgacaatgacaccttcaccgtgaagtacaccccaagaggagctggcagctacaccatcatggtgctgtttgctgaccaggccacccccaccagccccatccgggtgaaggtggagcccagccatgatgccagcaaggtgaaggccgagggccctggcctgagcaggactggagtggagctgggcaagcccacccacttcaccgtgaatgccaaggccgccggcaagggcaagctggatgtgcagttcagcggcctgaccaagggagatgctgtgagagatgtggacatcatcgaccaccacgacaacacctacacagtgaagtacacccctgtgcagcagggccctgtgggcgtgaatgtgacctatggaggagaccccatccccaagagccccttctctgtggccgtgagccccagcctggacctgagcaagatcaaggtgtctggcctgggggagaaggtggatgtgggcaaggaccaggagttcaccgtgaagagcaagggggccggcggccagggcaaggtggccagcaagatcgtgggccccagcggggctgctgtgccctgcaaggtggagcccggcctgggcgctgacaacagcgtggtgcgcttcctgccccgggaggagggcccctatgaggtggaggtgacctatgatggagtgcctgtgcccggcagccccttccccctggaggccgtggcccccaccaagcccagcaaggtgaaggcctttggacctggcctgcagggcggcagcgctggcagccctgcccgcttcaccatcgacaccaagggagctggcactggaggcctgggcctgactgtggagggcccctgtgaggcccagctggagtgcctggacaatggagatggcacctgcagcgtgtcctatgtgcccacagagcccggggactacaacatcaacatcctgtttgctgacacccacatccctggcagccccttcaaggcccacgtggtgccctgctttgatgccagcaaggtgaagtgcagcggccctggcctggagcgggccacagctggggaggtgggccagttccaggtggactgcagcagcgctggcagcgctgagctgaccatcgagatctgcagcgaggccggcctgcctgctgaggtgtacatccaggaccatggagatggcacccacaccatcacctacatccccctgtgccctggggcctacacagtgaccatcaagtatggaggccagcctgtgcccaacttccccagcaagctgcaggtggagcctgctgtggacaccagcggcgtgcagtgctacggccctggcatcgagggccagggcgtcttccgggaggccaccacagagttctctgtggatgcccgggccctgacccagacaggaggcccccacgtgaaggcccgggtggccaaccccagcggcaacctgacagagacctacgtgcaggacagaggagatggcatgtacaaggtggagtacaccccctatgaggagggcctgcacagcgtggatgtgacctatgatggcagccctgtgcccagcagccccttccaggtgcctgtgacagagggctgtgaccccagccgggtgcgggtgcacggccctggcatccagagcggcaccaccaacaagcccaacaagttcaccgtggagaccagaggagctggcactggaggcctgggcctggccgtggagggccccagcgaggccaagatgagctgcatggacaacaaggatggcagctgcagcgtggagtacatcccctatgaagctggcacctacagcctgaatgtgacctacggcggccaccaggtgcccggcagccccttcaaggtgcctgtgcatgatgtgacagatgccagcaaggtgaagtgcagcggccctggcctgagccctggcatggtgcgggccaacctgccccagagcttccaggtggacaccagcaaggccggcgtggcccccctgcaggtgaaggtgcagggccccaagggcctggtggagcctgtggatgtggtggacaatgctgatggcacccagacagtgaactacgtgcccagccgggagggcccctacagcatctctgtgctgtatggagatgaggaggtgcccaggagccccttcaaggtgaaggtgctgcccacccatgatgccagcaaggtgaaggccagcggccctggcctgaacaccaccggggtgcctgccagcctgcctgtggagttcaccattgatgccaaggatgctggggagggcctgctggccgtgcagatcacagatcctgagggcaagcccaagaagacccacatccaggacaaccatgatggcacctacacagtggcctacgtgcctgatgtgacaggccgctacaccatcctgatcaagtatggaggagatgagatccccttcagcccctacagagtgcgggctgtgcccactggagatgccagcaagtgcaccgtgacagtgtccattggaggccacggcctgggcgccggcatcggccccaccatccagatcggggaggagaccgtcatcaccgtggacaccaaggctgctgggaagggcaaggtgacctgcaccgtgtgcaccccagatggcagcgaggtggatgtggatgtggtggagaatgaagatggcacctttgacatcttctacacagccccccagcccgggaagtatgtgatctgtgtgcgctttggaggagagcacgtgcccaacagccccttccaggtgacagccctggccggggaccagcccagcgtgcagccccccctgcggagccagcagctggccccccagtacacctacgcccagggcggccagcagacctgggcccctgagcggcccctggtgggcgtgaatggcctggatgtgaccagcctgcggccctttgacctggtgatccccttcaccatcaagaagggggagatcactggagaggtgaggatgcccagcggcaaggtggcccagcccaccatcacagacaacaaggatggcaccgtgacagtgcgctatgcccccagcgaggccggcctgcacgagatggacatccgctatgacaacatgcacatccctggcagccccctgcagttctacgtggactatgtgaactgtggccacgtgacagcctacggccctggcctgacccatggagtggtgaacaagccagccaccttcaccgtgaacaccaaggatgctggggagggcggcctgagcctggccatcgagggccccagcaaggccgagatcagctgcacagacaaccaggacggcacctgcagcgtgtcctacctgcctgtgctgcccggggactacagcatcctggtgaagtacaatgagcagcacgtgcccggcagccccttcaccgcccgggtgactggagatgacagcatgaggatgagccacctgaaggtgggcagcgctgctgacatccccatcaacatcagcgagacagacctgagcctgctgacagccaccgtggtgcccccatctggccgggaggagccctgcctgctgaagaggctgagaaatggccacgtgggcatcagctttgtgcccaaggagaccggggagcacctggtgcacgtgaagaagaatggccagcacgtggccagcagccccatccctgtggtgatcagccagagcgagattggagatgccagccgggtgcgggtgtctggccagggcctgcacgagggccacacctttgagcctgctgagttcatcatcgacaccagagatgctggctatggaggcctgagcctgagcattgagggccccagcaaggtggacatcaacacagaggacctggaggatggcacctgccgggtgacctactgccccacagagcccggcaactacatcatcaacatcaagtttgctgaccagcacgtgcccggcagccccttctctgtgaaggtgactggagagggccgggtgaaggagagcatcaccaggagaagaagagcccccagcgtggccaacgtgggcagccactgtgacctgagcctgaagatccctgagatcagcatccaggacatgacagcccaggtgaccagccccagcggcaagacccatgaggccgagatcgtggagggggagaaccacacctactgcatccgctttgtgcctgctgagatgggcacccacacagtgtctgtgaagtacaagggccagcacgtgcccggcagccccttccagttcaccgtgggccccctgggggagggcggggcccacaaggtgcgggccggcggccctggcctggagagagctgaggccggcgtgcctgctgagttcagcatctggacccgggaggccggggccggcggcctggccatcgctgtggagggccccagcaaggccgagatcagctttgaggacaggaaggatggcagctgtggggtggcctacgtggtgcaggagcccggggactatgaggtgtctgtgaagttcaatgaggagcacatcccagacagcccctttgtggtgcctgtggccagccccagcggagatgcccggcggctgactgtgagcagcctgcaggagagcggcctgaaggtgaaccagcctgccagctttgctgtgtccctgaatggagccaagggggccattgatgccaaggtgcacagccccagcggggccctggaggagtgctacgtgacagaaattgaccaggacaagtatgctgtgcgcttcatcccccgggagaatggagtgtacctgattgatgtgaagttcaacggcacccacatccctggcagccccttcaagatccgggtgggggagcccggccatggaggagaccccggcctggtgtctgcctatggagctggcctggagggcggcgtgacaggcaacccagctgagtttgtggtgaacaccagcaatgctggggccggggccctgtctgtgaccattgatggccccagcaaggtgaagatggactgccaggagtgcccagagggctacagagtgacctacacccccatggcccctggcagctacctgatcagcatcaagtatggaggcccctaccacatcggcggcagccccttcaaggccaaggtgacaggcccccggctggtgagcaaccacagcctgcacgagaccagctctgtgtttgtggacagcctgaccaaggccacctgtgccccccagcacggggcccctggccctggccctgcagatgccagcaaggtggtggccaagggcctgggcctgagcaaggcctacgtgggccagaagagcagcttcaccgtggactgcagcaaggccggcaacaacatgctgctggtgggcgtgcacggccccaggaccccctgtgaggagatcctggtgaagcacgtgggcagccggctgtacagcgtgtcctacctgctgaaggacaagggggagtacaccctggtggtgaagtggggagatgagcacatccctggcagcccctacagagtggtggtgccctag

SEQ ID NO: 152544 - DNA, 6948 bp, Artificial Sequence
  Description of Artificial Sequence: Synthetic coding sequence
atgcctgccacagagaaggacctggccgaggatgccccctggaagaagatccagcagaacaccttcacccgctggtgcaatgagcacctgaagtgtgtgtccaagagaattgccaacctgcagacagacctgagtgatggcctgcggctgattgccctgctggaggtgctgagccagaagaagatgcacaggaagcacaaccagaggcccaccttccggcagatgcagctggagaatgtgtctgtggccctggagttcctggaccgggagagcatcaagctggtgtccattgacagcaaggccatcgtggatggcaacctgaagctgatcctgggcctcatctggaccctcatcctgcactacagcatctccatgcccatgtgggatgaggaggaggatgaggaggccaagaagcagacccccaagcagaggctgctgggctggatccagaacaagctgccccagctgcccatcaccaacttcagccgggactggcagagcggccgggccctgggcgccctggtggacagctgtgcccctggcctgtgcccagactgggacagctgggatgccagcaagcctgtgaccaatgcccgggaggccatgcagcaggctgatgactggctgggcatcccccaggtgatcaccccagaggagatcgtggaccccaacgtggatgagcacagcgtgatgacctacctgagccagttccccaaggccaagctgaagccaggggcccccctgcggcccaagctgaaccccaagaaggcccgggcctacggccctggcatcgagcccactggaaacatggtgaagaagagagctgagttcaccgtggagaccaggtctgctggccagggcgaggtgctggtgtatgtggaggaccctgctggccaccaggaggaggccaaggtgacagccaacaatgacaagaacagaaccttctctgtgtggtacgtgcctgaggtgacaggcacccacaaggtgacagtgctgtttgctggccagcacatcgccaagagcccctttgaggtgtatgtggacaagagccagggagatgccagcaaggtgacagcccagggccctggcctggagcccagcggcaacatcgccaacaagaccacctactttgagatcttcaccgctggggccggcaccggggaggtggaggtggtgatccaggaccccatgggccagaagggcaccgtggagccccagctggaggcccggggggacagcacctaccgctgcagctaccagcccaccatggagggcgtgcacacagtgcacgtgacctttgctggggtgcccatccccaggagcccctacacagtgacagtgggccaggcctgcaaccccagcgcctgcagagctgtgggccggggcctgcagcccaagggcgtgcgggtgaaggagacagctgacttcaaggtgtacaccaagggagctggcagcggggagctgaaggtgacagtgaagggccccaagggggaggagcgggtgaagcagaaggacctgggagatggagtgtatggctttgagtactaccccatggtgcccggcacctacatcgtgaccatcacctggggcggccagaacatcggccgcagcccctttgaggtgaaggtgggcacagaatgtggcaaccagaaggtgcgggcctggggccctggcctggagggcggcgtggtgggcaagtctgctgactttgtggtggaggccatcggagatgatgtgggcaccctgggcttctctgtggagggccccagccaggccaagattgaatgtgatgacaagggagatggcagctgtgatgtgcgctactggccccaggaggccggggagtatgctgtgcacgtgctgtgcaacagcgaggacatccggctgagccccttcatggctgacatcagagatgccccccaggacttccacccagacagagtgaaggcccggggccctggcctggagaagacaggagtggccgtgaacaagccagctgagttcaccgtggatgccaagcacggcggcaaggcccccctgcgggtgcaggtgcaggacaatgaaggctgccctgtggaggccctggtgaaggacaatggaaatggcacctacagctgcagctatgtgcccaggaagcctgtgaagcacacagccatggtgtcctggggcggcgtgtccatccccaacagccccttccgggtgaatgtgggcgccggcagccaccccaacaaggtgaaggtgtatggccctggggtggccaagacaggcctgaaggcccacgagcccacctacttcaccgtggactgtgccgaggccggccagggagatgtgtccatcggcatcaagtgtgcccctggggtggtgggccctgctgaggccgacatcgactttgacatcatcagaaatgacaatgacaccttcaccgtgaagtacacccccaggggggccggcagctacaccatcatggtgctgtttgctgaccaggccacccccaccagccccatccgggtgaaggtggagcccagccatgatgccagcaaggtgaaggccgagggccctggcctgagcaggactggagtggagctgggcaagcccacccacttcaccgtgaatgccaaggctgctgggaagggcaagctggatgtgcagttcagcggcctgaccaagggagatgctgtgagagatgtggacatcatcgaccaccacgacaacacctacacagtgaagtacacccctgtgcagcagggccctgtgggcgtgaatgtgacctacggcggggaccccatccccaagagccccttctctgtggccgtgagccccagcctggacctgagcaagatcaaggtgtctggcctgggggagaaggtggatgtgggcaaggaccaggagttcaccgtgaagagcaaaggagctgggggccagggcaaggtggccagcaagatcgtgggccccagcggggctgctgtgccctgcaaggtggagcccggcctgggcgctgacaacagcgtggtgcgcttcctgccccgggaggagggcccctatgaggtggaggtgacctatgatggagtgcctgtgcccggcagccccttccccctggaggccgtggcccccaccaagcccagcaaggtgaaggccttcggccctggcctgcagggcggcagcgctggcagccctgcccgcttcaccatcgacaccaagggggccggcaccggcggcctgggcctgactgtggagggcccctgtgaggcccagctggagtgcctggacaatggagatggcacctgcagcgtgtcctatgtgcccacagagcccggggactacaacatcaacatcctgtttgctgacacccacatccctggcagccccttcaaggcccacgtggtgccctgctttgatgccagcaaggtgaagtgcagcggccctggcctggagcgggccacagctggggaggtgggccagttccaggtggactgcagcagcgctggcagcgctgagctgaccatcgagatctgcagcgaggccggcctgcctgctgaggtgtacatccaggaccatggagatggcacccacaccatcacctacatccccctgtgccctggggcctacacagtgaccatcaagtatggaggccagcctgtgcccaacttccccagcaagctgcaggtggagcctgctgtggacaccagcggcgtgcagtgctacggccctggcatcgagggccagggcgtcttccgggaggccaccacagagttctctgtggatgcccgggccctgacccagacaggaggcccccacgtgaaggcccgggtggccaaccccagcggcaacctgacagagacctacgtgcaggacagaggagatggcatgtacaaggtggagtacaccccctatgaggagggcctgcacagcgtggatgtgacctatgatggcagccctgtgcccagcagccccttccaggtgcctgtgacagagggctgtgaccccagccgggtgcgggtgcacggccctggcatccagagcggcaccaccaacaagcccaacaagttcaccgtggagaccaggggggccggcaccggcggcctgggcctggccgtggagggccccagcgaggccaagatgagctgcatggacaacaaggatggcagctgcagcgtggagtacatcccctatgaggccggcacctacagcctgaatgtgacctatggaggccaccaggtgcccggcagccccttcaaggtgcctgtgcatgatgtgacagatgccagcaaggtgaagtgcagcggccctggcctgagccctggcatggtgcgggccaacctgccccagagcttccaggtggacaccagcaaggccggcgtggcccccctgcaggtgaaggtgcagggccccaagggcctggtggagcctgtggatgtggtggacaatgctgatggcacccagacagtgaactacgtgcccagccgggagggcccctacagcatctctgtgctgtatggagatgaggaggtgcccaggagccccttcaaggtgaaggtgctgcccacccatgatgccagcaaggtgaaggccagcggccctggcctgaacaccactggagtgcctgccagcctgcctgtggagttcaccattgatgccaaggatgctggggagggcctgctggccgtgcagatcacagatcctgagggcaagcccaagaagacccacatccaggacaaccatgatggcacctacacagtggcctacgtgcctgatgtgacaggccgctacaccatcctgatcaagtatggaggagatgagatccccttcagcccctacagagtgcgggctgtgcccactggagatgccagcaaatgtactgtgacagtgtccatcggcggccacggcctgggcgccggcatcggccccaccatccagattggagaggagaccgtcatcaccgtggacaccaaggccgccggcaagggcaaggtgacctgcaccgtgtgcaccccagatggcagcgaggtggatgtggatgtggtggagaatgaagatggcacctttgacatcttctacacagccccccagcccgggaagtatgtgatctgtgtgcgctttggaggagaacatgtgcccaacagccccttccaggtgacagccctggccggggaccagcccagcgtgcagccccccctgcggagccagcagctggccccccagtacacctacgcccagggcggccagcagacctgggcccctgagcggcccctggtgggcgtgaatggcctggatgtgaccagcctgcggccctttgacctggtgatccccttcaccatcaagaagggggagatcaccggggaggtgaggatgcccagcggcaaggtggcccagcccaccatcacagacaacaaggatggcaccgtgacagtgcgctatgcccccagcgaggccggcctgcacgagatggacatccgctatgacaacatgcacatccctggcagccccctgcagttctacgtggactatgtgaactgtggccacgtgacagcctacggccctggcctgacccacggcgtggtgaacaagccagccaccttcaccgtgaacaccaaggatgctggggagggcggcctgagcctggccatcgagggccccagcaaggccgagatcagctgcacagacaaccaggacggcacctgcagcgtgtcctacctgcctgtgctgcccggggactacagcatcctggtgaagtacaatgagcagcacgtgcccggcagccccttcaccgcccgggtgactggagatgacagcatgaggatgagccacctgaaggtgggcagcgctgctgacatccccatcaacatcagcgagatcagctttgaggacaggaaggatggcagctgtggggtggcctacgtggtgcaggagcccggggactatgaggtgtctgtgaagttcaatgaggagcacatcccagacagcccctttgtggtgcctgtggccagccccagcggagatgcccggcggctgactgtgagcagcctgcaggagagcggcctgaaggtgaaccagcctgccagctttgctgtgtccctgaatggagccaagggggccattgatgccaaggtgcacagccccagcggggccctggaggagtgctacgtgacagaaattgaccaggacaagtatgctgtgcgcttcatcccccgggagaatggagtgtacctgattgatgtgaagttcaacggcacccacatccctggcagccccttcaagatccgggtgggggagcccggccatggaggagaccccggcctggtgtctgcctatggagctggcctggagggcggcgtgacaggcaacccagctgagtttgtggtgaacaccagcaatgctggggccggggccctgtctgtgaccattgatggccccagcaaggtgaagatggactgccaggagtgcccagagggctacagagtgacctacacccccatggcccctggcagctacctgatcagcatcaagtatggaggcccctaccacatcggcggcagccccttcaaggccaaggtgacaggcccccggctggtgagcaaccacagcctgcacgagaccagctctgtgtttgtggacagcctgaccaaggccacctgtgccccccagcacggggcccctggccctggccctgcagatgccagcaaggtggtggccaagggcctgggcctgagcaaggcctacgtgggccagaagagcagcttcaccgtggactgcagcaaggccggcaacaacatgctgctggtgggcgtgcacggccccaggaccccctgtgaggagatcctggtgaagcacgtgggcagccggctgtacagcgtgtcctacctgctgaaggacaagggggagtacaccctggtggtgaagtggggagatgagcacatccctggcagcccctacagagtggtggtgccctag

SEQ ID NO: 152545 - DNA, 2343 bp, Artificial Sequence
  Description of Artificial Sequence: Synthetic coding sequence
atgcccagcggcaaggtggcccagcccaccatcacagacaacaaggatggcaccgtgacagtgcgctatgcccccagcgaggccggcctgcacgagatggacatccgctatgacaacatgcacatccctggcagccccctgcagttctacgtggactatgtgaactgtggccacgtgacagcctacggccctggcctgacccacggcgtggtgaacaagccagccaccttcaccgtgaacaccaaggatgctggggagggagatgacagcatgaggatgagccacctgaaggtgggcagcgctgctgacatccccatcaacatcagcgagacagacctgagcctgctgacagccaccgtggtgccccccagcggccgggaggagccctgcctgctgaagaggctgagaaatggacatgtgggcatcagctttgtgcccaaggagactggagagcacctggtgcacgtgaagaagaatggccagcacgtggccagcagccccatccctgtggtgatcagccagagcgagattggagatgccagccgggtgcgggtgtctggccagggcctgcacgagggccacacctttgagcctgctgagttcatcatcgacaccagagatgctggctacggcggcctgagcctgagcattgagggccccagcaaggtggacatcaacacagaggacctggaggatggcacctgccgggtgacctactgccccacagagcccggcaactacatcatcaacatcaagtttgctgaccagcacgtgcccggcagccccttctctgtgaaggtgactggagagggccgggtgaaggagagcatcaccaggagaagaagagcccccagcgtggccaacgtgggcagccactgtgacctgagcctgaagatccctgagatcagcatccaggacatgacagcccaggtgaccagccccagcggcaagacccatgaagctgagatcgtggagggggagaaccacacctactgcatccgctttgtgcctgctgagatgggcacccacacagtgtctgtgaagtacaagggccagcacgtgcccggcagccccttccagttcaccgtgggccccctgggggagggcggggcccacaaggtgcgggccggcggccctggcctggagcgggcagaggccggcgtgcctgctgagttcagcatctggacccgggaggccggggccggcggcctggccatcgctgtggagggccccagcaaggccgagatcagctttgaggacaggaaggatggcagctgtggggtggcctacgtggtgcaggagcccggggactatgaggtgtctgtgaagttcaatgaggagcacatcccagacagcccctttgtggtgcctgtggccagccccagcggagatgcccggcggctgactgtgagcagcctgcaggagagcggcctgaaggtgaaccagcctgccagctttgctgtgtccctgaatggagccaagggggccattgatgccaaggtgcacagccccagcggggccctggaggagtgctacgtgacagaaattgaccaggacaagtatgctgtgcgcttcatccccagagaaaatggagtgtacctgattgatgtgaagttcaacggcacccacatccctggcagccccttcaagatccgggtgggggagcccggccacggcggggaccccggcctggtgtctgcctacggggccggcctggagggcggcgtgactggaaatcctgctgagtttgtggtgaacaccagcaatgctggggccggggccctgtctgtgaccattgatggccccagcaaggtgaagatggactgccaggagtgcccagagggctacagagtgacctacacccccatggcccctggcagctacctgatcagcatcaagtatggaggcccctaccacatcggcggcagccccttcaaggccaaggtgacaggcccccggctggtgagcaaccacagcctgcacgagaccagctctgtgtttgtggacagcctgaccaaggccacctgtgccccccagcacggggcccctggccctggccctgcagatgccagcaaggtggtggccaagggcctgggcctgagcaaggcctacgtgggccagaagagcagcttcaccgtggactgcagcaaggccggcaacaacatgctgctggtgggcgtgcacggccccaggaccccctgtgaggagatcctggtgaagcacgtgggcagccggctgtacagcgtgtcctacctgctgaaggacaagggggagtacaccctggtggtgaagtggggagatgagcacatccctggcagcccctacagagtggtggtgccctag

SEQ ID NO: 152546 - DNA, 7920 bp, Artificial Sequence
  Description of Artificial Sequence: Synthetic coding sequence
atgagcagcagccacagccgggccggccagagcgctgctggagctgcccctgggggcggcgtggacaccagagatgctgagatgcctgccacagagaaggacctggctgaagatgccccctggaagaagatccagcagaacaccttcacccgctggtgcaatgagcacctgaagtgtgtgtccaagagaattgccaacctgcagacagacctgagtgatggcctgcggctcatcgccctgctggaggtgctgagccagaagaagatgcacaggaagcacaaccagaggcccaccttccggcagatgcagctggagaatgtgtctgtggccctggagttcctggaccgggagagcatcaagctggtgtccattgacagcaaggccatcgtggatggcaacctgaagctgatcctgggcctcatctggaccctcatcctgcactacagcatctccatgcccatgtgggatgaggaggaggatgaggaggccaagaagcagacccccaagcagaggctgctgggctggatccagaacaagctgccccagctgcccatcaccaacttcagccgggactggcagagcggccgggccctgggcgccctggtggacagctgtgcccctggcctgtgcccagactgggacagctgggatgccagcaagcctgtgaccaatgcccgggaggccatgcagcaggctgatgactggctgggcatcccccaggtgatcaccccagaggagatcgtggaccccaacgtggatgagcacagcgtgatgacctacctgagccagttccccaaggccaagctgaagccaggggcccccctgcggcccaagctgaaccccaagaaggcccgggcctacggccctggcatcgagcccaccggcaacatggtgaagaagagagctgagttcaccgtggagaccaggtctgctggccagggcgaggtgctggtgtatgtggaggaccctgctggccaccaggaggaggccaaggtgacagccaacaatgacaagaacagaaccttctctgtgtggtacgtgcctgaggtgacaggcacccacaaggtgacagtgctgtttgctggccagcacatcgccaagagcccctttgaggtgtatgtggacaagagccagggagatgccagcaaggtgacagcccagggccctggcctggagcccagcggcaacatcgccaacaagaccacctactttgagatcttcaccgctggagctggcactggagaggtggaggtggtgatccaggaccccatgggccagaagggcaccgtggagccccagctggaggcccggggggacagcacctaccgctgcagctaccagcccaccatggagggcgtgcacacagtgcacgtgacctttgctggggtgcccatccccaggagcccctacacagtgacagtgggccaggcctgcaaccccagcgcctgcagagctgtgggccggggcctgcagcccaagggcgtgcgggtgaaggagacagctgacttcaaggtgtacaccaagggggccggcagcggggagctgaaggtgacagtgaagggccccaagggggaggagcgggtgaagcagaaggacctgggagatggagtgtatggctttgagtactaccccatggtgcccggcacctacatcgtgaccatcacctggggcggccagaacatcggccgcagcccctttgaggtgaaggtgggcacagaatgtggcaaccagaaggtgcgggcctggggccctggcctggagggcggcgtggtgggcaagtctgctgactttgtggtggaggccatcggagatgatgtgggcaccctgggcttctctgtggagggccccagccaggccaagattgaatgtgatgacaagggagatggcagctgtgatgtgcgctactggccccaggaggccggggagtatgctgtgcacgtgctgtgcaacagcgaggacatccggctgagccccttcatggctgacatcagagatgccccccaggacttccacccagacagagtgaaggcccggggccctggcctggagaagacaggagtggccgtgaacaagccagctgagttcaccgtggatgccaagcatggaggcaaggcccccctgcgggtgcaggtgcaggacaatgaaggctgccctgtggaggccctggtgaaggacaatggaaatggcacctacagctgcagctatgtgcccaggaagcctgtgaagcacacagccatggtgtcctggggcggcgtgtccatccccaacagccccttccgggtgaatgtgggcgccggcagccaccccaacaaggtgaaggtgtatggccctggggtggccaagacaggcctgaaggcccacgagcccacctacttcaccgtggactgtgccgaggccggccagggagatgtgtccatcggcatcaagtgtgcccctggggtggtgggccctgctgaggccgacatcgactttgacatcatcagaaatgacaatgacaccttcaccgtgaagtacaccccaagaggagctggcagctacaccatcatggtgctgtttgctgaccaggccacccccaccagccccatccgggtgaaggtggagcccagccatgatgccagcaaggtgaaggccgagggccctggcctgagcaggactggagtggagctgggcaagcccacccacttcaccgtgaatgccaaggccgccggcaagggcaagctggatgtgcagttcagcggcctgaccaagggagatgctgtgagagatgtggacatcatcgaccaccacgacaacacctacacagtgaagtacacccctgtgcagcagggccctgtgggcgtgaatgtgacctatggaggagaccccatccccaagagccccttctctgtggccgtgagccccagcctggacctgagcaagatcaaggtgtctggcctgggggagaaggtggatgtgggcaaggaccaggagttcaccgtgaagagcaagggggccggcggccagggcaaggtggccagcaagatcgtgggccccagcggggctgctgtgccctgcaaggtggagcccggcctgggcgctgacaacagcgtggtgcgcttcctgccccgggaggagggcccctatgaggtggaggtgacctatgatggagtgcctgtgcccggcagccccttccccctggaggccgtggcccccaccaagcccagcaaggtgaaggcctttggacctggcctgcagggcggcagcgctggcagccctgcccgcttcaccatcgacaccaagggagctggcactggaggcctgggcctgactgtggagggcccctgtgaggcccagctggagtgcctggacaatggagatggcacctgcagcgtgtcctatgtgcccacagagcccggggactacaacatcaacatcctgtttgctgacacccacatccctggcagccccttcaaggcccacgtggtgccctgctttgatgccagcaaggtgaagtgcagcggccctggcctggagcgggccacagctggggaggtgggccagttccaggtggactgcagcagcgctggcagcgctgagctgaccatcgagatctgcagcgaggccggcctgcctgctgaggtgtacatccaggaccatggagatggcacccacaccatcacctacatccccctgtgccctggggcctacacagtgaccatcaagtatggaggccagcctgtgcccaacttccccagcaagctgcaggtggagcctgctgtggacaccagcggcgtgcagtgctacggccctggcatcgagggccagggcgtcttccgggaggccaccacagagttctctgtggatgcccgggccctgacccagacaggaggcccccacgtgaaggcccgggtggccaaccccagcggcaacctgacagagacctacgtgcaggacagaggagatggcatgtacaaggtggagtacaccccctatgaggagggcctgcacagcgtggatgtgacctatgatggcagccctgtgcccagcagccccttccaggtgcctgtgacagagggctgtgaccccagccgggtgcgggtgcacggccctggcatccagagcggcaccaccaacaagcccaacaagttcaccgtggagaccagaggagctggcactggaggcctgggcctggccgtggagggccccagcgaggccaagatgagctgcatggacaacaaggatggcagctgcagcgtggagtacatcccctatgaagctggcacctacagcctgaatgtgacctacggcggccaccaggtgcccggcagccccttcaaggtgcctgtgcatgatgtgacagatgccagcaaggtgaagtgcagcggccctggcctgagccctggcatggtgcgggccaacctgccccagagcttccaggtggacaccagcaaggccggcgtggcccccctgcaggtgaaggtgcagggccccaagggcctggtggagcctgtggatgtggtggacaatgctgatggcacccagacagtgaactacgtgcccagccgggagggcccctacagcatctctgtgctgtatggagatgaggaggtgcccaggagccccttcaaggtgaaggtgctgcccacccatgatgccagcaaggtgaaggccagcggccctggcctgaacaccaccggggtgcctgccagcctgcctgtggagttcaccattgatgccaaggatgctggggagggcctgctggccgtgcagatcacagatcctgagggcaagcccaagaagacccacatccaggacaaccatgatggcacctacacagtggcctacgtgcctgatgtgacaggccgctacaccatcctgatcaagtatggaggagatgagatccccttcagcccctacagagtgcgggctgtgcccactggagatgccagcaagtgcaccgtgactggagctggcatcggccccaccatccagatcggggaggagaccgtcatcaccgtggacaccaaggctgctgggaagggcaaggtgacctgcaccgtgtgcaccccagatggcagcgaggtggatgtggatgtggtggagaatgaagatggcacctttgacatcttctacacagccccccagcccgggaagtatgtgatctgtgtgcgctttggaggagagcacgtgcccaacagccccttccaggtgacagccctggccggggaccagcccagcgtgcagccccccctgcggagccagcagctggccccccagtacacctacgcccagggcggccagcagacctgggcccctgagcggcccctggtgggcgtgaatggcctggatgtgaccagcctgcggccctttgacctggtgatccccttcaccatcaagaagggggagatcactggagaggtgaggatgcccagcggcaaggtggcccagcccaccatcacagacaacaaggatggcaccgtgacagtgcgctatgcccccagcgaggccggcctgcacgagatggacatccgctatgacaacatgcacatccctggcagccccctgcagttctacgtggactatgtgaactgtggccacgtgacagcctacggccctggcctgacccatggagtggtgaacaagccagccaccttcaccgtgaacaccaaggatgctggggagggcggcctgagcctggccatcgagggccccagcaaggccgagatcagctgcacagacaaccaggacggcacctgcagcgtgtcctacctgcctgtgctgcccggggactacagcatcctggtgaagtacaatgagcagcacgtgcccggcagccccttcaccgcccgggtgactggagatgacagcatgaggatgagccacctgaaggtgggcagcgctgctgacatccccatcaacatcagcgagacagacctgagcctgctgacagccaccgtggtgcccccatctggccgggaggagccctgcctgctgaagaggctgagaaatggccacgtgggcatcagctttgtgcccaaggagaccggggagcacctggtgcacgtgaagaagaatggccagcacgtggccagcagccccatccctgtggtgatcagccagagcgagattggagatgccagccgggtgcgggtgtctggccagggcctgcacgagggccacacctttgagcctgctgagttcatcatcgacaccagagatgctggctatggaggcctgagcctgagcattgagggccccagcaaggtggacatcaacacagaggacctggaggatggcacctgccgggtgacctactgccccacagagcccggcaactacatcatcaacatcaagtttgctgaccagcacgtgcccggcagccccttctctgtgaaggtgactggagagggccgggtgaaggagagcatcaccaggagaagaagagcccccagcgtggccaacgtgggcagccactgtgacctgagcctgaagatccctgagatcagcatccaggacatgacagcccaggtgaccagccccagcggcaagacccatgaggccgagatcgtggagggggagaaccacacctactgcatccgctttgtgcctgctgagatgggcacccacacagtgtctgtgaagtacaagggccagcacgtgcccggcagccccttccagttcaccgtgggccccctgggggagggcggggcccacaaggtgcgggccggcggccctggcctggagagagctgaggccggcgtgcctgctgagttcagcatctggacccgggaggccggggccggcggcctggccatcgctgtggagggccccagcaaggccgagatcagctttgaggacaggaaggatggcagctgtggggtggcctacgtggtgcaggagcccggggactatgaggtgtctgtgaagttcaatgaggagcacatcccagacagcccctttgtggtgcctgtggccagccccagcggagatgcccggcggctgactgtgagcagcctgcaggagagcggcctgaaggtgaaccagcctgccagctttgctgtgtccctgaatggagccaagggggccattgatgccaaggtgcacagccccagcggggccctggaggagtgctacgtgacagaaattgaccaggacaagtatgctgtgcgcttcatcccccgggagaatggagtgtacctgattgatgtgaagttcaacggcacccacatccctggcagccccttcaagatccgggtgggggagcccggccatggaggagaccccggcctggtgtctgcctatggagctggcctggagggcggcgtgacaggcaacccagctgagtttgtggtgaacaccagcaatgctggggccggggccctgtctgtgaccattgatggccccagcaaggtgaagatggactgccaggagtgcccagagggctacagagtgacctacacccccatggcccctggcagctacctgatcagcatcaagtatggaggcccctaccacatcggcggcagccccttcaaggccaaggtgacaggcccccggctggtgagcaaccacagcctgcacgagaccagctctgtgtttgtggacagcctgaccaaggccacctgtgccccccagcacggggcccctggccctggccctgcagatgccagcaaggtggtggccaagggcctgggcctgagcaaggcctacgtgggccagaagagcagcttcaccgtggactgcagcaaggccggcaacaacatgctgctggtgggcgtgcacggccccaggaccccctgtgaggagatcctggtgaagcacgtgggcagccggctgtacagcgtgtcctacctgctgaaggacaagggggagtacaccctggtggtgaagtggggagatgagcacatccctggcagcccctacagagtggtggtgccctag

SEQ ID NO: 152547 - DNA, 7809 bp, Artificial Sequence
  Description of Artificial Sequence: Synthetic coding sequence
atgcctgtgacagagaaggacctggccgaggatgccccctggaagaagatccagcagaacaccttcacccgctggtgcaatgagcacctgaagtgtgtgaacaagagaattggcaacctgcagacagacctgagtgatggcctgcggctgattgccctgctggaggtgctgagccagaagaggatgtacaggaagtaccaccagaggcccaccttccggcagatgcagctggagaatgtgtctgtggccctggagttcctggaccgggagagcatcaagctggtgtccattgacagcaaggccatcgtggatggcaacctgaagctgatcctgggcctggtgtggaccctcatcctgcactacagcatctccatgcctgtgtgggaggatgaaggagatgatgatgccaagaagcagacccccaagcagaggctgctgggctggatccagaacaagatcccctacctgcccatcaccaacttcaaccagaactggcaggacggcaaggccctgggcgccctggtggacagctgtgcccctggcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccactggaaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggggccggcgtgggggacattggagtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggccgccggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcacggcggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcctggagaatatgctgtgcacatcatgtgtgatgatgaggacatcaaggacagcccctacatggccttcatccacccagccaccggcggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaggccggggagggagatgtgtctgtgggcatcaagtgtgatgcccgggtgctgtctgaagatgaagaagatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggagctgggaaggcccccctgaatgtgcagttcaacagccccctgcctggagatgctgtgaaggacctggacatcatcgacaactatgactacagccacacagtgaagtacacccccacccagcagggcaacatgcaggtgctggtgacctacggcggggaccccatccccaagagccccttcaccgtgggcgtggccgcccccctggacctgagcaagatcaagctgaatggcctggagaacagagtggaggtgggcaaggaccaggagttcaccgtggacaccagaggagctgggggccagggcaagctggatgtgaccatcctgagccccagcaggaaggtggtgccctgcctggtgacccctgtgacaggccgggagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggggccggcaccggcggcctgggcctgactgtggagggcccctgtgaggccaagattgagtgcagcgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgacagcggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagaatgttttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccaggggggccggcatcggcggcctgggcatcaccgtggagggccccagcgagagcaagatcaactgccgggacaacaaggatggcagctgcagcgctgagtacatcccctttgcccctggggactatgatgtgaacatcacctatggaggagcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggcccccggggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccaccggccctggcatcgccagcacagtgaagacaggagaggaggtgggctttgtggtggatgccaagacagctgggaagggcaaggtgacctgcaccgtgctgaccccagatggaacagaggccgaggctgatgtgattgaaaatgaagatggcacctatgacatcttctacacagctgccaagccaggcacctacgtgatctacgtgcgctttggaggagtggacatccccaacagccccttcaccgtgatggccacagatggagaggtgacagctgtggaggaggcccctgtgaatgcctgccccccaggcttccggccctgggtgacagaggaggcctacgtgcctgtgtctgacatgaatggcctgggcttcaagccctttgacctggtgatcccctttgctgtgaggaaaggagagatcactggagaggtgcacatgcccagcggcaagacagccaccccagagatcgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaaccacgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctacggcggcatcagcctggccgtggagggccccagcaaggtggacatccagacagaggacctggaggatggcacctgcaaggtgtcctacttccccaccgtgcctggggtgtacatcgtgtccaccaagtttgctgatgaacatgtgcccggcagccccttcaccgtgaagatcagcggggagggccgggtgaaggagagcatcaccaggaccagccgggcccccagcgtggccaccgtgggcagcatctgtgacctgaacctgaagatccctgagatcaacagcagtgacatgtctgcccacgtgaccagccccagcggccgggtgacagaagctgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgcctgctgagttcagcatctggacccgggaggccggggccggcggcctgagcattgctgtggagggccccagcaaggccgagatcacctttgatgaccacaagaatggcagctgtggggtgtcctacatcgcccaggagcccggcaactatgaggtgtccatcaagttcaatgatgagcacatccctgagagcccctacctggtgcctgtgattgcccccagtgatgatgcccggcggctgactgtgatgagcctgcaggagagcggcctgaaggtgaaccagcctgccagctttgccatccggctgaatggagccaagggcaagattgatgccaaggtgcacagccccagcggggctgtggaggagtgccacgtgtctgagctggagccagacaagtatgctgtgcgcttcatcccccatgaaaatggagtgcacaccattgatgtgaagttcaacggcagccacgtggtgggcagccccttcaaggtgcgggtgggggagcccggccaggccggcaacccagccctggtgtctgcctacggcaccggcctggagggcggcaccaccggcatccagagcgagttcttcatcaacaccacccgggccggccctggcaccctgtctgtgaccatcgagggccccagcaaggtgaagatggactgccaggagaccccagagggctacaaggtgatgtacacccccatggcccctggcaactacctgatctctgtgaagtatggaggccccaaccacatcgtgggcagccccttcaaggccaaggtgacaggccagaggctggtgtccccaggcagcgccaatgagaccagcagcatcctggtggagagcgtgaccaggagcagcacagagacctgctacagcgccatccccaaggccagcagtgatgccagcaaggtgaccagcaagggggccggcctgagcaaggcctttgtgggccagaagagcagcttcctggtggactgcagcaaggccggcagcaacatgctgctgattggagtgcacggccccaccaccccctgtgaggaggtgtccatgaagcacgtgggcaaccagcagtacaacgtgacctacgtggtgaaggagcggggggactatgtgctggccgtgaagtggggcgaggagcacatccctggcagccccttccacgtgacagtgccctag

SEQ ID NO: 152548 - DNA, 7686 bp, Artificial Sequence
  Description of Artificial Sequence: Synthetic coding sequence
atgcctgtgacagagaaggacctggccgaggatgccccctggaagaagatccagcagaacaccttcacccgctggtgcaatgagcacctgaagtgtgtgaacaagagaattggcaacctgcagacagacctgagtgatggcctgcggctgattgccctgctggaggtgctgagccagaagaggatgtacaggaagtaccaccagaggcccaccttccggcagatgcagctggagaatgtgtctgtggccctggagttcctggaccgggagagcatcaagctggtgtccattgacagcaaggccatcgtggatggcaacctgaagctgatcctgggcctggtgtggaccctcatcctgcactacagcatctccatgcctgtgtgggaggatgaaggagatgatgatgccaagaagcagacccccaagcagaggctgctgggctggatccagaacaagatcccctacctgcccatcaccaacttcaaccagaactggcaggacggcaaggccctgggcgccctggtggacagctgtgcccctggcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccactggaaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggggccggcgtgggggacattggagtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggccgccggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcacggcggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcctggagaatatgctgtgcacatcatgtgtgatgatgaggacatcaaggacagcccctacatggccttcatccacccagccaccggcggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaggccggggagggagatgtgtctgtgggcatcaagtgtgatgcccgggtgctgtctgaagatgaagaagatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggagctgggaaggcccccctgaatgtgcagttcaacagccccctgcctggagatgctgtgaaggacctggacatcatcgacaactatgactacagccacacagtgaagtacacccccacccagcagggcaacatgcaggtgctggtgacctacggcggggaccccatccccaagagccccttcaccgtgggcgtggccgcccccctggacctgagcaagatcaagctgaatggcctggagaacagagtggaggtgggcaaggaccaggagttcaccgtggacaccagaggagctgggggccagggcaagctggatgtgaccatcctgagccccagcaggaaggtggtgccctgcctggtgacccctgtgacaggccgggagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggggccggcaccggcggcctgggcctgactgtggagggcccctgtgaggccaagattgagtgcagcgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgacagcggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagaatgttttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccaggggggccggcatcggcggcctgggcatcaccgtggagggccccagcgagagcaagatcaactgccgggacaacaaggatggcagctgcagcgctgagtacatcccctttgcccctggggactatgatgtgaacatcacctatggaggagcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggcccccggggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccaccggccctggcatcgccagcacagtgaagacaggagaggaggtgggctttgtggtggatgccaagacagctgggaagggcaaggtgacctgcaccgtgctgaccccagatggaacagaggccgaggctgatgtgattgaaaatgaagatggcacctatgacatcttctacacagctgccaagccaggcacctacgtgatctacgtgcgctttggaggagtggacatccccaacagccccttcaccgtgatggccacagatggagaggtgacagctgtggaggaggcccctgtgaatgcctgccccccaggcttccggccctgggtgacagaggaggcctacgtgcctgtgtctgacatgaatggcctgggcttcaagccctttgacctggtgatcccctttgctgtgaggaaaggagagatcactggagaggtgcacatgcccagcggcaagacagccaccccagagatcgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaaccacgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctacggcggcatcagcctggccgtggagggccccagcaaggtggacatccagacagaggacctggaggatggcacctgcaaggtgtcctacttccccaccgtgcctggggtgtacatcgtgtccaccaagtttgctgatgaacatgtgcctgagatcaacagcagtgacatgtctgcccacgtgaccagccccagcggccgggtgacagaggccgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgcctgctgagttcagcatctggacccgggaggccggggccggcggcctgagcattgctgtggagggccccagcaaggccgagatcacctttgatgaccacaagaatggcagctgtggggtgtcctacatcgcccaggagcccggcaactatgaggtgtccatcaagttcaatgatgagcacatccctgagagcccctacctggtgcctgtgattgcccccagtgatgatgcccggcggctgactgtgatgagcctgcaggagagcggcctgaaggtgaaccagcctgccagctttgccatccggctgaatggagccaagggcaagattgatgccaaggtgcacagccccagcggggctgtggaggagtgccacgtgtctgagctggagccagacaagtatgctgtgcgcttcatcccccatgaaaatggagtgcacaccattgatgtgaagttcaacggcagccacgtggtgggcagccccttcaaggtgcgggtgggggagcccggccaggccggcaacccagccctggtgtctgcctatggaacaggcctggagggcggcaccaccggcatccagagcgagttcttcatcaacaccaccagggctggccctggcaccctgtctgtgaccatcgagggccccagcaaggtgaagatggactgccaggagaccccagagggctacaaggtgatgtacacccccatggcccctggcaactacctgatctctgtgaagtatggaggccccaaccacatcgtgggcagccccttcaaggccaaggtgacaggccagaggctggtgtccccaggcagcgccaatgagaccagcagcatcctggtggagagcgtgaccaggagcagcacagagacctgctacagcgccatccccaaggccagcagtgatgccagcaaggtgaccagcaaaggagctggcctgagcaaggcctttgtgggccagaagagcagcttcctggtggactgcagcaaggccggcagcaacatgctgctgattggagtgcacggccccaccaccccctgtgaggaggtgtccatgaagcacgtgggcaaccagcagtacaacgtgacctacgtggtgaaggagcggggggactatgtgctggccgtgaagtggggcgaggagcacatccctggcagccccttccacgtgacagtgccctag

SEQ ID NO: 152549 - DNA, 6453 bp, Artificial Sequence
  Description of Artificial Sequence: Synthetic coding sequence
atgcctgtgacagagaaggacctggccgaggatgccccctggaagaagatccagcagaacaccttcacccgctggtgcaatgagcacctgaagtgtgtgaacaagagaattggcaacctgcagacagacctgagtgatggcctgcggctgattgccctgctggaggtgctgagccagaagaggatgtacaggaagtaccaccagaggcccaccttccggcagatgcagctggagaatgtgtctgtggccctggagttcctggaccgggagagcatcaagctggtgtccattgacagcaaggccatcgtggatggcaacctgaagctgatcctgggcctggtgtggaccctcatcctgcactacagcatctccatgcctgtgtgggaggatgaaggagatgatgatgccaagaagcagacccccaagcagaggctgctgggctggatccagaacaagatcccctacctgcccatcaccaacttcaaccagaactggcaggacggcaaggccctgggcgccctggtggacagctgtgcccctggcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccactggaaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggggccggcgtgggggacattggagtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggccgccggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcacggcggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcctggagaatatgctgtgcacatcatgtgtgatgatgaggacatcaaggacagcccctacatggccttcatccacccagccaccggcggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaggccggggagggagatgtgtctgtgggcatcaagtgtgatgcccgggtgctgtctgaagatgaagaagatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggagctgggaaggcccccctgaatgtgcagttcaacagccccctgcctggagatgctgtgaaggacctggacatcatcgacaactatgactacagccacacagtgaagtacacccccacccagcagggcaacatgcaggtgctggtgacctacggcggggaccccatccccaagagccccttcaccgtgggcgtggccgcccccctggacctgagcaagatcaagctgaatggcctggagaacagagtggaggtgggcaaggaccaggagttcaccgtggacaccagaggagctgggggccagggcaagctggatgtgaccatcctgagccccagcaggaaggtggtgccctgcctggtgacccctgtgacaggccgggagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggggccggcaccggcggcctgggcctgactgtggagggcccctgtgaggccaagattgagtgcagcgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgacagcggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagaatgttttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccaggggggccggcatcggcggcctgggcatcaccgtggagggccccagcgagagcaagatcaactgccgggacaacaaggatggcagctgcagcgctgagtacatcccctttgcccctggggactatgatgtgaacatcacctatggaggagcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggcccccggggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccaccggccctggcatcgccagcacagtgaagacaggagaggaggtgggctttgtggtggatgccaagacagctgggaagggcaaggtgacctgcaccgtgctgaccccagatggaacagaggccgaggctgatgtgattgaaaatgaagatggcacctatgacatcttctacacagctgccaagccaggcacctacgtgatctacgtgcgctttggaggagtggacatccccaacagccccttcaccgtgatggccacagatggagaggtgacagctgtggaggaggcccctgtgaatgcctgccccccaggcttccggccctgggtgacagaggaggcctacgtgcctgtgtctgacatgaatggcctgggcttcaagccctttgacctggtgatcccctttgctgtgaggaaaggagagatcactggagaggtgcacatgcccagcggcaagacagccaccccagagatcgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaaccacgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctacggcggcatcagcctggccgtggagggccccagcaaggtggacatccagacagaggacctggaggatggcacctgcaaggtgtcctacttccccaccgtgcctggggtgtacatcgtgtccaccaagtttgctgatgaacatgtgcccggcagccccttcaccgtgaagatcagcggggagggccgggtgaaggagagcatcaccaggaccagccgggcccccagcgtggccaccgtgggcagcatctgtgacctgaacctgaagatccctggggtgcgggtgatgaactgcagcgcccagatcctgtggggctggagggtgcagttccacacaggcagcaggaaccagcagcagtag

SEQ ID NO: 152550 - DNA, 7737 bp, Artificial Sequence
  Description of Artificial Sequence: Synthetic coding sequence
atgcctgtgacagagaaggacctggccgaggatgccccctggaagaagatccagcagaacaccttcacccgctggtgcaatgagcacctgaagtgtgtgaacaagagaattggcaacctgcagacagacctgagtgatggcctgcggctgattgccctgctggaggtgctgagccagaagaggatgtacaggaagtaccaccagaggcccaccttccggcagatgcagctggagaatgtgtctgtggccctggagttcctggaccgggagagcatcaagctggtgtccattgacagcaaggccatcgtggatggcaacctgaagctgatcctgggcctggtgtggaccctcatcctgcactacagcatctccatgcctgtgtgggaggatgaaggagatgatgatgccaagaagcagacccccaagcagaggctgctgggctggatccagaacaagatcccctacctgcccatcaccaacttcaaccagaactggcaggacggcaaggccctgggcgccctggtggacagctgtgcccctggcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccactggaaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggggccggcgtgggggacattggagtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggccgccggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcacggcggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcctggagaatatgctgtgcacatcatgtgtgatgatgaggacatcaaggacagcccctacatggccttcatccacccagccaccggcggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaggccggggagggagatgtgtctgtgggcatcaagtgtgatgcccgggtgctgtctgaagatgaagaagatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggagctgggaaggcccccctgaatgtgcagttcaacagccccctgcctggagatgctgtgaaggacctggacatcatcgacaactatgactacagccacacagtgaagtacacccccacccagcagggcaacatgcaggtgctggtgacctacggcggggaccccatccccaagagccccttcaccgtgggcgtggccgcccccctggacctgagcaagatcaagctgaatggcctggagaacagagtggaggtgggcaaggaccaggagttcaccgtggacaccagaggagctgggggccagggcaagctggatgtgaccatcctgagccccagcaggaaggtggtgccctgcctggtgacccctgtgacaggccgggagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggggccggcaccggcggcctgggcctgactgtggagggcccctgtgaggccaagattgagtgcagcgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgacagcggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagaatgttttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccaggggggccggcatcggcggcctgggcatcaccgtggagggccccagcgagagcaagatcaactgccgggacaacaaggatggcagctgcagcgctgagtacatcccctttgcccctggggactatgatgtgaacatcacctatggaggagcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggcccccggggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccaccggccctggcatcgccagcacagtgaagacaggagaggaggtgggctttgtggtggatgccaagacagctgggaagggcaaggtgacctgcaccgtgctgaccccagatggaacagaggccgaggctgatgtgattgaaaatgaagatggcacctatgacatcttctacacagctgccaagccaggcacctacgtgatctacgtgcgctttggaggagtggacatccccaacagccccttcaccgtgatggtgacagaggaggcctacgtgcctgtgtctgacatgaatggcctgggcttcaagccctttgacctggtgatcccctttgctgtgaggaaaggagagatcactggagaggtgcacatgcccagcggcaagacagccaccccagagatcgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaaccacgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctacggcggcatcagcctggccgtggagggccccagcaaggtggacatccagacagaggacctggaggatggcacctgcaaggtgtcctacttccccaccgtgcctggggtgtacatcgtgtccaccaagtttgctgatgaacatgtgcccggcagccccttcaccgtgaagatcagcggggagggccgggtgaaggagagcatcaccaggaccagccgggcccccagcgtggccaccgtgggcagcatctgtgacctgaacctgaagatccctgagatcaacagcagtgacatgtctgcccacgtgaccagccccagcggccgggtgacagaagctgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgcctgctgagttcagcatctggacccgggaggccggggccggcggcctgagcattgctgtggagggccccagcaaggccgagatcacctttgatgaccacaagaatggcagctgtggggtgtcctacatcgcccaggagcccggcaactatgaggtgtccatcaagttcaatgatgagcacatccctgagagcccctacctggtgcctgtgattgcccccagtgatgatgcccggcggctgactgtgatgagcctgcaggagagcggcctgaaggtgaaccagcctgccagctttgccatccggctgaatggagccaagggcaagattgatgccaaggtgcacagccccagcggggctgtggaggagtgccacgtgtctgagctggagccagacaagtatgctgtgcgcttcatcccccatgaaaatggagtgcacaccattgatgtgaagttcaacggcagccacgtggtgggcagccccttcaaggtgcgggtgggggagcccggccaggccggcaacccagccctggtgtctgcctacggcaccggcctggagggcggcaccaccggcatccagagcgagttcttcatcaacaccacccgggccggccctggcaccctgtctgtgaccatcgagggccccagcaaggtgaagatggactgccaggagaccccagagggctacaaggtgatgtacacccccatggcccctggcaactacctgatctctgtgaagtatggaggccccaaccacatcgtgggcagccccttcaaggccaaggtgacaggccagaggctggtgtccccaggcagcgccaatgagaccagcagcatcctggtggagagcgtgaccaggagcagcacagagacctgctacagcgccatccccaaggccagcagtgatgccagcaaggtgaccagcaagggggccggcctgagcaaggcctttgtgggccagaagagcagcttcctggtggactgcagcaaggccggcagcaacatgctgctgattggagtgcacggccccaccaccccctgtgaggaggtgtccatgaagcacgtgggcaaccagcagtacaacgtgacctacgtggtgaaggagcggggggactatgtgctggccgtgaagtggggcgaggagcacatccctggcagccccttccacgtgacagtgccctag

SEQ ID NO: 152551 - DNA, 7269 bp, Artificial Sequence
  Description of Artificial Sequence: Synthetic coding sequence
atgcaggagcacagcacccggcggcgcagcctgagcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccaccggcaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggagctggggtgggggacatcggcgtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggctgctggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcatggaggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcccggggagtatgctgtgcacatcatgtgtgatgatgaggacatcaaggacagcccctacatggccttcatccacccagccactggaggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaagctggggagggagatgtgtctgtgggcatcaagtgtgatgcccgggtgctgtctgaagatgaggaggatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggggccggcaaggcccccctgaatgtgcagttcaacagccccctgcctggagatgctgtgaaggacctggacatcatcgacaactatgactacagccacacagtgaagtacacccccacccagcagggcaacatgcaggtgctggtgacctatggaggagaccccatccccaagagccccttcaccgtgggcgtggccgcccccctggacctgagcaagatcaagctgaatggcctggagaacagagtggaggtgggcaaggaccaggagttcaccgtggacaccaggggggccggcggccagggcaagctggatgtgaccatcctgagccccagcaggaaggtggtgccctgcctggtgacccctgtgactggaagagagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggagctggcactggaggcctgggcctgactgtggagggcccctgtgaggccaagattgaatgtagtgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgattctggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagagtgctttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccagaggagctggcattggaggcctgggcatcaccgtggagggccccagcgagagcaagatcaactgccgggacaacaaggatggcagctgcagcgctgagtacatcccctttgcccctggggactatgatgtgaacatcacctacggcggggcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggcccccggggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccactggacctggcatcgccagcacagtgaagacaggagaggaggtgggctttgtggtggatgccaagacagctgggaagggcaaggtgacctgcaccgtgctgaccccagatggaacagaagctgaggctgatgtgattgaaaatgaagatggcacctatgacatcttctacacagctgccaagccaggcacctacgtgatctacgtgcgctttggaggagtggacatccccaacagccccttcaccgtgatggccacagatggagaggtgacagctgtggaggaggcccctgtgacagaggaggcctacgtgcctgtgtctgacatgaatggcctgggcttcaagccctttgacctggtgatcccctttgctgtgaggaaaggagagatcactggagaggtgcacatgcccagcggcaagacagccaccccagagatcgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaaccacgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctacggcggcatcagcctggccgtggagggccccagcaaggtggacatccagacagaggacctggaggatggcacctgcaaggtgtcctacttccccaccgtgcctggggtgtacatcgtgtccaccaagtttgctgatgaacatgtgcccggcagccccttcaccgtgaagatcagcggggagggccgggtgaaggagagcatcaccaggaccagccgggcccccagcgtggccaccgtgggcagcatctgtgacctgaacctgaagatccctgagatcaacagcagtgacatgtctgcccacgtgaccagccccagcggccgggtgacagaagctgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgcctgctgagttcagcatctggacccgggaggccggggccggcggcctgagcattgctgtggagggccccagcaaggccgagatcacctttgatgaccacaagaatggcagctgtggggtgtcctacatcgcccaggagcccggcaactatgaggtgtccatcaagttcaatgatgagcacatccctgagagcccctacctggtgcctgtgattgcccccagtgatgatgcccggcggctgactgtgatgagcctgcaggagagcggcctgaaggtgaaccagcctgccagctttgccatccggctgaatggagccaagggcaagattgatgccaaggtgcacagccccagcggggctgtggaggagtgccacgtgtctgagctggagccagacaagtatgctgtgcgcttcatcccccatgaaaatggagtgcacaccattgatgtgaagttcaacggcagccacgtggtgggcagccccttcaaggtgcgggtgggggagcccggccaggccggcaacccagccctggtgtctgcctacggcaccggcctggagggcggcaccaccggcatccagagcgagttcttcatcaacaccacccgggccggccctggcaccctgtctgtgaccatcgagggccccagcaaggtgaagatggactgccaggagaccccagagggctacaaggtgatgtacacccccatggcccctggcaactacctgatctctgtgaagtatggaggccccaaccacatcgtgggcagccccttcaaggccaaggtgacaggccagaggctggtgtccccaggcagcgccaatgagaccagcagcatcctggtggagagcgtgaccaggagcagcacagagacctgctacagcgccatccccaaggccagcagtgatgccagcaaggtgaccagcaagggggccggcctgagcaaggcctttgtgggccagaagagcagcttcctggtggactgcagcaaggccggcagcaacatgctgctgattggagtgcacggccccaccaccccctgtgaggaggtgtccatgaagcacgtgggcaaccagcagtacaacgtgacctacgtggtgaaggagcggggggactatgtgctggccgtgaagtggggcgaggagcacatccctggcagccccttccacgtgacagtgccctag

SEQ ID NO: 152552 - DNA, 7776 bp, Artificial Sequence
  Description of Artificial Sequence: Synthetic coding sequence
atgcctgtgacagagaaggacctggccgaggatgccccctggaagaagatccagcagaacaccttcacccgctggtgcaatgagcacctgaagtgtgtgaacaagagaattggcaacctgcagacagacctgagtgatggcctgcggctgattgccctgctggaggtgctgagccagaagaggatgtacaggaagtaccaccagaggcccaccttccggcagatgcagctggagaatgtgtctgtggccctggagttcctggaccgggagagcatcaagctggtgtccattgacagcaaggccatcgtggatggcaacctgaagctgatcctgggcctggtgtggaccctcatcctgcactacagcatctccatgcctgtgtgggaggatgaaggagatgatgatgccaagaagcagacccccaagcagaggctgctgggctggatccagaacaagatcccctacctgcccatcaccaacttcaaccagaactggcaggacggcaaggccctgggcgccctggtggacagctgtgcccctggcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccactggaaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggggccggcgtgggggacattggagtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggccgccggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcacggcggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcctggagaatatgctgtgcacatcatgtgtgatgatgaggacatcaaggacagcccctacatggccttcatccacccagccaccggcggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaggccggggagggagatgtgtctgtgggcatcaagtgtgatgcccgggtgctgtctgaagatgaagaagatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggagctgggaaggcccccctgaatgtgcagttcaacagccccctgcctggagatgctgtgaaggacctggacatcatcgacaactatgactacagccacacagtgaagtacacccccacccagcagggcaacatgcaggtgctggtgacctacggcggggaccccatccccaagagccccttcaccgtgggcgtggccgcccccctggacctgagcaagatcaagctgaatggcctggagaacagagtggaggtgggcaaggaccaggagttcaccgtggacaccagaggagctgggggccagggcaagctggatgtgaccatcctgagccccagcaggaaggtggtgccctgcctggtgacccctgtgacaggccgggagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggggccggcaccggcggcctgggcctgactgtggagggcccctgtgaggccaagattgagtgcagcgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgacagcggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagaatgttttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccaggggggccggcatcggcggcctgggcatcaccgtggagggccccagcgagagcaagatcaactgccgggacaacaaggatggcagctgcagcgctgagtacatcccctttgcccctggggactatgatgtgaacatcacctatggaggagcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggcccccggggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccaccggccctggcatcgccagcacagtgaagacaggagaggaggtgggctttgtggtggatgccaagacagctgggaagggcaaggtgacctgcaccgtgctgaccccagatggaacagaggccgaggctgatgtgattgaaaatgaagatggcacctatgacatcttctacacagctgccaagccaggcacctacgtgatctacgtgcgctttggaggagtggacatccccaacagccccttcaccgtgatggccacagatggagaggtgacagctgtggaggaggcccctgtgacagaggaggcctacgtgcctgtgtctgacatgaatggcctgggcttcaagccctttgacctggtgatcccctttgctgtgaggaagggggagatcaccggggaggtgcacatgcccagcggcaagacagccaccccagaaattgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaatcatgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctatggaggcatcagcctggccgtggagggccccagcaaggtggacatccagacagaggacctggaggatggcacctgcaaggtgtcctacttccccaccgtgcctggggtgtacatcgtgtccaccaagtttgctgatgagcacgtgcccggcagccccttcaccgtgaagatctctggagagggccgggtgaaggagagcatcaccaggaccagccgggcccccagcgtggccaccgtgggcagcatctgtgacctgaacctgaagatccctgagatcaacagcagtgacatgtctgcccacgtgaccagccccagcggccgggtgacagaggccgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgcctgctgagttcagcatctggacccgggaggccggggccggcggcctgagcattgctgtggagggccccagcaaggccgagatcacctttgatgaccacaagaatggcagctgtggggtgtcctacatcgcccaggagcccggcaactatgaggtgtccatcaagttcaatgatgagcacatccctgagagcccctacctggtgcctgtgattgcccccagtgatgatgcccggcggctgactgtgatgagcctgcaggagagcggcctgaaggtgaaccagcctgccagctttgccatccggctgaatggagccaagggcaagattgatgccaaggtgcacagccccagcggggctgtggaggagtgccacgtgtctgagctggagccagacaagtatgctgtgcgcttcatcccccatgaaaatggagtgcacaccattgatgtgaagttcaacggcagccacgtggtgggcagccccttcaaggtgcgggtgggggagcccggccaggccggcaacccagccctggtgtctgcctatggaacaggcctggagggcggcaccaccggcatccagagcgagttcttcatcaacaccaccagggctggccctggcaccctgtctgtgaccatcgagggccccagcaaggtgaagatggactgccaggagaccccagagggctacaaggtgatgtacacccccatggcccctggcaactacctgatctctgtgaagtatggaggccccaaccacatcgtgggcagccccttcaaggccaaggtgacaggccagaggctggtgtccccaggcagcgccaatgagaccagcagcatcctggtggagagcgtgaccaggagcagcacagagacctgctacagcgccatccccaaggccagcagtgatgccagcaaggtgaccagcaaaggagctggcctgagcaaggcctttgtgggccagaagagcagcttcctggtggactgcagcaaggccggcagcaacatgctgctgattggagtgcacggccccaccaccccctgtgaggaggtgtccatgaagcacgtgggcaaccagcagtacaacgtgacctacgtggtgaaggagcggggggactatgtgctggccgtgaagtggggcgaggagcacatccctggcagccccttccacgtgacagtgccctag

SEQ ID NO: 152553 - DNA, 408 bp, Artificial Sequence
  Description of Artificial Sequence: Synthetic coding sequence
tgactggccgtggagggccccagcaaggtggacatccagacagaggacctggaggatggcacctgcaaggtgtcctacttccccaccgtgcctggggtgtacatcgtgtccaccaagtttgctgatgagcacgtgcctgagatcaacagcagtgacatgtctgcccacgtgaccagccccagcggccgggtgacagaagctgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgccctag

SEQ ID NO: 152554 - DNA, 7902 bp, Artificial Sequence
  Description of Artificial Sequence: Synthetic coding sequence
atgcctgtgacagagaaggacctggccgaggatgccccctggaagaagatccagcagaacaccttcacccgctggtgcaatgagcacctgaagtgtgtgaacaagagaattggcaacctgcagacagacctgagtgatggcctgcggctgattgccctgctggaggtgctgagccagaagaggatgtacaggaagtaccaccagaggcccaccttccggcagatgcagctggagaatgtgtctgtggccctggagttcctggaccgggagagcatcaagctggtgtccattgacagcaaggccatcgtggatggcaacctgaagctgatcctgggcctggtgtggaccctcatcctgcactacagcatctccatgcctgtgtgggaggatgaaggagatgatgatgccaagaagcagacccccaagcagaggctgctgggctggatccagaacaagatcccctacctgcccatcaccaacttcaaccagaactggcaggacggcaaggccctgggcgccctggtggacagctgtgcccctggcctgtgcccagactgggagagctgggacccccagaagcctgtggacaatgcccgggaggccatgcagcaggctgatgactggctgggcgtgccccaggtgatcaccccagaggagatcatccacccagatgtggatgagcacagcgtgatgacctacctgagccagttccccaaggccaagctgaagccaggggcccccctgaagcccaagctgaaccccaagaaggcccgggcctacggccggggcatcgagcccactggaaacatggtgaagcagcctgccaagttcaccgtggacaccatctctgctggccagggagatgtgatggtgtttgtggaggaccctgagggcaacaaggaggaggcccaggtgaccccagacagcgacaagaacaagacctacagcgtggagtacctgcccaaggtgacaggcctgcacaaggtgacagtgctgtttgctggccagcacatcagcaagagcccctttgaggtgtctgtggacaaggcccagggagatgccagcaaggtgacagccaagggccctggcctggaggccgtgggcaacatcgccaacaagcccacctactttgacatctacacagctggggccggcgtgggggacattggagtggaggtggaggacccccagggcaagaacacagtggagctgctggtggaggacaagggcaaccaggtgtaccgctgtgtgtacaagcccatgcagcccggcccccacgtggtgaagatcttctttgctggggacaccatccccaagagcccctttgtggtgcaggtgggggaggcctgcaaccccaatgcctgccgggccagcggccggggcctgcagcccaagggcgtgcgcatccgggagaccacagacttcaaggtggacaccaaggccgccggcagcggggagctgggcgtgaccatgaagggccccaagggcctggaggagctggtgaagcagaaggacttcctggatggagtgtatgcctttgagtactaccccagcaccccaggccgctacagcatcgccatcacctggggcggccaccacatccccaagagcccctttgaggtgcaggtgggccctgaggccggcatgcagaaggtgcgggcctggggccctggcctgcacggcggcatcgtgggccgctctgctgactttgtggtggagagcatcggcagcgaggtgggcagcctgggctttgccatcgagggccccagccaggccaagattgagtacaatgaccagaatgatggcagctgtgatgtgaagtactggcccaaggagcctggagaatatgctgtgcacatcatgtgtgatgatgaggacatcaaggacagcccctacatggccttcatccacccagccaccggcggctacaacccagacctggtgcgggcctacggccctggcctggagaagagcggctgcatcgtgaacaacctggccgagttcaccgtggaccccaaggatgctgggaaggcccccctgaagatctttgcccaggatggagagggccagagaattgacatccagatgaagaacaggatggatggcacctacgcctgcagctacacccctgtgaaggccatcaagcacaccatcgctgtggtgtggggcggcgtgaacatcccccacagcccctacagagtgaacatcggccagggcagccacccccagaaggtgaaggtgtttggacctggggtggagaggagcggcctgaaggccaatgagcccacccacttcaccgtggactgcacagaggccggggagggagatgtgtctgtgggcatcaagtgtgatgcccgggtgctgtctgaagatgaagaagatgtggactttgacatcatccacaatgccaatgacaccttcaccgtgaagtatgtgcccccagctgctggccgctacaccatcaaggtgctgtttgccagccaggagatcccagccagccccttccgggtgaaggtggaccccagccatgatgccagcaaggtgaaggccgagggccctggcctgagcaaggccggcgtggagaatggcaagcccacccacttcaccgtgtacaccaagggagctgggaaggcccccctgaatgtgcagttcaacagccccctgcctggagatgctgtgaaggacctggacatcatcgacaactatgactacagccacacagtgaagtacacccccacccagcagggcaacatgcaggtgctggtgacctacggcggggaccccatccccaagagccccttcaccgtgggcgtggccgcccccctggacctgagcaagatcaagctgaatggcctggagaacagagtggaggtgggcaaggaccaggagttcaccgtggacaccagaggagctgggggccagggcaagctggatgtgaccatcctgagccccagcaggaaggtggtgccctgcctggtgacccctgtgacaggccgggagaacagcacagccaagttcatcccccgggaggagggcctgtatgctgtggatgtgacctatgatggccaccctgtgcccggcagcccctacacagtggaggccagcctgcccccagaccccagcaaggtgaaggcccacggccctggcctggagggcggcctggtgggcaagccagctgagttcaccatcgacaccaagggggccggcaccggcggcctgggcctgactgtggagggcccctgtgaggccaagattgagtgcagcgacaatggagatggcacctgcagcgtgtcctacctgcccaccaagccaggagagtactttgtgaacatcctgtttgaggaggtgcacatccctggcagccccttcaaggctgacatcgagatgccctttgaccccagcaaggtggtggccagcggccctggcctggagcacggcaaggtgggggaggccggcctgctgtctgtggactgcagcgaggccggccctggggccctgggcctggaggccgtgtctgacagcggcaccaaggccgaggtgtccatccagaacaacaaggatggcacctatgctgtgacctacgtgcccctgacagctggcatgtacaccctgaccatgaagtatggaggagagctggtgccccacttccctgcccgggtgaaggtggagcctgctgtggacaccagccgcatcaaggtgtttggacctggcatcgagggcaaggatgtgttccgggaggccaccacagacttcaccgtggacagccggcccctgacccaggtgggcggggaccacatcaaggcccacatcgccaaccccagcggggccagcacagaatgttttgtgacagacaatgctgatggcacctaccaggtggagtacaccccatttgagaagggcctgcacgtggtggaggtgacctatgatgatgtgcccatccccaacagccccttcaaggtggccgtgacagagggctgccagcccagccgggtgcaggcccagggccctggcctgaaggaggccttcaccaacaagcccaacgtgttcaccgtggtgaccaggggggccggcatcggcggcctgggcatcaccgtggagggccccagcgagagcaagatcaactgccgggacaacaaggatggcagctgcagcgctgagtacatcccctttgcccctggggactatgatgtgaacatcacctatggaggagcccacatccctggcagccccttccgggtgcctgtgaaggatgtggtggaccccagcaaggtgaagattgctggccctggcctgggcagcggcgtgcgggcccgggtgctgcagagcttcaccgtggacagcagcaaggccggcctggcccccctggaggtgcgggtgctgggccccagggcagatgacacagacagccagagctggaggagccccctgaaggccctgtctgagttcttcaagggggaccccaagggggacttcaacaagacaggcctggtggagcctgtgaatgtggtggacaatggagatggcacccacacagtgacctacacccccagccaggagggcccctacatggtgtctgtgaagtatgcagatgaggagatccccaggagccccttcaaggtgaaggtgctgcccacctatgatgccagcaaggtgacagccagcggccctggcctgagcagctatggagtgcctgccagcctgcctgtggactttgccattgatgccagagatgctggggagggcctgctggccgtgcagatcacagaccaggagggcaagcccaagagggccatcgtgcatgacaacaaggatggcacctatgctgtgacctacatcccagacaagacaggccgctacatgattggagtgacctatggaggagatgacatccccctgagcccctaccgcatccgggccacccagacaggagatgccagcaagtgcctggccactggacctggcatcgccagcacagtgaagacaggagaggaggtgggctttgtggtggatgccaagacagctgggaagggcaaggtgacctgcaccgtgctgaccccagatggaacagaagctgaggctgatgtgattgaaaatgaagatggcacctatgacatcttctacacagctgccaagccaggcacctacgtgatctacgtgcgctttggaggagtggacatccccaacagccccttcaccgtgatggccacagatggagaggtgacagctgtggaggaggcccctgtgaatgcctgccccccaggcttccggccctgggtgacagaggaggcctacgtgcctgtgtctgacatgaatggcctgggcttcaagccctttgacctggtgatcccctttgctgtgaggaagggggagatcaccggggaggtgcacatgcccagcggcaagacagccaccccagaaattgtggacaacaaggatggcaccgtgacagtgcgctatgcccccacagaggtgggcctgcacgagatgcacatcaagtacatgggcagccacatccctgagagccccctgcagttctacgtgaactaccccaacagcggctctgtgtctgcctacggccctggcctggtgtatggagtggccaacaagacagccaccttcaccatcgtgacagaagatgctggggagggcggcctggacctggccatcgagggccccagcaaggccgagatcagctgcatcgacaacaaggatggcacctgcaccgtgacctacctgcccaccctgcccggggactacagcatcctggtgaagtacaatgacaagcacatccctggcagccccttcaccgccaagatcacagatgacagccgccgctgcagccaggtgaagctgggcagcgctgctgacttcctgctggacatcagcgagacagacctgagcagcctgacagccagcatcaaggcccccagcggcagagatgagccctgcctgctgaagaggctgcccaacaaccacatcggcatctccttcatcccccgggaggtgggggagcacctggtgtccatcaagaagaatggaaatcatgtggccaacagccctgtgtccatcatggtggtgcagagcgagattggagatgcccggcgggccaaggtgtatggccggggcctgtctgagggccgcacctttgagatgtctgacttcatcgtggacaccagagatgctggctatggaggcatcagcctggccgtggagggccccagcaaggtggacatccagacagaggacctggaggatggcacctgcaaggtgtcctacttccccaccgtgcctggggtgtacatcgtgtccaccaagtttgctgatgagcacgtgcccggcagccccttcaccgtgaagatctctggagagggccgggtgaaggagagcatcaccaggaccagccgggcccccagcgtggccaccgtgggcagcatctgtgacctgaacctgaagatccctgagatcaacagcagtgacatgtctgcccacgtgaccagccccagcggccgggtgacagaggccgagatcgtgcccatgggcaagaacagccactgtgtgcgctttgtgccccaggagatgggcgtgcacacagtgtctgtgaagtaccggggccagcacgtgacaggcagccccttccagttcaccgtgggccccctgggggagggcggggcccacaaggtgcgggccggcggccctggcctggagcggggggaggccggcgtgcctgctgagttcagcatctggacccgggaggccggggccggcggcctgagcattgctgtggagggccccagcaaggccgagatcacctttgatgaccacaagaatggcagctgtggggtgtcctacatcgcccaggagcccggcaactatgaggtgtccatcaagttcaatgatgagcacatccctgagagcccctacctggtgcctgtgattgcccccagtgatgatgcccggcggctgactgtgatgagcctgcaggagagcggcctgaaggtgaaccagcctgccagctttgccatccggctgaatggagccaagggcaagattgatgccaaggtgcacagccccagcggggctgtggaggagtgccacgtgtctgagctggagccagacaagtatgctgtgcgcttcatcccccatgaaaatggagtgcacaccattgatgtgaagttcaacggcagccacgtggtgggcagccccttcaaggtgcgggtgggggagcccggccaggccggcaacccagccctggtgtctgcctatggaacaggcctggagggcggcaccaccggcatccagagcgagttcttcatcaacaccaccagggctggccctggcaccctgtctgtgaccatcgagggccccagcaaggtgaagatggactgccaggagaccccagagggctacaaggtgatgtacacccccatggcccctggcaactacctgatctctgtgaagtatggaggccccaaccacatcgtgggcagccccttcaaggccaaggtgacaggccagaggctggtgtccccaggcagcgccaatgagaccagcagcatcctggtggagagcgtgaccaggagcagcacagagacctgctacagcgccatccccaaggccagcagtgatgccagcaaggtgaccagcaaaggagctggcctgagcaaggcctttgtgggccagaagagcagcttcctggtggactgcagcaaggccggcagcaacatgctgctgattggagtgcacggccccaccaccccctgtgaggaggtgtccatgaagcacgtgggcaaccagcagtacaacgtgacctacgtggtgaaggagcggggggactatgtgctggccgtgaagtggggcgaggagcacatccctggcagccccttccacgtgacagtgccctag

SEQ ID NO: 152555 - DNA, 8178 bp, Artificial Sequence
  Description of Artificial Sequence: Synthetic coding sequence
atgatgaacaacagcggctacagtgatgctggcctgggcctgggagatgaaacagatgagatgcccagcacagagaaggacctggccgaggatgccccctggaagaagatccagcagaacaccttcacccgctggtgcaatgagcacctgaagtgtgtgggcaagaggctgacagacctgcagagggacctgagtgatggcctgcggctgattgccctgctggaggtgctgagccagaagaggatgtacaggaagttccacccccggcccaacttccggcagatgaagctggagaatgtgtctgtggccctggagttcctggagcgggagcacatcaagctggtgtccattgacagcaaggccatcgtggatggcaacctgaagctgatcctgggcctcatctggaccctcatcctgcactacagcatctccatgcccatgtgggaggatgaagatgatgaagatgccaggaagcagacccccaagcagaggctgctgggctggatccagaacaaggtgccccagctgcccatcaccaacttcaacagagactggcaggacggcaaggccctgggcgccctggtggacaactgtgcccctggcctgtgcccagactgggaggcctgggaccccaaccagcctgtggagaatgcccgggaggccatgcagcaggctgatgactggctgggcgtgccccaggtgattgcccctgaggagatcgtggaccccaacgtggatgagcacagcgtgatgacctacctgagccagttccccaaggccaagctgaagccaggggcccctgtgcgcagcaagcagctgaaccccaagaaggccatcgcctacggccctggcatcgagccccagggcaacacagtgctgcagcctgcccacttcaccgtgcagacagtggatgctggggtgggggaggtgctggtgtacattgaagatcctgagggccacacagaggaggccaaggtggtgcccaacaatgacaaggacaggacctatgctgtgtcctatgtgcccaaggtggccggcctgcacaaggtgacagtgctgtttgctggccagaacatcgagaggagcccctttgaggtgaatgtgggcatggccctgggagatgccaacaaggtgtctgcccggggccctggcctggagcctgtgggcaatgtggccaacaagcccacctactttgacatctacacagctggagctggcactggagatgtggccgtggtgattgtggacccccagggccggcgggacacagtggaggtggccctggaggacaagggggacagcaccttccgctgcacctacagacctgccatggagggcccccacacagtgcacgtggcctttgctggggcccccatcaccaggagccccttccctgtgcacgtgtctgaggcctgcaaccccaatgcctgccgggccagcggccggggcctgcagcccaagggcgtgcgggtgaaggaggtggccgacttcaaggtgttcaccaagggggccggcagcggggagctgaaggtgacagtgaagggccccaagggcacagaggagcctgtgaaggtgcgggaggccggagatggagtgtttgaatgtgagtactaccctgtggtgcctgggaagtatgtggtgaccatcacctggggcggctacgccatccccaggagcccctttgaggtgcaggtgtccccagaggccggcgtgcagaaggtgcgggcctggggccctggcctggagaccggccaggtgggcaagtctgctgactttgtggtggaggccatcggcacagaggtgggcaccctgggcttcagcattgagggccccagccaggccaagattgaatgtgatgacaagggagatggcagctgtgatgtgcgctactggcccacagagcctggagaatatgctgtgcacgtgatctgtgatgatgaggacatccgggacagccccttcatcgcccacatcctgcctgcccccccagactgcttcccagacaaggtgaaggcctttggacctggcctggagcccaccggctgcatcgtggacaagccagctgagttcaccattgatgcccgggctgctggaaaaggagacctgaagctgtatgcccaggatgctgatggctgccccatcgacatcaaggtgatccccaatggagatggcaccttccgctgcagctatgtgcccaccaagcccatcaagcacaccatcatcatctcctggggcggcgtgaatgtgcccaagagccccttccgggtgaatgtgggggagggcagccaccctgagcgggtgaaggtgtatggccctggggtggagaagacaggcctgaaggccaatgagcccacctacttcaccgtggactgcagcgaggccggccagggagatgtgtccatcggcatcaagtgtgcccctggggtggtgggccctgctgaggccgacatcgactttgacatcatcaagaatgacaatgacaccttcaccgtgaagtacaccccacctggggccggccgctacaccatcatggtgctgtttgccaaccaggagatcccagccagccccttccacatcaaggtggaccccagccatgatgccagcaaggtgaaggccgagggccctggcctgaacagaactggagtggaggtgggcaagcccacccacttcaccgtgctgaccaagggagctgggaaggccaagctggatgtgcagtttgctggaacagccaagggggaggtggtgcgggactttgagatcatcgacaaccacgactacagctacacagtgaagtacacagctgtgcagcagggcaacatggctgtgacagtgacctacggcggggaccctgtgcccaagagcccctttgtggtgaatgtggccccacccctggacctgagcaagatcaaggtgcagggcctgaacagcaaggtggccgtgggccaggagcaggccttctctgtgaacaccagaggagctgggggccagggccagctggatgtgaggatgaccagccccagccggcggcccatcccctgcaagctggagcccggcggcggcgctgaggcccaggccgtgcgctacatgcctcctgaggagggcccctacaaggtggacatcacctatgatggccaccctgtgcccggcagcccctttgctgtggagggcgtgctgcccccagaccccagcaaggtgtgtgcctacggccctggcctgaagggcggcctggtgggcaccccagcccccttcagcattgacaccaagggggccggcaccggcggcctgggcctgactgtggagggcccctgtgaggccaagattgagtgccaggacaatggagatggcagctgtgctgtgtcctacctgcccacagagcccggggagtacaccatcaacatcctgtttgctgaggcccacatccctggcagccccttcaaggccaccatccggcctgtgtttgaccccagcaaggtgcgggccagcggccctggcctggagcggggcaaggtgggggaggccgccaccttcaccgtggactgcagcgaggccggggaggccgagctgaccatcgagatcctgagtgatgctggggtgaaggccgaggtgctgatccacaacaatgctgatggcacctaccacatcacctacagccctgccttccctggcacctacaccatcaccatcaagtatggaggccaccctgtgcccaagttccccaccagggtgcacgtgcagcctgctgtggacaccagcggcgtgaaggtgtctggccctggggtggagccccatggagtgctgcgggaggtgaccacagagttcaccgtggatgcccggagcctgacagccactggaggcaaccacgtgacagcccgggtgctgaaccccagcggggccaagacagacacctacgtgacagacaatggagatggcacctacagagtgcagtacacagcctatgaggagggcgtgcacctggtggaggtgctgtatgatgaggtggccgtgcccaagagccccttccgggtgggcgtgacagagggctgtgaccccaccagggtgcgggccttcggccctggcctggagggcggcctggtgaacaaggccaaccgcttcaccgtggagaccaggggggccggcaccggcggcctgggcctggccatcgagggccccagcgaggccaagatgagctgcaaggacaacaaggatggcagctgcaccgtggagtacatccccttcacccctggggactatgatgtgaacatcacctttggaggccggcccatccctggcagccccttccgggtgcctgtgaaggatgtggtggaccccgggaaggtgaagtgcagcggccctggcctgggcgccggcgtgcgggcccgggtgccccagaccttcaccgtggactgcagccaggccggccgggcccccctgcaggtggccgtgctgggccccactggagtggccgagcctgtggaggtgcgggacaatggagatggcacccacacagtgcactacaccccagccacagatggcccctacacagtggccgtgaagtatgctgaccaggaggtgcccaggagccccttcaagatcaaggtgctgcctgcccatgatgccagcaaggtgcgggccagcggccctggcctgaatgccagcggcatcccagccagcctgcctgtggagttcaccattgatgccagagatgctggggagggcctgctgactgtgcagatcctggaccctgagggcaagcccaagaaggccaacatccgggacaatggagatggcacctacacagtgtcctacctgcctgacatgagcggccgctacaccatcaccatcaagtatggaggagatgagatcccctacagccccttccgcatccacgccctgcccactggagatgccagcaagtgcctggtgacagtgtccattggaggccacggcctgggcgcctgcctgggcccccgcatccagatcggccaggagaccgtcatcaccgtggatgccaaggctgctggggagggcaaggtgacctgcaccgtgtccaccccagatggagctgagctggatgtggatgtggtggagaaccatgatggcacctttgacatctactacacagcccctgagcccgggaagtatgtgatcaccatccgctttggaggagagcacatccccaacagccccttccacgtgctggcctgtgaccccctgccccatgaggaggagcccagcgaggtgccccagctgcggcagccctatgccccacccaggcctggggcccggcccacccactgggccacagaggagcctgtggtgcctgtggagcccatggagagcatgctgcggcccttcaacctggtgatcccctttgctgtgcagaagggggagctgactggagaggtgaggatgcccagcggcaagacagcccggcccaacatcacagacaacaaggatggcaccatcaccgtgcgctatgcccccacagagaagggcctgcaccagatgggcatcaagtatgatggcaaccacatccctggcagccccctgcagttctacgtggatgccatcaacagcagacatgtgtctgcctacggccctggcctgagccacggcatggtgaacaagccagccaccttcaccatcgtgaccaaggatgctggggagggcggcctgagcctggccgtggagggccccagcaaggccgagatcacctgcaaggacaacaaggatggcacctgcaccgtgtcctacctgcccacagcccctggggactacagcatcatcgtgcgctttgatgacaagcacatccctggcagccccttcaccgccaagatcactggagatgacagcatgaggaccagccagctgaatgtgggcaccagcacagatgtgtccctgaagatcacagaaagtgacctgagccagctgacagccagcatccgggcccccagcggaaatgaggagccctgcctgctgaagaggctgcccaacagacacatcggcatctccttcacccccaaggaggtgggggagcacgtggtgtctgtgaggaagagcggcaagcacgtgaccaacagccccttcaagatcctggtgggccccagcgagattggagatgccagcaaggtgcgggtgtggggcaagggcctgtctgagggccacaccttccaggtggccgagttcatcgtggacaccagaaatgccggctatggaggcctgggcctgagcattgagggccccagcaaggtggacatcaactgtgaggacatggaggatggcacctgcaaggtgacctactgccccacagagcccggcacctacatcatcaacatcaagtttgctgacaagcacgtgcccggcagccccttcaccgtgaaggtgactggagagggccgcatgaaggagagcatcacccggcggcggcaggcccccagcatcgccaccatcggcagcacctgtgacctgaacctgaagatccctggcaactggttccagatggtgtctgcccaggagcggctgaccaggaccttcaccaggagcagccacacctacaccaggacagagaggacagagatcagcaagacccggggcggggagaccaagcgggaggtgcgggtggaggagagcacccaggtgggcggggaccccttccctgctgtgtttggagacttcctgggccgggagcggctgggcagctttggcagcatcacccggcagcaggagggggaggccagcagccaggacatgacagcccaggtgaccagccccagcggcaaggtggaggccgctgagatcgtggagggggaggacagcgcctacagcgtgcgctttgtgccccaggagatgggcccccacacagtggccgtgaagtaccggggccagcacgtgcccggcagccccttccagttcaccgtgggccccctgggggagggcggggcccacaaggtgcgggccggcggcaccggcctggagcggggcgtggccggcgtgcctgctgagttcagcatctggacccgggaggccggggccggcggcctgagcattgctgtggagggccccagcaaggccgagatcgcctttgaggacaggaaggatggcagctgtggggtgtcctatgtggtgcaggagcccggggactatgaggtgtccatcaagttcaatgatgagcacatcccagacagcccctttgtggtgcctgtggccagcctgagtgatgatgcccggcggctgactgtgaccagcctgcaggagaccggcctgaaggtgaaccagcctgccagctttgctgtgcagctgaatggagcccggggcgtgattgatgcccgggtgcacacccccagcggggctgtggaggagtgctacgtgtctgagctggacagcgacaagcacaccatccgcttcatcccccatgaaaatggagtgcacagcattgatgtgaagttcaatggagcccacatccctggcagccccttcaagatccgggtgggggagcagagccaggccggggaccccggcctggtgtctgcctacggccctggcctggagggcggcaccaccggggtgagcagcgagttcatcgtgaacaccctgaatgccggcagcggggccctgtctgtgaccattgatggccccagcaaggtgcagctggactgccgggagtgcccagagggccacgtggtgacctacacccccatggcccctggcaactacctgattgccatcaagtatggaggcccccagcacatcgtgggcagccccttcaaggccaaggtgacaggcccccggctgagcggcggccacagcctgcacgagaccagcacagtgctggtggagaccgtgaccaagagcagcagcagccggggcagcagctacagcagcatccccaagttcagcagtgatgccagcaaggtggtgacccggggccctggcctgagccaggcctttgtgggccagaagaacagcttcaccgtggactgcagcaaggccggcaccaacatgatgatggtgggcgtgcacggccccaagaccccctgtgaggaggtgtatgtgaagcacatgggcaacagagtgtacaacgtgacctacacagtgaaggagaagggggactacatcctgattgtgaagtggggagatgagagcgtgcccggcagccccttcaaggtgaaggtgccctag

SEQ ID NO: 152556 - DNA, 8079 bp, Artificial Sequence
  Description of Artificial Sequence: Synthetic coding sequence
atgatgaacaacagcggctacagtgatgctggcctgggcctgggagatgaaacagatgagatgcccagcacagagaaggacctggccgaggatgccccctggaagaagatccagcagaacaccttcacccgctggtgcaatgagcacctgaagtgtgtgggcaagaggctgacagacctgcagagggacctgagtgatggcctgcggctgattgccctgctggaggtgctgagccagaagaggatgtacaggaagttccacccccggcccaacttccggcagatgaagctggagaatgtgtctgtggccctggagttcctggagcgggagcacatcaagctggtgtccattgacagcaaggccatcgtggatggcaacctgaagctgatcctgggcctcatctggaccctcatcctgcactacagcatctccatgcccatgtgggaggatgaagatgatgaagatgccaggaagcagacccccaagcagaggctgctgggctggatccagaacaaggtgccccagctgcccatcaccaacttcaacagagactggcaggacggcaaggccctgggcgccctggtggacaactgtgcccctggcctgtgcccagactgggaggcctgggaccccaaccagcctgtggagaatgcccgggaggccatgcagcaggctgatgactggctgggcgtgccccaggtgattgcccctgaggagatcgtggaccccaacgtggatgagcacagcgtgatgacctacctgagccagttccccaaggccaagctgaagccaggggcccctgtgcgcagcaagcagctgaaccccaagaaggccatcgcctacggccctggcatcgagccccagggcaacacagtgctgcagcctgcccacttcaccgtgcagacagtggatgctggggtgggggaggtgctggtgtacattgaagatcctgagggccacacagaggaggccaaggtggtgcccaacaatgacaaggacaggacctatgctgtgtcctatgtgcccaaggtggccggcctgcacaaggtgacagtgctgtttgctggccagaacatcgagaggagcccctttgaggtgaatgtgggcatggccctgggagatgccaacaaggtgtctgcccggggccctggcctggagcctgtgggcaatgtggccaacaagcccacctactttgacatctacacagctggagctggcactggagatgtggccgtggtgattgtggacccccagggccggcgggacacagtggaggtggccctggaggacaagggggacagcaccttccgctgcacctacagacctgccatggagggcccccacacagtgcacgtggcctttgctggggcccccatcaccaggagccccttccctgtgcacgtgtctgaggcctgcaaccccaatgcctgccgggccagcggccggggcctgcagcccaagggcgtgcgggtgaaggaggtggccgacttcaaggtgttcaccaagggggccggcagcggggagctgaaggtgacagtgaagggccccaagggcacagaggagcctgtgaaggtgcgggaggccggagatggagtgtttgaatgtgagtactaccctgtggtgcctgggaagtatgtggtgaccatcacctggggcggctacgccatccccaggagcccctttgaggtgcaggtgtccccagaggccggcgtgcagaaggtgcgggcctggggccctggcctggagaccggccaggtgggcaagtctgctgactttgtggtggaggccatcggcacagaggtgggcaccctgggcttcagcattgagggccccagccaggccaagattgaatgtgatgacaagggagatggcagctgtgatgtgcgctactggcccacagagcctggagaatatgctgtgcacgtgatctgtgatgatgaggacatccgggacagccccttcatcgcccacatcctgcctgcccccccagactgcttcccagacaaggtgaaggcctttggacctggcctggagcccaccggctgcatcgtggacaagccagctgagttcaccattgatgcccgggctgctggaaaaggagacctgaagctgtatgcccaggatgctgatggctgccccatcgacatcaaggtgatccccaatggagatggcaccttccgctgcagctatgtgcccaccaagcccatcaagcacaccatcatcatctcctggggcggcgtgaatgtgcccaagagccccttccgggtgaatgtgggggagggcagccaccctgagcgggtgaaggtgtatggccctggggtggagaagacaggcctgaaggccaatgagcccacctacttcaccgtggactgcagcgaggccggccagggagatgtgtccatcggcatcaagtgtgcccctggggtggtgggccctgctgaggccgacatcgactttgacatcatcaagaatgacaatgacaccttcaccgtgaagtacaccccacctggggccggccgctacaccatcatggtgctgtttgccaaccaggagatcccagccagccccttccacatcaaggtggaccccagccatgatgccagcaaggtgaaggccgagggccctggcctgaacagaactggagtggaggtgggcaagcccacccacttcaccgtgctgaccaagggagctgggaaggccaagctggatgtgcagtttgctggaacagccaagggggaggtggtgcgggactttgagatcatcgacaaccacgactacagctacacagtgaagtacacagctgtgcagcagggcaacatggctgtgacagtgacctacggcggggaccctgtgcccaagagcccctttgtggtgaatgtggccccacccctggacctgagcaagatcaaggtgcagggcctgaacagcaaggtggccgtgggccaggagcaggccttctctgtgaacaccagaggagctgggggccagggccagctggatgtgaggatgaccagccccagccggcggcccatcccctgcaagctggagcccggcggcggcgctgaggcccaggccgtgcgctacatgcctcctgaggagggcccctacaaggtggacatcacctatgatggccaccctgtgcccggcagcccctttgctgtggagggcgtgctgcccccagaccccagcaaggtgtgtgcctacggccctggcctgaagggcggcctggtgggcaccccagcccccttcagcattgacaccaagggggccggcaccggcggcctgggcctgactgtggagggcccctgtgaggccaagattgagtgccaggacaatggagatggcagctgtgctgtgtcctacctgcccacagagcccggggagtacaccatcaacatcctgtttgctgaggcccacatccctggcagccccttcaaggccaccatccggcctgtgtttgaccccagcaaggtgcgggccagcggccctggcctggagcggggcaaggtgggggaggccgccaccttcaccgtggactgcagcgaggccggggaggccgagctgaccatcgagatcctgagtgatgctggggtgaaggccgaggtgctgatccacaacaatgctgatggcacctaccacatcacctacagccctgccttccctggcacctacaccatcaccatcaagtatggaggccaccctgtgcccaagttccccaccagggtgcacgtgcagcctgctgtggacaccagcggcgtgaaggtgtctggccctggggtggagccccatggagtgctgcgggaggtgaccacagagttcaccgtggatgcccggagcctgacagccactggaggcaaccacgtgacagcccgggtgctgaaccccagcggggccaagacagacacctacgtgacagacaatggagatggcacctacagagtgcagtacacagcctatgaggagggcgtgcacctggtggaggtgctgtatgatgaggtggccgtgcccaagagccccttccgggtgggcgtgacagagggctgtgaccccaccagggtgcgggccttcggccctggcctggagggcggcctggtgaacaaggccaaccgcttcaccgtggagaccaggggggccggcaccggcggcctgggcctggccatcgagggccccagcgaggccaagatgagctgcaaggacaacaaggatggcagctgcaccgtggagtacatccccttcacccctggggactatgatgtgaacatcacctttggaggccggcccatccctggcagccccttccgggtgcctgtgaaggatgtggtggaccccgggaaggtgaagtgcagcggccctggcctgggcgccggcgtgcgggcccgggtgccccagaccttcaccgtggactgcagccaggccggccgggcccccctgcaggtggccgtgctgggccccactggagtggccgagcctgtggaggtgcgggacaatggagatggcacccacacagtgcactacaccccagccacagatggcccctacacagtggccgtgaagtatgctgaccaggaggtgcccaggagccccttcaagatcaaggtgctgcctgcccatgatgccagcaaggtgcgggccagcggccctggcctgaatgccagcggcatcccagccagcctgcctgtggagttcaccattgatgccagagatgctggggagggcctgctgactgtgcagatcctggaccctgagggcaagcccaagaaggccaacatccgggacaatggagatggcacctacacagtgtcctacctgcctgacatgagcggccgctacaccatcaccatcaagtatggaggagatgagatcccctacagccccttccgcatccacgccctgcccactggagatgccagcaagtgcctggtgacagtgtccattggaggccacggcctgggcgcctgcctgggcccccgcatccagatcggccaggagaccgtcatcaccgtggatgccaaggctgctggggagggcaaggtgacctgcaccgtgtccaccccagatggagctgagctggatgtggatgtggtggagaaccatgatggcacctttgacatctactacacagcccctgagcccgggaagtatgtgatcaccatccgctttggaggagagcacatccccaacagccccttccacgtgctggccacagaggagcctgtggtgcctgtggagcccatggagagcatgctgcggcccttcaacctggtgatcccctttgctgtgcagaagggggagctgaccggggaggtgaggatgcccagcggcaagacagcccggcccaacatcacagacaacaaggatggcaccatcaccgtgcgctatgcccccacagagaagggcctgcaccagatgggcatcaagtatgatggcaaccacatccctggcagccccctgcagttctacgtggatgccatcaacagccgccacgtgtctgcctacggccctggcctgagccacggcatggtgaacaagccagccaccttcaccatcgtgaccaaggatgctggggagggcggcctgagcctggccgtggagggccccagcaaggccgagatcacctgcaaggacaacaaggatggcacctgcaccgtgtcctacctgcccacagcccctggggactacagcatcatcgtgcgctttgatgacaagcacatccctggcagccccttcaccgccaagatcactggagatgacagcatgaggaccagccagctgaatgtgggcaccagcacagatgtgtccctgaagatcacagaaagtgacctgagccagctgacagccagcatccgggcccccagcggaaatgaggagccctgcctgctgaagaggctgcccaacagacacatcggcatctccttcacccccaaggaggtgggggagcacgtggtgtctgtgaggaagagcggcaagcacgtgaccaacagccccttcaagatcctggtgggccccagcgagattggagatgccagcaaggtgcgggtgtggggcaagggcctgtctgagggccacaccttccaggtggccgagttcatcgtggacaccagaaatgccggctacggcggcctgggcctgagcattgagggccccagcaaggtggacatcaactgtgaggacatggaggatggcacctgcaaggtgacctactgccccacagagcccggcacctacatcatcaacatcaagtttgctgacaagcacgtgcccggcagccccttcaccgtgaaggtgactggagagggccgcatgaaggagagcatcacccggcggcggcaggcccccagcatcgccaccatcggcagcacctgtgacctgaacctgaagatccctggcaactggttccagatggtgtctgcccaggagcggctgaccaggaccttcaccaggagcagccacacctacaccaggacagagaggacagagatcagcaagacccggggcggggagaccaagcgggaggtgcgggtggaggagagcacccaggtgggcggggaccccttccctgctgtgtttggagacttcctgggccgggagcggctgggcagctttggcagcatcacccggcagcaggagggggaggccagcagccaggacatgacagcccaggtgaccagccccagcggcaaggtggaggccgctgagatcgtggagggagaagattctgcctacagcgtgcgctttgtgccccaggagatgggcccccacacagtggccgtgaagtaccggggccagcacgtgcccggcagccccttccagttcaccgtgggccccctgggggagggcggggcccacaaggtgcgggccggcggcaccggcctggagcggggcgtggccggcgtgcctgctgagttcagcatctggacccgggaggccggggccggcggcctgagcattgctgtggagggccccagcaaggccgagatcgcctttgaggacaggaaggatggcagctgtggggtgtcctatgtggtgcaggagcccggggactatgaggtgtccatcaagttcaatgatgagcacatcccagacagcccctttgtggtgcctgtggccagcctgagtgatgatgcccggcggctgactgtgaccagcctgcaggagaccggcctgaaggtgaaccagcctgccagctttgctgtgcagctgaatggagcccggggcgtgattgatgcccgggtgcacaccccatctggagctgtggaggagtgctacgtgtctgagctggacagcgacaagcacaccatccgcttcatcccccatgaaaatggagtgcacagcattgatgtgaagttcaacggggcccacatccctggcagccccttcaagatccgggtgggggagcagagccaggccggggaccccggcctggtgtctgcctacggccctggcctggagggcggcaccactggagtgtcctctgagttcatcgtgaacaccctgaatgccggcagcggggccctgtctgtgaccattgatggccccagcaaggtgcagctggactgcagagaatgtcctgagggccacgtggtgacctacacccccatggcccctggcaactacctgattgccatcaagtatggaggcccccagcacatcgtgggcagccccttcaaggccaaggtgacaggcccccggctgagcggcggccacagcctgcacgagaccagcacagtgctggtggagaccgtgaccaagagcagcagcagccggggcagcagctacagcagcatccccaagttcagcagtgatgccagcaaggtggtgacccggggccctggcctgagccaggcctttgtgggccagaagaacagcttcaccgtggactgcagcaaggccggcaccaacatgatgatggtgggcgtgcacggccccaagaccccctgtgaggaggtgtatgtgaagcacatgggcaacagagtgtacaacgtgacctacacagtgaaggagaagggggactacatcctgattgtgaagtggggagatgaatctgtgcccggcagccccttcaaggtgaaggtgccctag

SEQ ID NO: 152557 - DNA, 264 bp, Artificial Sequence
  Description of Artificial Sequence: Synthetic coding sequence
atgcagctgtttgtgcgggcccaggagctgcacacctttgaggtgacaggccaggagaccgtggcccagatcaaggcccacgtggccagcctggagggcatcgcccctgaggaccaggtggtgctgctggccggggcccccctggaggatgaggccaccctgggccagtgtggggtggaggccctgaccaccctggaggtggccggccgcatgctgggcggcggccagacaggagaggaggaggaggaggacaggagcggctag

SEQ ID NO: 152558 - DNA, 228 bp, Artificial Sequence
  Description of Artificial Sequence: Synthetic coding sequence
atgcagctgtttgtgcgggcccaggagctgcacacctttgaggtgacaggccaggagaccgtggcccagatcaaggcccacgtggccagcctggagggcatcgcccctgaggaccaggtggtgctgctggccggggcccccctggaggatgaggccaccctgggccagtgtggggtggaggccctgaccaccctggaggtggccggccgcatgctgggcggggagtag

SEQ ID NO: 152559 - DNA, 297 bp, Artificial Sequence
  Description of Artificial Sequence: Synthetic coding sequence
atgcagctgtttgtgcgggcccaggagctgcacacctttgaggtgacaggccaggagaccgtggcccagatcaaggccctgaccaccctggaggtggccggccgcatgctgggcggcaaggtgcacggcagcctggcccgggccggcaaggtgcggggccagacccccaaggtggccaagcaggagaagaagaagaagaagacaggccgggccaagaggaggatgcagtacaacagaagatttgtgaatgtggtgcccaccttcggcaagaagaagggccccaatgccaacagctag

SEQ ID NO: 152560 - DNA, 330 bp, Artificial Sequence
  Description of Artificial Sequence: Synthetic coding sequence
atgcagctgtttgtgcgggcccaggagctgcacacctttgaggtgacaggccaggagaccgtggcccagatcaaggcccacgtggccagcctggagggcatcgcccctgaggaccaggtggtgctgctggccggggcccccctggaggatgaggccaccctgggccagtgtggggtggaggccctgaccaccctggaggtggccggccgcatgctgggcggcaaggtgcacggcagcctggcccgggccggcaaggtgcggggccagacccccaaggtggccaagcaggagaagaagaagaagaagacaggccgggccaagagaagatag

SEQ ID NO: 152561 - DNA, 402 bp, Artificial Sequence
  Description of Artificial Sequence: Synthetic coding sequence
atgcagctgtttgtgcgggcccaggagctgcacacctttgaggtgacaggccaggagaccgtggcccagatcaaggcccacgtggccagcctggagggcatcgcccctgaggaccaggtggtgctgctggccggggcccccctggaggatgaggccaccctgggccagtgtggggtggaggccctgaccaccctggaggtggccggccgcatgctgggcggcaaggtgcacggcagcctggcccgggccggcaaggtgcggggccagacccccaaggtggccaagcaggagaagaagaagaagaagacaggccgggccaagaggaggatgcagtacaacagaagatttgtgaatgtggtgcccaccttcggcaagaagaagggccccaatgccaacagctag

SEQ ID NO: 152562 - DNA, 228 bp, Artificial Sequence; identical to SEQ ID NO: 152558
  Description of Artificial Sequence: Synthetic coding sequence

SEQ ID NO: 152563 - DNA, 402 bp, Artificial Sequence; identical to SEQ ID NO: 152561
  Description of Artificial Sequence: Synthetic coding sequence

SEQ ID NO: 152564 - DNA, 402 bp, Artificial Sequence; identical to SEQ ID NO: 152561
  Description of Artificial Sequence: Synthetic coding sequence

SEQ ID NO: 152565 - DNA, 1563 bp, Artificial Sequence
  Description of Artificial Sequence: Synthetic coding sequence
atgtctgctggggaggtggagcggctggtgtctgagctgagcggcggcactggaggagatgaggaggaggagtggctgtatggagatgaaaatgaggtggagaggcctgaggaggagaatgccagcgccaaccccccatctggaattgaagatgaaacagcagaaaatggagtgcccaagcccaaggtgacagaaacagaagatgacagcgacagcgacagtgatgatgatgaagatgatgtgcacgtgaccatcggggacatcaagacaggagccccccagtatggcagctatggaacagcccctgtgaacctgaacatcaagacaggaggccgggtgtatggcaccaccggcaccaaggtgaagggcgtggacctggatgcccctggcagcatcaatggagtgcccctgctggaggtggacctggacagctttgaggacaagccctggaggaagccaggagctgacctgagtgactacttcaactacggcttcaatgaagacacctggaaggcctactgtgagaagcagaagaggatccgcatgggcctggaggtgattcctgtgaccagcaccaccaacaagatcaccgtgcagcagggccgcactggaaacagcgagaaggagacagccctgcccagcaccaaggccgagttcaccagcccccccagcctcttcaagacaggcctgccccccagccggcggctgcccggggccattgatgtgattggccagaccatcaccatcagccgggtggagggcagaagaagagccaatgaaaacagcaacatccaggtgctgtctgagaggtctgccacagaggtggacaacaacttcagcaagcccccacccttcttccccccaggggccccacccacccacctgcccccaccacccttcctgcccccaccacccaccgtgtccacagcccctcctctcatccccccacctggcttccccccacctcctggggcccccccacccagcctcatccccaccatcgagagcggccacagcagcggctatgacagccgcagcgcccgggccttcccctatggaaatgtggccttcccccacctgcccggcagcgcccccagctggcccagcctggtggacaccagcaagcagtgggactactatgcccggcgggagaaggaccgggaccgggagcgggaccgggaccgggagcgggaccgggaccgggaccgggagcgggagaggacccgggagcgggagcgggagcgggaccacagccccacccccagcgtcttcaacagtgatgaggagcgctaccgctaccgggagtatgcagagcggggctatgagcggcaccgggccagccgggagaaggaggagcggcaccgggagaggaggcaccgggagaaggaggagaccaggcacaagagcagccgcagcaacagcagaagaagacatgagagcgaggagggggacagccacagaagacacaagcacaagaagagcaagaggagcaaggagggcaaggaggccggcagcgagcccgcccctgagcaggagagcacagaggccaccccagctgagtag

SEQ ID NO: 152566 - DNA, 1785 bp, Artificial Sequence
  Description of Artificial Sequence: Synthetic coding sequence
atgtctgctggggaggtggagcggctggtgtctgagctgagcggcggcactggaggagatgaggaggaggagtggctgtatggaggcccctgggatgtgcacgtgcacagcgacctggccaaggacctggatgaaaatgaggtggagaggcctgaggaggagaatgccagcgccaacccccccagcggcattgaagatgaaacagcagaaaatggagtgcccaagcccaaggtgacagaaacagaagatgacagcgacagcgacagtgatgatgatgaagatgatgtgcacgtgaccatcggggacatcaagacaggagccccccagtatggcagctatggaacagcccctgtgaacctgaacatcaagacaggaggccgggtgtatggcaccaccggcaccaaggtgaagggcgtggacctggatgcccctggcagcatcaacggggtgcccctgctggaggtggacctggacagctttgaggacaagccctggaggaagccaggagctgacctgagtgactacttcaactacggcttcaatgaagacacctggaaggcctactgtgagaagcagaagaggatccgcatgggcctggaggtgattcctgtgaccagcaccaccaacaagatcacagctgaggactgcaccatggaggtgaccccaggagctgagatccaggacggccgcttcaacctcttcaaggtgcagcagggccgcactggaaacagcgagaaggagacagccctgcccagcaccaaggccgagttcaccagcccccccagcctcttcaagacaggcctgccccccagcaggaacagcaccagcagccagagccagaccagcacagccagcaggaaggccaacagctctgtgggcaagtggcaggacagatatggccgggcagagagcccagacctgcggcggctgcccggggccattgatgtgattggccagaccatcaccatcagccgggtggagggcagaagaagagccaatgaaaacagcaacatccaggtgctgtctgagaggtctgccacagaggtggacaacaacttcagcaagcccccacccttcttccccccaggggccccacccacccacctgcccccaccacccttcctgcccccaccacccaccgtgtccacagcccctcctctcatccccccacctggcttccccccacctcctggggcccccccacccagcctcatccccaccatcgagagcggccacagcagcggctatgacagccgcagcgcccgggccttcccctatggaaatgtggccttcccccacctgcccggcagcgcccccagctggcccagcctggtggacaccagcaagcagtgggactactatgcccggcgggagaaggaccgggaccgggagcgggaccgggaccgggagcgggaccgggaccgggaccgggagcgggagaggacccgggagcgggagcgggagcgggaccacagccccacccccagcgtcttcaacagtgatgaggagcgctaccgctaccgggagtatgcagagcggggctatgagcggcaccgggccagccgggagaaggaggagcggcaccgggagaggaggcaccgggagaaggaggagaccaggcacaagagcagccgcagcaacagcagaagaagacatgagagcgaggagggggacagccacagaagacacaagcacaagaagagcaagaggagcaaggagggcaaggaggccggcagcgagcccgcccctgagcaggagagcacagaggccaccccagctgagtag

SEQ ID NO: 152567 - DNA, 1767 bp, Artificial Sequence
  Description of Artificial Sequence: Synthetic coding sequence
atgtctgctggggaggtggagcggctggtgtctgagctgagcggcggcactggaggagatgaggaggaggagtggctgtatggagatgaaaatgaggtggagaggcctgaggaggagaatgccagcgccaaccccccatctggaattgaagatgaaacagcagaaaatggagtgcccaagcccaaggtgacagaaacagaagatgacagcgacagcgacagtgatgatgatgaagatgatgtgcacgtgaccatcggggacatcaagacaggagccccccagtatggcagctatggaacagcccctgtgaacctgaacatcaagacaggaggccgggtgtatggcaccaccggcaccaaggtgaagggcgtggacctggatgcccctggcagcatcaatggagtgcccctgctggaggtggacctggacagctttgaggacaagccctggaggaagccaggagctgacctgagtgactacttcaactacggcttcaatgaagacacctggaaggcctactgtgagaagcagaagaggatccgcatgggcctggaggtgattcctgtgaccagcaccaccaacaagatcacagctgaggactgcaccatggaggtgaccccaggagctgagatccaggacggccgcttcaacctcttcaaggtgcagcagggccgcacaggcaacagcgagaaggagacagccctgcccagcaccaaggccgagttcaccagcccccccagcctcttcaagacaggcctgccccccagcaggaacagcaccagcagccagagccagaccagcacagccagcaggaaggccaacagctctgtgggcaagtggcaggacagatatggccgggcagagagcccagacctgcggcggctgcccggggccattgatgtgattggccagaccatcaccatcagccgggtggagggcagaagaagagccaatgaaaacagcaacatccaggtgctgtctgagaggtctgccacagaggtggacaacaacttcagcaagcccccacccttcttccccccaggggccccacccacccacctgcccccaccacccttcctgcccccaccacccaccgtgtccacagccccacccctcatccccccacctggcatccccatcaccgtgcccccacctggcttccccccacctcctggggcccccccacccagcctcatccccaccatcgagagcggccacagcagcggctatgacagccgcagcgcccgggccttcccctatggaaatgtggccttcccccacctgcccggcagcgcccccagctggcccagcctggtggacaccagcaagcagtgggactactatgcccggcgggagaaggaccgggaccgggagcgggaccgggaccgggagcgggaccgggaccgggaccgggagcgggagaggacccgggagcgggagcgggagcgggaccacagccccacccccagcgtcttcaacagtgatgaggagcgctaccgctaccgggagtatgcagagcggggctatgagcggcaccgggccagccgggagaaggaggagcggcaccgggagaggaggcaccgggagaaggaggagaccaggcacaagagcagccgcagcaacagcagaagaagacatgagagcgaggagggggacagccacagaagacacaagcacaagaagagcaagaggagcaaggagggcaaggaggccggcagcgagcccgcccctgagcaggagagcacagaggccaccccagctgagtag

SEQ ID NO: 152568 - DNA, 366 bp, Artificial Sequence
  Description of Artificial Sequence: Synthetic coding sequence
atggtggacatgatggacctgcccaggagccgcatcaatgccggcatgctggcccagttcatcgacaagcctgtgtgctttgtgggccgcctggagaagatccaccccaccgggaagatgttcatcctgagtgatggagagggcaagaatggcaccatcgagctgatggagcccctggatgaggagatcagcggcatcgtggaggtggtgggccgggtgacagccaaggccaccatcctgtgcaccagctatgtgcagttcaaggaggacagccacccctttgacctgggcctgtacaatgaggccgtgaagatcatccatgacttcccccagttctaccccctgggcatcgtgcagcacgactag

SEQ ID NO: 152569 - DNA, 1413 bp, Artificial Sequence
  Description of Artificial Sequence: Synthetic coding sequence
atgtttcctgctggcccccccagccacagcctgctgcggctgcccctgctgcagctgctgctgctggtggtgcaggccgtgggccggggcctgggccgggccagccctgctgggggccccctggaggatgtggtgattgaaagataccacatcccccgggcctgcccccgggaggtgcagatgggagactttgtgcgctaccactacaacggcacctttgaagatggcaagaagtttgacagcagctatgacaggaacaccctggtggccatcgtggtgggcgtgggccgcctcatcaccggcatggaccggggcctgatgggcatgtgtgtgaatgaaagaagaagactcatcgtgcccccccacctgggctacggcagcatcggcctggccggcctcatccccccagatgccaccctgtactttgatgtggtgctgctggatgtgtggaacaaggaggacacagtgcaggtgtccaccctgctgcggcccccccactgccccaggatggtgcaggatggagactttgtgcgctaccactacaacggcaccctgctggatggcaccagctttgacaccagctacagcaggaaccacacctacaacacctacatcggccagggctacatcatccctggcatggaccagggcctgcagggcgcctgcatgggagagcggcggcgcatcaccatccccccccacctggcctatggagaaaatggcaccggggacaagatccctggcagcgctgtgctgatcttcaacgtgcacgtgattgacttccacaacccagcagatgtggtggagatccgcaccctgagccggcccagcgagacctgcaatgagaccaccaagctgggggactttgtgcgctaccactacaactgcagcctgctggatggcacccagctgttcaccagccatgactatggagccccccaggaggccaccctgggcgccaacaaggtgattgagggcctggacaccggcctgcagggcatgtgtgtgggggagcggcggcagctgattgtgcccccccacctggcccacggggagagcggggcccggggcgtgcccggcagcgctgtgctgctgtttgaggtggagctggtgtcccgggaggatggcctgcccaccggctacctgtttgtgtggcacaaggaccccccagccaacctgtttgaggacatggacctgaacaaggatggagaggtgcccccagaggagttcagcaccttcatcaaggcccaggtgtctgagggcaagggccgcctgatgcctggccaggaccctgagaagaccatcggggacatgttccagaaccaggacaggaaccaggacggcaagatcaccgtggatgagctgaagctgaagagtgatgaagatgaggagcgggtgcatgaggagctgtag

SEQ ID NO: 152570 - DNA, 1749 bp, Artificial Sequence
  Description of Artificial Sequence: Synthetic coding sequence
atgtttcctgctggcccccccagccacagcctgctgcggctgcccctgctgcagctgctgctgctggtggtgcaggccgtgggccggggcctgggccgggccagccctgctgggggccccctggaggatgtggtgattgaaagataccacatcccccgggcctgcccccgggaggtgcagatgggagactttgtgcgctaccactacaacggcacctttgaagatggcaagaagtttgacagcagctatgacaggaacaccctggtggccatcgtggtgggcgtgggccgcctcatcaccggcatggaccggggcctgatgggcatgtgtgtgaatgaaagaagaagactcatcgtgcccccccacctgggctacggcagcatcggcctggccggcctcatccccccagatgccaccctgtactttgatgtggtgctgctggatgtgtggaacaaggaggacacagtgcaggtgtccaccctgctgcggcccccccactgccccaggatggtgcaggatggagactttgtgcgctaccactacaacggcaccctgctggatggcaccagctttgacaccagctacagcaaaggaggcacctatgacacctacgtgggcagcggctggctgatcaagggcatggaccagggcctgctgggcatgtgccctggagagaggaggaagatcatcatcccccccttcctggcctatggagagaagggctacggcaccgtcatccccccccaggccagcctggtgttccacgtgctgctgattgatgtgcacaaccccaaggatgctgtgcagctggagaccctggagctgcccccaggctgtgtgagaagagctggagctggggacttcatgagataccactacaacggcagcctgatggatggcaccctgtttgacagcagctacagcaggaaccacacctacaacacctacatcggccagggctacatcatccctggcatggaccagggcctgcagggcgcctgcatgggagagcggcggcgcatcaccatccccccccacctggcctatggagaaaatggcaccggggacaagatccctggcagcgctgtgctgatcttcaacgtgcacgtgattgacttccacaacccagcagatgtggtggagatccgcaccctgagccggcccagcgagacctgcaatgagaccaccaagctgggggactttgtgcgctaccactacaactgcagcctgctggatggcacccagctgttcaccagccatgactatggagccccccaggaggccaccctgggcgccaacaaggtgattgagggcctggacaccggcctgcagggcatgtgtgtgggggagcggcggcagctgattgtgcccccccacctggcccacggggagagcggggcccggggcgtgcccggcagcgctgtgctgctgtttgaggtggagctggtgtcccgggaggatggcctgcccaccggctacctgtttgtgtggcacaaggaccccccagccaacctgtttgaggacatggacctgaacaaggatggagaggtgcccccagaggagttcagcaccttcatcaaggcccaggtgtctgagggcaagggccgcctgatgcctggccaggaccctgagaagaccatcggggacatgttccagaaccaggacaggaaccaggacggcaagatcaccgtggatgagctgaagctgaagagtgatgaagatgaggagcgggtgcatgaggagctgtag

SEQ ID NO: 152571 - DNA, 1629 bp, Artificial Sequence
  Description of Artificial Sequence: Synthetic coding sequence
atgtttcctgctggcccccccagccacagcctgctgcggctgcccctgctgcagctgctgctgctggtggtgcaggccgtgggccggggcctgggccgggccagccctgctgggggccccctggaggatgtggtgattgaaagataccacatcccccgggcctgcccccgggaggtgcagatgggagactttgtgcgctaccactacaacggcacctttgaagatggcaagaagtttgacagcagctatgacaggaacaccctggtggccatcgtggtgggcgtgggccgcctcatcaccggcatggaccggggcctgatgggcatgtgtgtgaatgaaagaagaagactcatcgtgcccccccacctgggctacggcagcatcggcctggccggcctcatccccccagatgccaccctgtactttgatgtggtgctgctggatgtgtggaacaaggaggacacagtgcaggtgtccaccctgctgcggcccccccactgccccaggatggtgcaggatggagactttgtgcgctaccactacaacggcaccctgctggatggcaccagctttgacaccagctacagcaaaggaggcacctatgacacctacgtgggcagcggctggctgatcaagggcatggaccagggcctgctgggcatgtgccctggagagaggaggaagatcatcatcccccccttcctggcctatggagagaagggctacggcaccgtcatccccccccaggccagcctggtgttccacgtgctgctgattgatgtgcacaaccccaaggatgctgtgcagctggagaccctggagctgcccccaggctgtgtgagaagagctggagctggggacttcatgagataccactacaacggcagcctgatggatggcaccctgtttgacagcagctacagcaggaaccacacctacaacacctacatcggccagggctacatcatccctggcatggaccagggcctgcagggcgcctgcatgggagagcggcggcgcatcaccatccccccccacctggcctatggagaaaatggcaccggggacaagatccctggcagcgctgtgctgatcttcaacgtgcacgtgattgacttccacaacccagcagatgtggtggagatccgcaccctgagccggcccagcgagacctgcaatgagaccaccaagctgggggactttgtgcgctaccactacaactgcagcctgctggatggcacccagctgttcaccagccatgactatggagccccccaggaggccaccctgggcgccaacaaggtgattgagggcctggacaccggcctgcagggcatgtgtgtgggggagcggcggcagctgattgtgcccccccacctggcccacggggagagcggggcccggggcgtgcccggcagcgctgtgctgctgtttgaggtggagctggtgtcccgggaggatggcctgcccaccggctacctgtttgtgtggcacaaggaccccccagccaacctgtttgaggacatggacctgaacaaggatggagaggtgcccccagaggagttcagcaccttcatcaaggcccaggtgtctgagggcaagggcccccacgcctgggccggcccctag

SEQ ID NO: 152572 - DNA, 246 bp, Artificial Sequence
  Description of Artificial Sequence: Synthetic coding sequence
atgggagactttgtgcgctaccactacaacggcacctttgaagatggcaagaagtttgacagcagctatgacaggaacaccctggtggccatcgtggtgggcgtgggccgcctcatcaccggcatggaccggggcctgatgggcatgtgtgtgaatgaaagaagaagactcatcgtgcccccccacctgggctacggcagcatcggcctggccggcctcatccccccagatgccaccctgtactag

SEQ ID NO: 152573 - DNA, 1161 bp, Artificial Sequence
  Description of Artificial Sequence: Synthetic coding sequence
tgaattgatgtgcacaaccccaaggatgctgtgcagctggagaccctggagctgcccccaggctgtgtgcggcgggccggggccggggacttcatgagataccactacaacggcagcctgatggatggcaccctgtttgacagcagctacagcaggaaccacacctacaacacctacatcggccagggctacatcatccctggcatggaccagggcctgcagggcgcctgcatgggagagcggcggcgcatcaccatccccccccacctggcctacggggagaatggaacagacagcatcggcttcctgcagggcagcgcccccctgcggcccttccgcagcggggagggccagcccagcctgggccgggagggcggctacggcaagacagagcccgcctacccccaggaccctgctgtgctgggcgcctctgtgagcagccctgtgaagtgggccagccatgctgacccccagggcgacaagatccctggcagcgctgtgctgatcttcaacgtgcacgtgattgacttccacaacccagcagatgtggtggagatccgcaccctgagccggcccagcgagacctgcaatgagaccaccaagctgggggactttgtgcgctaccactacaactgcagcctgctggatggcacccagctgttcaccagccatgactatggagccccccaggaggccaccctgggcgccaacaaggtgattgagggcctggacaccggcctgcagggcatgtgtgtgggggagcggcggcagctgattgtgcccccccacctggcccacggggagagcggggcccggggcgtgcccggcagcgctgtgctgctgtttgaggtggagctggtgtcccgggaggatggcctgcccaccggctacctgtttgtgtggcacaaggaccccccagccaacctgtttgaggacatggacctgaacaaggatggagaggtgcccccagaggagttcagcaccttcatcaaggcccaggtgtctgagggcaagggccgcctgatgcctggccaggaccctgagaagaccatcggggacatgttccagaaccaggacaggaaccaggacggcaagatcaccgtggatgagctgaagctgaagagtgatgaagatgaggagcgggtgcatgaggagctgtag

SEQ ID NO: 152574 - DNA, 1068 bp, Artificial Sequence
  Description of Artificial Sequence: Synthetic coding sequence
atgagataccactacaacggcagcctgatggatggcaccctgtttgacagcagctacagcaggaaccacacctacaacacctacatcggccagggctacatcatccctggcatggaccagggcctgcagggcgcctgcatgggagagcggcggcgcatcaccatccccccccacctggcctatggagaaaatggaacagacagcatcggcttcctgcagggcagcgcccccctgcggcccttccgctctggagagggccagcccagcctgggccgggagggcggctacggcaagacagagcccgcctacccccaggaccctgctgtgctgggcgcctctgtgagcagccctgtgaagtgggccagccacgccgacccccagggcgacaagatccctggcagcgctgtgctgatcttcaacgtgcacgtgattgacttccacaacccagcagatgtggtggagatccgcaccctgagccggcccagcgagacctgcaatgagaccaccaagctgggggactttgtgcgctaccactacaactgcagcctgctggatggcacccagctgttcaccagccatgactatggagccccccaggaggccaccctgggcgccaacaaggtgattgagggcctggacaccggcctgcagggcatgtgtgtgggggagcggcggcagctgattgtgcccccccacctggcccatggagagagcggggcccggggcgtgcccggcagcgctgtgctgctgtttgaggtggagctggtgtccagagaagatggcctgcccaccggctacctgtttgtgtggcacaaggaccccccagccaacctgtttgaggacatggacctgaacaaggatggagaggtgcccccagaggagttcagcaccttcatcaaggcccaggtgtctgagggcaagggccgcctgatgcctggccaggaccctgagaagaccatcggggacatgttccagaaccaggacaggaaccaggacggcaagatcaccgtggatgagctgaagctgaagagtgatgaagatgaggagcgggtgcatgaggagctgtag

SEQ ID NO: 152575 - DNA, 327 bp, Artificial Sequence
  Description of Artificial Sequence: Synthetic coding sequence
atgggcgtggagattgagaccatcagccctggagatggccgcaccttccccaagaagggccagacctgtgtggtgcactacacaggcatgctgcagaatggcaagaagtttgacagcagccgggacaggaacaagcccttcaagttcagaattggcaagcaggaggtgatcaagggctttgaggagggcgccgcccagatgagcctgggccagagggccaagctgacctgcaccccagatgtggcctatggagccaccggccaccctggggtcatccccccaaatgccaccctcatctttgatgtggagctgctgaacctggagtag

SEQ ID NO: 152576 - DNA, 243 bp, Artificial Sequence
  Description of Artificial Sequence: Synthetic coding sequence
atgggcgtggagattgagaccatcagccctggagatggccgcaccttccccaagaagggccagacctgtgtggtgcactacacaggcatgctgcagaatggcaagaagtttgacagcagccgggacaggaacaagcccttcaagttcagaattggcaagcaggaggtgatcaagggctttgaggagggcgccgcccagctgggccccctgagccccctgcccatctgcccccacccctgctag

SEQ ID NO: 152577 - DNA, 429 bp, Artificial Sequence
  Description of Artificial Sequence: Synthetic coding sequence
atgaggctgtcctggttccgggtgctgactgtgctgagcatctgcctgtctgctgtggccacagccactggagctgagggcaagaggaagctgcagattggagtgaagaagagggtggaccactgccccatcaagagcaggaaaggagatgtgctgcacatgcactacacaggcaagctggaggatggaacagaatttgacagcagcctgccccagaaccagccctttgtgttcagcctgggcaccggccaggtgatcaagggctgggaccagggcctgctgggcatgtgtgagggggagaagaggaagctggtgatccccagcgagctgggctacggggagcggggggccccacccaagatccctgggggcgccaccctggtgtttgaggtggagctgctgaagattgaaagaagaacagagctgtag

SEQ ID NO: 152578 - DNA, 429 bp, Artificial Sequence; identical to SEQ ID NO: 152577
  Description of Artificial Sequence: Synthetic coding sequence

SEQ ID NO: 152579 - DNA, 429 bp, Artificial Sequence; identical to SEQ ID NO: 152577
  Description of Artificial Sequence: Synthetic coding sequence

SEQ ID NO: 152580 - DNA, 309 bp, Artificial Sequence
  Description of Artificial Sequence: Synthetic coding sequence
atgaggctgtcctggttccgggtgctgactgtgctgagcatctgcctgtctgctgtggccacagccactggagctgagggcaagaggaagctgcagattggagtgaagaagagggtggaccactgccccatcaagagcaggaaaggagatgtgctgcacatgcactacacaggcaagctggaggatggaacagaatttgacagcagcctgccccagaaccagccctttgtgttcagcctgggcaccggccaggtgatcaagggctgggaccagggcctgctgggcatgtgtgagggggagaagaggtag

SEQ ID NO: 152581 - DNA, 3144 bp, Artificial Sequence
  Description of Artificial Sequence: Synthetic coding sequence
atggctgtgaccctggacaaggatgcctactaccgccgggtgaagaggctgtacagcaactggaggaaaggagaagatgaatatgccaacgtggatgccatcgtggtgtctgtgggcgtggatgaggagatcgtgtatgccaagagcacagccctgcagacctggctgtttggctatgagctgacagacaccatcatggtgttctgtgatgacaagatcatcttcatggccagcaagaagaaggtggagttcctgaagcagatcgccaacaccaagggaaatgaaaatgccaacggggccccagccatcaccctgctgatccgggagaagaatgaaagcaacaagagcagctttgacaagatgattgaggccatcaaggagagcaagaatggcaagaagattggagtcttcagcaaggacaagtttcctggagagttcatgaagtcctggaatgactgcctgaacaaggagggctttgacaagattgacatctctgctgtggtggcctacaccatcgctgtgaaggaggatggagagctgaacctgatgaagaaggccgccagcatcaccagcgaggtgttcaacaagttcttcaaggagcgggtgatggagatcgtggatgctgatgagaaggtgcgccacagcaagctggccgagagcgtggagaaggccatcgaggagaagaagtacctggccggggctgaccccagcacagtggagatgtgctacccacccatcatccagagcggcggcaactacaacctgaagttctctgtggtgtctgacaagaaccacatgcactttggagccatcacctgtgccatgggcatccgcttcaagagctactgcagcaacctggtgaggaccctgatggtggaccccagccaggaggtgcaggagaactacaacttcctgctgcagctgcaggaggagctgctgaaggagctgcggcatggagtgaagatctgtgatgtgtacaatgctgtgatggatgtggtgaagaagcagaagccagagctgctgaacaagatcaccaagaacctgggcttcggcatgggcatcgagttccgggagggcagcctggtgatcaacagcaagaaccagtacaagctgaagaagggcatggtgttcagcatcaacctgggcttcagtgacctgaccaacaaggagggcaagaagccagaggagaagacctacgccctcttcatcggggacacagtgctggtggatgaagatggccctgccaccgtgctgacctctgtgaagaagaaggtgaagaatgtgggcatcttcctgaagaatgaagatgaggaggaggaggaggaggagaaggatgaagctgaggacctgctgggccggggcagcagagctgccctgctgacagagaggaccagaaatgagatgacagctgaggagaagaggcgggcccaccagaaggagctggccgcccagctgaatgaggaggccaagaggcggctgacagagcagaagggggagcagcagatccagaaggccaggaagagcaatgtgtcctacaagaaccccagcctgatgcccaaggagccccacatccgggagatgaagatctacatcgacaagaagtatgaaacagtcatcatgcctgtgtttggaattgccacccccttccacatcgccaccatcaagaacatctccatgtctgtggagggggactacacctacctgcgcatcaacttctactgccccggcagcgccctgggcagaaatgaaggcaacatcttccccaaccctgaggccacctttgtgaaggagatcacctaccgggccagcaacatcaaggcccctggagagcagacagtgcctgccctgaacctgcagaatgccttccgcatcatcaaggaggtgcagaagcgctacaagacccgggaggccgaggagaaggagaaggagggcatcgtgaagcaggacagcctggtgatcaacctgaacagaagcaaccccaagctgaaggacctgtacatccggcccaacatcgcccagaagaggatgcagggcagcctggaggcccacgtgaatggcttccgcttcacctctgtgcggggggacaaggtggacatcctgtacaacaacatcaagcacgccctcttccagccctgtgatggagagatgatcatcgtgctgcacttccacctgaagaatgccatcatgtttgggaagaagaggcacacagatgtgcagttctacacagaggtgggggagatcaccacagacctgggcaagcaccagcacatgcatgacagagatgacctgtatgcagagcagatggagcgggagatgaggcacaagctgaagacagccttcaagaacttcatcgagaaggtggaggccctgaccaaggaggagctggagtttgaggtgcccttccgggacctgggcttcaatggagccccctaccgcagcacctgcctgctgcagcccaccagcagcgccctggtgaatgccacagagtggcccccatttgtggtgaccctggatgaggtggagctgatccactttgagcgggtgcagttccacctgaagaactttgacatggtgattgtgtacaaggactacagcaagaaggtgaccatgatcaatgccatccctgtggccagcctggaccccatcaaggagtggctgaacagctgtgacctgaagtacacagagggcgtgcagagcctgaactggaccaagatcatgaagaccatcgtggatgatcctgagggcttctttgagcagggcggctggagcttcctggagcctgagggggagggcagtgatgctgaggagggggacagcgagagcgagattgaagatgagaccttcaaccccagtgaagatgattatgaggaggaggaggaggacagtgatgaggactacagcagcgaggccgaggagagtgactacagcaaggagagcctgggcagcgaggaggagagcggcaaggactgggatgagctggaggaggaggccaggaaggctgaccgggagagccgctatgaggaggaggaggagcagagccgctccatgagcaggaagaggaaggcctctgtgcacagcagcggccggggcagcaacagaggcagccgccacagcagcgccccacccaagaagaagaggaagtag

SEQ ID NO: 152582 - DNA, 675 bp, Artificial Sequence; identical to SEQ ID NO: 146524
  Description of Artificial Sequence: Synthetic coding sequence

SEQ ID NO: 152583 - DNA, 1374 bp, Artificial Sequence
  Description of Artificial Sequence: Synthetic coding sequence
atgaccacagatgagggcgccaagaacaatgaggagagccccacagccaccgtggccgagcagggcgaggacatcaccagcaagaaggaccggggcgtgctgaagatcgtgaagagggtgggcaatggagaggagacccccatgattggagacaaggtgtatgtgcactacaagggcaagctgagcaatggcaagaagtttgacagcagccatgacagaaatgagccctttgtgttcagcctgggcaagggccaggtgatcaaggcctgggacatcggcgtggccaccatgaagaagggggagatctgccacctgctgtgcaagccagaatatgcctacggcagcgctggcagcctgcccaagatccccagcaatgccaccctcttctttgaaattgagctgctggacttcaagggggaggacctgtttgaagatggcggcatcatccggaggaccaagaggaaaggagagggctacagcaaccccaatgaaggagccaccgtggagatccacctggagggccgctgtggcggccgcatgtttgactgcagagatgtggccttcaccgtgggggagggggaggaccatgacatccccatcggcatcgacaaggccctggagaagatgcagcgggaggagcagtgcatcctgtacctgggccccaggtatggctttggagaggccggcaagcccaagtttggaattgagcccaatgctgagctgatctatgaggtgaccctgaagagctttgagaaggccaaggagagctgggagatggacaccaaggagaagctggagcaggccgccatcgtgaaggagaagggcaccgtgtacttcaagggcggcaagtacatgcaggccgtcatccagtatggcaagatcgtgtcctggctggagatggagtatggcctgtctgagaaggagagcaaggccagcgagagcttcctgctggccgccttcctgaacctggccatgtgctacctgaagctgcgggagtacaccaaggctgtggagtgctgtgacaaggccctgggcctggacagcgccaatgagaagggcctgtaccgccgcggggaggcccagctgctgatgaatgaatttgaaagtgccaagggggactttgagaaggtgctggaggtgaacccccagaacaaggccgcccggctgcagatctccatgtgccagaagaaggccaaggagcacaatgaaagagaccggcgcatctatgccaacatgttcaagaagtttgctgagcaggatgccaaggaggaggccaacaaggccatgggcaagaagaccagcgagggcgtgaccaatgaaaaaggaacagacagccaggccatggaggaggagaagccagagggccacgtgtag

SEQ ID NO: 152584 - DNA, 1374 bp, Artificial Sequence; identical to SEQ ID NO: 152583
  Description of Artificial Sequence: Synthetic coding sequence

SEQ ID NO: 152585 - DNA, 801 bp, Artificial Sequence
  Description of Artificial Sequence: Synthetic coding sequence
ctgctgatgaaggtgcccaggaccatgaagaaggccccccagcccctgctgctgagccgggagcgcatcctgccccccaaggaccggggcgtgctgaagatcgtgaagagggtgggcaatggagaggagacccccatgattggagacaaggtgtatgtgcactacaagggcaagctgagcaatggcaagaagtttgacagcagccatgacagaaatgagccctttgtgttcagcctgggcaagggccaggtgatcaaggcctgggacatcggcgtggccaccatgaagaagggggagatctgccacctgctgtgcaagccagaatatgcctacggcagcgctggcagcctgcccaagatccccagcaatgccaccctcttctttgaaattgagctgctggacttcaagggggaggacctgtttgaagatggcggcatcatccggaggaccaagaggaaaggagagggctacagcaaccccaatgaaggagccaccgtggagatccacctggagggccgctgtggcggccgcatgtttgactgcagagatgtggccttcaccgtgggggagggggaggaccatgacatccccatcggcatcgacaaggccctggagaagatgcagcgggaggagcagtgcatcctgtacctgggcccccggcccaagaaccctggccgctggatccccaagaagaactggagccggctgcccctgagcaagagaagagagccctacaccagccgctgtgtgagcccctatgccatcctgagcatcagcaagaacctcttcaagtgctggtag

SEQ ID NO: 152586 - DNA, 1374 bp, Artificial Sequence; identical to SEQ ID NO: 152583
  Description of Artificial Sequence: Synthetic coding sequence

SEQ ID NO: 152587 - DNA, 1374 bp, Artificial Sequence; identical to SEQ ID NO: 152583
  Description of Artificial Sequence: Synthetic coding sequence

SEQ ID NO: 152588 - DNA, 837 bp, Artificial Sequence
  Description of Artificial Sequence: Synthetic coding sequence
atgtttgactgcagagatgtggccttcaccgtgggggagggagaagatcatgacatccccatcggcatcgacaaggccctggagaagatgcagcgggaggagcagtgcatcctgtacctgggccccaggtatggctttggagaggccggcaagcccaagtttggcatcgagcccaatgctgagctgatctatgaggtgaccctgaagagctttgagaaggccaaggagagctgggagatggacaccaaggagaagctggagcaggccgccatcgtgaaggagaagggcaccgtgtacttcaagggcggcaagtacatgcaggccgtcatccagtatggcaagatcgtgtcctggctggagatggagtatggcctgtctgagaaggagagcaaggccagcgagagcttcctgctggccgccttcctgaacctggccatgtgctacctgaagctgcgggagtacaccaaggctgtggagtgctgtgacaaggccctgggcctggacagcgccaatgagaagggcctgtacagaagaggagaggcccagctgctgatgaatgaatttgagagcgccaagggggactttgagaaggtgctggaggtgaacccccagaacaaggccgcccggctgcagatctccatgtgccagaagaaggccaaggagcacaatgaaagagaccggcgcatctatgccaacatgttcaagaagtttgctgagcaggatgccaaggaggaggccaacaaggccatgggcaagaagaccagcgagggcgtgaccaatgagaagggcacagacagccaggccatggaggaggagaagccagagggccacgtgtag

SEQ ID NO: 152589 - DNA, 807 bp, Artificial Sequence
  Description of Artificial Sequence: Synthetic coding sequence
atgaccacagatgagggcgccaagaacaatgaggagagccccacagccaccgtggccgagcagggcgaggacatcaccagcaagaaggaccggggcgtgctgaagatcgtgaagagggtgggcaatggagaggagacccccatgattggagacaaggtgtatgtgcactacaagggcaagctgagcaatggcaagaagtttgacagcagccatgacagaaatgagccctttgtgttcagcctgggcaagggccaggtgatcaaggcctgggacatcggcgtggccaccatgaagaagggggagatctgccacctgctgtgcaagccagaatatgcctacggcagcgctggcagcctgcccaagatccccagcaatgccaccctcttctttgaaattgagctgctggacttcaagggggaggacctgtttgaagatggcggcatcatccggaggaccaagaggaaaggagagggctacagcaaccccaatgaaggagccaccgtggagatccacctggagggccgctgtggcggccgcatgtttgactgcagagatgtggccttcaccgtgggggagggggaggaccatgacatccccatcggcatcgacaaggccctggagaagatgcagcgggaggagcagtgcatcctgtacctgggcccccggcccaagaaccctggccgctggatccccaagaagaactggagccggctgcccctgagcaagagaagagagccctacaccagccgctgtgtgagcccctatgccatcctgagcatcagcaagaacctcttcaagtgctggtag

SEQ ID NO: 152590 - DNA, 1263 bp, Artificial Sequence
  Description of Artificial Sequence: Synthetic coding sequence
atgaccacagagcagggcgaggagacccccatgattggagacaaggtgtatgtgcactacaagggcaagctgagcaatggcaagaagtttgacagcagccatgacagaaatgagccctttgtgttcagcctgggcaagggccaggtgatcaaggcctgggacattggagtggccaccatgaagaagggggagatctgccacctgctgtgcaagccagaatatgcctacggcagcgctggcagcctgcccaagatccccagcaatgccaccctcttctttgaaattgagctgctggacttcaagggggaggacctgtttgaagatggcggcatcatccggaggaccaagaggaagggggagggctacagcaaccccaatgaaggagccaccgtggagatccacctggagggccgctgtggcggccgcatgtttgactgcagagatgtggccttcaccgtgggggagggagaagatcatgacatccccatcggcatcgacaaggccctggagaagatgcagcgggaggagcagtgcatcctgtacctgggccccaggtatggctttggagaggccggcaagcccaagtttggcatcgagcccaatgctgagctgatctatgaggtgaccctgaagagctttgagaaggccaaggagagctgggagatggacaccaaggagaagctggagcaggccgccatcgtgaaggagaagggcaccgtgtacttcaagggcggcaagtacatgcaggccgtcatccagtatggcaagatcgtgtcctggctggagatggagtatggcctgtctgagaaggagagcaaggccagcgagagcttcctgctggccgccttcctgaacctggccatgtgctacctgaagctgcgggagtacaccaaggctgtggagtgctgtgacaaggccctgggcctggacagcgccaatgagaagggcctgtacagaagaggagaggcccagctgctgatgaatgaatttgagagcgccaagggggactttgagaaggtgctggaggtgaacccccagaacaaggccgcccggctgcagatctccatgtgccagaagaaggccaaggagcacaatgaaagagaccggcgcatctatgccaacatgttcaagaagtttgctgagcaggatgccaaggaggaggccaacaaggccatgggcaagaagaccagcgagggcgtgaccaatgagaagggcacagacagccaggccatggaggaggagaagccagagggccacgtgtag

SEQ ID NO: 152591 - DNA, 984 bp, Artificial Sequence
  Description of Artificial Sequence: Synthetic coding sequence
atgggcggcagcgccctgaaccagggcgtgctggagggagatgatgcccctggccagagcctgtatgaaaggctgagccagaggatgctggacatcagcggggacagaggagtgctgaaggatgtgatccgggagggcgctggggacctggtggccccagatgcctctgtgctggtgaagtacagcggctacctggagcacatggaccggccctttgacagcaactacttcaggaagaccccccggctgatgaagctgggggaggacatcaccctgtggggcatggagctgggcctgctgtccatgagaagaggagagctggcccgcttcctgttcaagcccaactatgcctacggcaccctgggctgccccccactcatcccccccaacaccaccgtgctgtttgaaattgagctgctggacttcctggactgtgccgagagtgacaagttctgtgccctgtctgctgagcagcaggaccagttccccctgcagaaggtgctgaaggtggccgccacagagcgggagtttggaaactacctgttccggcagaaccgcttctatgatgccaaggtgcgctacaagagggccctgctgctgctgcggaggagaagtgcccctcctgaggagcagcacctggtggaggccgccaagctgcctgtgctgctgaacctgtccttcacctacctgaagctggaccggcccaccatcgccctgtgctatggagagcaggccctgatcatcgaccagaagaatgccaaggccctcttccgctgtggccaggcctgcctgctgctgacagagtaccagaaggcccgggacttcctggtgcgggcccagaaggagcagcccttcaaccacgacatcaacaatgagctgaagaagctggccagctgctacagagattatgtggacaaggagaaggagatgtggcacaggatgtttgccccctgtggagatggcagcacagctggggagagctag

SEQ ID NO: 152592 - DNA, 969 bp, Artificial Sequence
  Description of Artificial Sequence: Synthetic coding sequence
atgtctgccagctcctggccccagaatggcatgccacccagcagcctgtatgagcggctgagccagaggatgctggacatcagcggggaccggggcgtgctgaaggatgtgatccgggagggcgctggggacctggtggccccagatgcctctgtgctggtgaagtacagcggctacctggagcacatggaccggccctttgacagcaactacttcaggaagaccccccggctgatgaagctgggggaggacatcaccctgtggggcatggagctgggcctgctgtccatgagaagaggagagctggcccgcttcctgttcaagcccaactatgcctacggcaccctgggctgccccccactcatcccccccaacaccaccgtgctgtttgaaattgagctgctggacttcctggactgtgccgagagtgacaagttctgtgccctgtctgctgagcagcaggaccagttccccctgcagaaggtgctgaaggtggccgccacagagcgggagtttggaaactacctgttccggcagaaccgcttctatgatgccaaggtgcgctacaagagggccctgctgctgctgcggcggcgcagcgcccctcctgaggagcagcacctggtggaggccgccaagctgcctgtgctgctgaacctgtccttcacctacctgaagctggaccggcccaccatcgccctgtgctacggggagcaggccctgatcatcgaccagaagaatgccaaggccctcttccgctgtggccaggcctgcctgctgctgacagagtaccagaaggcccgggacttcctggtgcgggcccagaaggagcagcccttcaaccacgacatcaacaatgagctgaagaagctggccagctgctacagagattatgtggacaaggagaaggagatgtggcacaggatgtttgccccctgtggagatggcagcacagctggggagagctag

SEQ ID NO: 152593 - DNA, 531 bp, Artificial Sequence
  Description of Artificial Sequence: Synthetic coding sequence
atggacctgcctgacagcgccagcagggtcttctgtggccgcatcctgtccatggtgaacacagatgatgtgaatgccatcatcctggcccagaagaacatgctggacagatttgagaagaccaatgagatgctgctgaacttcaacaacctgagcagcgcccggctgcagcagatgtctgagcgcttcctgcaccacaccaggaccctggtggagatgaagagggacctggacagcatcttccgccgcatccgcaccctgaagggcaagctggcccggcagcaccctgaggccttcagccacatccctgaggccagcttcctggaggaggaggatgaggaccccatcccccccagcaccaccaccaccatcgccaccagcgagcagagcacaggcagctgtgacaccagcccagacacagtgagccccagcctgagccctggctttgaggacctgagccacgtgcagcccggcagccctgccatcaatggccgcagccagacagatgatgaggagatgaccggggagtag

SEQ ID NO: 152594 - DNA, 1326 bp, Artificial Sequence
  Description of Artificial Sequence: Synthetic coding sequence
atgggcgtgggcgccggccgggtgtcccagagcggggcccccagccctgggggcgccggccgggccaacagctgcccccccagctccatggccagctgtgccgagcccagcgagcccagcgcccccctgcctgctggggtgccccccctggaggactttgaggtgctggatggagtggaggatgctgagggggaggaggaggaggaggaggaggaggaggaggaggatgacctgtctgagctgccccccctggaggacatgggccagcccccagctgaggaggccgagcagcccggggccctggcccgggagttcctggccgccatggagcctgagcccgccccagccccagcccctgaggagtggctggacatcctgggcaatggcctgctgaggaagaagaccctggtgcccggccccccaggcagcagcaggcctgtgaagggccaggtggtgacagtgcacctgcagaccagcctggagaatggcaccagggtgcaggaggagcctgagctggtgttcaccctgggggactgtgatgtgatccaggccctggacctgtctgtgcccctgatggatgtgggggagacagccatggtgacagctgacagcaagtactgctacggcccccagggccgcagcccctacatcccccctcatgctgccctgtgcctggaggtgaccctgaagacagctgtggatggccctgacctggagatgctgaccggccaggagcgggtggccctggccaacaggaagagagaatgtggaaatgcccactaccagagagctgactttgtgctggccgccaacagctatgacctggccatcaaggccatcaccagcagcgccaaggtggacatgacctttgaggaggaggcccagctgctgcagctgaaggtgaagtgcctgaacaacctggccgccagccagctgaagctggaccactacagagctgccctgcggagctgcagcctggtgctggagcaccagcctgacaacatcaaggccctcttcaggaagggcaaggtgctggcccagcagggcgagtacagcgaggccatccccatcctgcgggccgccctgaagctggagcccagcaacaagaccatccatgctgagctgagcaagctggtgaagaagcatgctgcccagaggagcacagaaacagccctgtacaggaagatgctgggcaaccccagccggctgcctgccaagtgccctgggaagggggcctggagcatcccctggaagtggctgtttggagccacagctgtggccctgggcggcgtggccctgtctgtggtgattgctgccaggaactag

SEQ ID NO: 152595 - DNA, 762 bp, Artificial Sequence
  Description of Artificial Sequence: Synthetic coding sequence
atggccagctgtgccgagcccagcgagcccagcgcccccctgcctgctggggtgccccccctggaggactttgaggtgctggatggagtggaggatgctgagggggaggaggaggaggaggaggaggaggaggaggaggatgacctgtctgagctgccccccctggaggacatgggccagcccccagctgaggaggccgagcagcccggggccctggcccgggagttcctggccgccatggagcctgagcccgccccagccccagcccctgaggagtggctggacatcctggtggacatgacctttgaggaggaggcccagctgctgcagctgaaggtgaagtgcctgaacaacctggccgccagccagctgaagctggaccactacagagctgccctgcggagctgcagcctggtgctggagcaccagcctgacaacatcaaggccctcttcaggaagggcaaggtgctggcccagcagggcgagtacagcgaggccatccccatcctgcgggccgccctgaagctggagcccagcaacaagaccatccatgctgagctgagcaagctggtgaagaagcatgctgcccagaggagcacagaaacagccctgtacaggaagatgctgggcaaccccagccggctgcctgccaagtgccctgggaagggggcctggagcatcccctggaagtggctgtttggagccacagctgtggccctgggcggcgtggccctgtctgtggtgattgctgccaggaactag

SEQ ID NO: 152596 - DNA, 1599 bp, Artificial Sequence
  Description of Artificial Sequence: Synthetic coding sequence
atggccaagagggtggccatcgtgggcgctggggtgtctggcctggccagcatcaagtgctgcctggaggagggcctggagcccacctgctttgagaggagtgatgacctgggcggcctgtggaggttcacagagcacgtggaggagggccgggccagcctgtacaagtctgtggtgagcaacagctgcaaggagatgagctgctacagcgacttccccttccctgaggactaccccaactacgtgcccaacagccagttcctggagtacctgaagatgtatgccaaccactttgacctgctgaagcacatccagttcaagaccaaggtgtgcagcgtgaccaagtgcagcgacagcgctgtgtctggccagtgggaggtggtgaccatgcatgaggagaagcaggagagcgccatctttgatgctgtgatggtgtgcaccggcttcctgaccaacccctacctgcccctggacagcttccctggcatcaatgccttcaagggccagtacttccacagccggcagtacaagcacccagacatcttcaaggacaagagggtgctggtgattggcatgggcaacagcggcacagacattgctgtggaggccagccacctggccgagaaggtgttcctgagcaccactggaggcggctgggtgatcagccgcatctttgattctggctacccctgggacatggtgttcatgacccgcttccagaacatgctgaggaacagcctgcccacccccatcgtgacctggctgatggagaggaagatcaacaactggctgaaccacgccaactacggcctcatccctgaggacaggacccagctgaaggagtttgtgctgaatgatgagctgcccggccgcatcatcaccgggaaggtgttcatccggcccagcatcaaggaggtgaaggagaacagcgtcatcttcaacaacaccagcaaggaggagcccatcgacatcatcgtgtttgccaccggctacacctttgccttccccttcctggatgaatctgtggtgaaggtggaggatggccaggccagcctgtacaagtacatcttccctgcccacctgcagaagcccaccctggccatcatcggcctcatcaagcccctgggctccatgatccccactggagagacccaggcccgctgggccgtgcgggtgctgaagggcgtgaacaagctgcccccaccttctgtgatgattgaggagatcaatgccaggaaggagaacaagcccagctggtttggcctgtgctactgcaaggccctgcagagcgactacatcacctacattgatgagctgctgacctacatcaatgccaagcccaacctcttctccatgctgctgacagacccccacctggccctgaccgtcttcttcggcccctgcagcccctaccagttccggctgaccggccctgggaagtgggagggcgccagaaatgccatcatgacccagtgggacaggaccttcaaggtgatcaaggcccgggtggtgcaggagagccccagcccctttgagagcttcctgaaggtgttctccttcctggccctgctggtggccatcttcctgatcttcctgtag

SEQ ID NO: 152597 - DNA, 1599 bp, Artificial Sequence; identical to SEQ ID NO: 152596
  Description of Artificial Sequence: Synthetic coding sequence

SEQ ID NO: 152598 - DNA, 1410 bp, Artificial Sequence
  Description of Artificial Sequence: Synthetic coding sequence
atggccaagagggtggccatcgtgggcgctggggtgtctggcctggccagcatcaagtgctgcctggaggagggcctggagcccacctgctttgagaggagtgatgacctgggcggcctgtggaggttcaccaccaaggtgtgcagcgtgaccaagtgcagcgacagcgctgtgtctggccagtgggaggtggtgaccatgcatgaggagaagcaggagagcgccatctttgatgctgtgatggtgtgcaccggcttcctgaccaacccctacctgcccctggacagcttccctggcatcaatgccttcaagggccagtacttccacagccggcagtacaagcacccagacatcttcaaggacaagagggtgctggtgattggcatgggcaacagcggcacagacattgctgtggaggccagccacctggccgagaaggtgttcctgagcaccaccggcggcggctgggtgatcagccgcatctttgacagcggctacccctgggacatggtgttcatgacccgcttccagaacatgctgaggaacagcctgcccacccccatcgtgacctggctgatggagaggaagatcaacaactggctgaaccacgccaactacggcctcatccctgaggacaggacccagctgaaggagtttgtgctgaatgatgagctgcccggccgcatcatcaccgggaaggtgttcatccggcccagcatcaaggaggtgaaggaaaattctgtcatcttcaacaacaccagcaaggaggagcccatcgacatcatcgtgtttgccaccggctacacctttgccttccccttcctggatgagagcgtggtgaaggtggaggatggccaggccagcctgtacaagtacatcttccctgcccacctgcagaagcccaccctggccatcatcggcctcatcaagcccctgggctccatgatccccaccggggagacccaggcccgctgggccgtgcgggtgctgaagggcgtgaacaagctgcccccacccagcgtgatgattgaggagatcaatgccaggaaagaaaacaagcccagctggtttggcctgtgctactgcaaggccctgcagagcgactacatcacctacattgatgagctgctgacctacatcaatgccaagcccaacctcttctccatgctgctgacagacccccacctggccctgactgtgttcttcggcccctgcagcccctaccagttccggctgactggacctgggaagtgggagggcgccagaaatgccatcatgacccagtgggacaggaccttcaaggtgatcaaggcccgggtggtgcaggagagccccagcccctttgagagcttcctgaaggtgttctccttcctggccctgctggtggccatcttcctgatcttcctgtag

SEQ ID NO: 152599 - DNA, 627 bp, Artificial Sequence
  Description of Artificial Sequence: Synthetic coding sequence
atggccaagagggtggccatcgtgggcgctggggtgtctggcctggccagcatcaagtgctgcctggaggagggcctggagcccacctgctttgagaggagtgatgacctgggcggcctgtggaggttcacagagcacgtggaggagggccgggccagcctgtacaagtctgtggtgagcaacagctgcaaggagatgagctgctacagcgacttccccttccctgaggactaccccaactacgtgcccaacagccagttcctggagtacctgaagatgtatgccaaccactttgacctgctgaagcacatccagttcaagaccaaggtgtgcagcgtgaccaagtgcagcgacagcgctgtgtctggccagtgggaggtggtgaccatgcatgaggagaagcaggagagcgccatctttgatgctgtgatggtgtgcaccggcttcctgaccaacccctacctgcccctggacagcttccctggcatcaatgccttcaagggccagtacttccacagccggcagtacaagcacccagacatcttcaaggacaagagggtgctggtgattggcatgggcaacagcggcacagacattgctgtggaggccagccacctggccgagtag

SEQ ID NO: 152600 - DNA, 1830 bp, Artificial Sequence
  Description of Artificial Sequence: Synthetic coding sequence
atggagggcaagcccatgaggcgctgcaccaacatccggcctggagaaacaggcatggatgtgaccagccgctgcaccctgggggaccccaacaagctgcctgagggcgtgccccagcctgccaggatgccctacatcagtgacaagcacccccggcagaccctggaggtgatcaacctgctgaggaagcaccgggagctgtgtgatgtggtgctggtggtgggcgccaagaagatctatgcccacagggtcatcctgagcgcctgcagcccctacttccgggccatgttcaccggggagctggccgagagccggcagacagaggtggtgatccgggacattgatgagcgggccatggagctgctgattgactttgcctacaccagccagatcaccgtggaggagggcaatgtgcagaccctgctgcctgctgcctgcctgctgcagctggccgagatccaggaggcctgctgtgagttcctgaagaggcagctggaccccagcaactgcctgggcatccgggcctttgctgacacccacagctgccgggagctgctgagaattgctgacaagttcacccagcacaacttccaggaggtgatggagagcgaggagttcatgctgctgcctgccaaccagctgattgacatcatcagcagtgatgagctgaatgtgcgctctgaggagcaggtgttcaatgctgtgatggcctgggtgaagtacagcatccaggagcggcggccccagctgccccaggtgctgcagcacgtgcggctgcccctgctgagccccaagttcctggtgggcaccgtgggcagtgaccccctcatcaagagtgatgaggagtgccgggacctggtggatgaggccaagaactacctgctgctgccccaggagcggcccctgatgcagggccccaggacccggcccaggaagcccatccgctgtggggaggtgctgtttgctgtgggcggctggtgcagcggagatgccatcagctctgtggagagatatgacccccagaccaatgagtggaggatggtggcctccatgagcaagaggcgctgtggggtgggcgtgtctgtgctggatgacctgctgtatgctgtgggcggccatgatggcagcagctacctgaacagcgtggagagatatgaccccaagaccaaccagtggagcagtgatgtggcccccaccagcacctgcaggacctctgtgggcgtggccgtgctgggcggcttcctgtatgctgtgggcggccaggatggagtgtcctgcctgaacatcgtggagagatatgaccccaaggagaacaagtggaccagggtggcctccatgagcacccggcggctgggcgtggccgtggccgtgctgggcggcttcctgtatgctgtgggcggcagtgatggcaccagccccctgaacacagtggagcgctacaacccccaggagaaccgctggcacaccatcgcccccatgggcaccaggaggaagcacctgggctgtgctgtgtaccaggacatgatctatgctgtgggcggcagagatgacaccacagagctgagcagcgctgagcgctacaaccccaggaccaaccagtggagccctgtggtggccatgaccagcagaagaagtggagtgggcctggccgtggtgaatggccagctgatggctgtgggcggctttgatggcaccacctacctgaagaccatcgaggtgtttgatcctgatgccaacacctggaggctgtatggaggcatgaactaccgccgcctgggcggcggcgtgggcgtcatcaagatgacccactgtgagagccacatctggtag

SEQ ID NO: 152601 - DNA, 1416 bp, Artificial Sequence; identical to SEQ ID NO: 149798
  Description of Artificial Sequence: Synthetic coding sequence

SEQ ID NO: 152602 - DNA, 1599 bp, Artificial Sequence
  Description of Artificial Sequence: Synthetic coding sequence
atgggcaagaaggtggccatcatcggggccggcgtgtctggcctggccagcatccgcagctgcctggaggagggcctggagcccacctgctttgagaagagcaatgacattggaggcctgtggaagttcagtgaccatgctgaggagggccgggccagcatctacaagtctgtgttcagcaacagcagcaaggagatgatgtgcttcccagacttccccttcccagatgacttccccaacttcatgcacaacagcaagatccaggagtacatcatcgcctttgccaaggagaagaacctgctgaagtacatccagttcaagacctttgtgtcctctgtgaacaagcacccagactttgccaccaccggccagtgggatgtgaccacagaaagagatggcaagaaggagagcgctgtgtttgatgctgtgatggtgtgcagcggccaccacgtgtaccccaacctgcccaaggagagcttccctggcctgaaccacttcaagggcaagtgcttccacagccgggactacaaggagcccggggtcttcaacgggaagagggtgctggtggtgggcctgggcaacagcggctgtgacatcgccacagagctgagcaggacagctgagcaggtgatgatcagcagccgcagcggctcctgggtgatgagccgggtgtgggacaatggctacccctgggacatgctgctggtgaccaggtttggcaccttcctgaagaacaacctgcccacagccatcagtgactggctgtatgtgaagcagatgaatgcccgcttcaagcatgaaaattatggcctgatgcccctgaatggagtgctgaggaaggagcccgtcttcaatgatgagctgcctgccagcatcctgtgtggcatcgtgtctgtgaagcccaacgtgaaggagttcacagagaccagcgccatctttgaagatggcaccatctttgagggcatcgactgtgtgatctttgccaccggctacagctttgcctaccccttcctggatgagagcatcatcaagagcaggaacaatgagatcatcctcttcaagggcgtcttcccccccctgctggagaagagcaccatcgctgtgattggatttgtgcagagcctgggcgccgccatccccaccgtggacctgcagagccgctgggccgcccaggtgatcaagggcacctgcaccctgcccagcatggaggacatgatgaatgacatcaatgagaagatggagaagaagaggaagtggtttgggaagtctgagaccatccagacagactacatcgtgtacatggatgagctgagcagcttcatcggggccaagcccaacatcccctggctgttcctgacagaccccaagctggccatggaggtgtacttcggcccctgcagcccctaccagttccggctggtgggccctggccagtggccaggggccagaaatgccatcctgacccagtgggacaggagcctgaagcccatgcagaccagggtggtgggccgcctgcagaagccctgcttcttcttccactggctgaagctgtttgccatccccatcctgctgattgctgtgttcctggtgctgacctag

SEQ ID NO: 152603 - DNA, 1599 bp, Artificial Sequence; identical to SEQ ID NO: 152602
  Description of Artificial Sequence: Synthetic coding sequence

SEQ ID NO: 152604 - DNA, 1410 bp, Artificial Sequence
  Description of Artificial Sequence: Synthetic coding sequence
atgggcaagaaggtggccatcatcggggccggcgtgtctggcctggccagcatccgcagctgcctggaggagggcctggagcccacctgctttgagaagagcaatgacattggaggcctgtggaagttcagcacctttgtgtcctctgtgaacaagcacccagactttgccaccaccggccagtgggatgtgaccacagaaagagatggcaagaaggagagcgctgtgtttgatgctgtgatggtgtgcagcggccaccacgtgtaccccaacctgcccaaggagagcttccctggcctgaaccacttcaagggcaagtgcttccacagccgggactacaaggagcccggggtcttcaacgggaagagggtgctggtggtgggcctgggcaacagcggctgtgacatcgccacagagctgagcaggacagctgagcaggtgatgatcagcagccgcagcggctcctgggtgatgagccgggtgtgggacaatggctacccctgggacatgctgctggtgacccgcttcggcaccttcctgaagaacaacctgcccacagccatcagtgactggctgtatgtgaagcagatgaatgcccgcttcaagcatgagaactacggcctgatgcccctgaatggagtgctgaggaaggagcctgtgttcaatgatgagctgcctgccagcatcctgtgtggcatcgtgtctgtgaagcccaacgtgaaggagttcacagagaccagcgccatctttgaagatggcaccatctttgagggcatcgactgtgtgatctttgccaccggctacagctttgcctaccccttcctggatgagagcatcatcaagagcagaaataatgagatcatcctcttcaagggcgtcttcccccccctgctggagaagagcaccatcgccgtcatcggctttgtgcagagcctgggcgccgccatccccaccgtggacctgcagagccgctgggccgcccaggtgatcaagggcacctgcaccctgcccagcatggaggacatgatgaatgacatcaatgagaagatggagaagaagaggaagtggtttgggaagtctgagaccatccagacagactacatcgtgtacatggatgagctgagcagcttcatcggggccaagcccaacatcccctggctgttcctgacagaccccaagctggccatggaggtgtacttcggcccctgcagcccctaccagttccggctggtgggccctggccagtggccaggggccagaaatgccatcctgacccagtgggacaggagcctgaagcccatgcagaccagggtggtgggccgcctgcagaagccctgcttcttcttccactggctgaagctgtttgccatccccatcctgctgattgctgtgttcctggtgctgacctag

SEQ ID NO: 152605 - DNA, 1539 bp, Artificial Sequence
  Description of Artificial Sequence: Synthetic coding sequence
atgcctgccagcaccaggagccagaagaggcagggcatggacagcctgctggagcccctgaagatgaacatggaccatgctgaggagggccgggccagcatctacaagtctgtgttcagcaacagcagcaaggagatgatgtgcttcccagacttccccttcccagatgacttccccaacttcatgcacaacagcaagatccaggagtacatcatcgcctttgccaaggagaagaacctgctgaagtacatccagttcaagacctttgtgtcctctgtgaacaagcacccagactttgccaccaccggccagtgggatgtgaccacagaaagagatggcaagaaggagagcgctgtgtttgatgctgtgatggtgtgcagcggccaccacgtgtaccccaacctgcccaaggagagcttccctggcctgaaccacttcaagggcaagtgcttccacagccgggactacaaggagcccggggtcttcaacgggaagagggtgctggtggtgggcctgggcaacagcggctgtgacatcgccacagagctgagcaggacagctgagcaggtgatgatcagcagccgcagcggctcctgggtgatgagccgggtgtgggacaatggctacccctgggacatgctgctggtgaccaggtttggcaccttcctgaagaacaacctgcccacagccatcagtgactggctgtatgtgaagcagatgaatgcccgcttcaagcatgaaaattatggcctgatgcccctgaatggagtgctgaggaaggagcccgtcttcaatgatgagctgcctgccagcatcctgtgtggcatcgtgtctgtgaagcccaacgtgaaggagttcacagagaccagcgccatctttgaagatggcaccatctttgagggcatcgactgtgtgatctttgccaccggctacagctttgcctaccccttcctggatgagagcatcatcaagagcaggaacaatgagatcatcctcttcaagggcgtcttcccccccctgctggagaagagcaccatcgctgtgattggatttgtgcagagcctgggcgccgccatccccaccgtggacctgcagagccgctgggccgcccaggtgatcaagggcacctgcaccctgcccagcatggaggacatgatgaatgacatcaatgagaagatggagaagaagaggaagtggtttgggaagtctgagaccatccagacagactacatcgtgtacatggatgagctgagcagcttcatcggggccaagcccaacatcccctggctgttcctgacagaccccaagctggccatggaggtgtacttcggcccctgcagcccctaccagttccggctggtgggccctggccagtggccaggggccagaaatgccatcctgacccagtgggacaggagcctgaagcccatgcagaccagggtggtgggccgcctgcagaagccctgcttcttcttccactggctgaagctgtttgccatccccatcctgctgattgctgtgttcctggtgctgacctag

SEQ ID NO: 152606 - DNA, 1677 bp, Artificial Sequence
  Description of Artificial Sequence: Synthetic coding sequence
atggccaagaaggtggccgtcatcggggccggcgtgtctggcctgagcagcatcaagtgctgcgtggatgaggacctggagcccacctgctttgagaggagtgatgacattggaggcctgtggaagttcacagagagcagcaaggatggcatgaccagggtgtacaagagcctggtgaccaacgtgtgcaaggagatgagctgctacagcgacttccccttccacgaggactaccccaacttcatgaaccacgagaagttctgggactacctgcaggagtttgctgagcactttgacctgctgaagtacatccagttcaagaccaccgtgtgcagcatcaccaagaggccagacttcagcgagaccggccagtgggatgtggtgacagaaacagagggcaagcagaacagagctgtgtttgatgctgtgatggtgtgcaccggccacttcctgaacccccacctgcccctggaggccttccctggcatccacaagttcaagggccagatcctgcacagccaggagtacaagatccctgagggcttccagggcaagagggtgctggtgattggcctgggcaacacaggaggagacattgctgtggagctgagcaggacagctgcccaggtgctgctgagcaccaggacaggcacctgggtgctgggccgcagcagtgactggggctacccctacaacatgatggtgacccggcgctgctgcagcttcatcgcccaggtgctgcccagccgcttcctgaactggatccaggagaggaagctgaacaagcgcttcaaccatgaagattatggcctgagcatcaccaagggcaagaaggccaagttcatcgtgaatgatgagctgcccaactgcatcctgtgtggggccatcaccatgaagacctctgtgattgagttcacagagaccagcgctgtgtttgaagatggcaccgtggaggagaacattgatgtggtgatcttcaccaccggctacaccttctccttccccttctttgaggagcccctgaagagcctgtgcaccaagaagatcttcctgtacaagcaggtgttccccctgaacctggagcgggccaccctggccatcatcggcctgattggcctgaagggcagcatcctgtctggaacagagctgcaggcccgctgggtgaccagggtcttcaagggcctgtgcaagatcccccccagccagaagctgatgatggaggccacagagaaggagcagctgatcaagaggggcgtcttcaaggacaccagcaaggacaagtttgactacatcgcctacatggatgacattgctgcctgcatcggcaccaagcccagcatccccctgctcttcctgaaggacccccggctggcctgggaggtgttcttcggcccctgcaccccctaccagtaccgcctgatgggccctgggaagtgggatggagccagaaatgccatcctgacccagtgggacaggaccctgaagcccctgaagaccagaattgtgcctgacagcagcaagccagcctccatgagccactacctgaaggcctggggcgcccctgtgctgctggccagcctgctgctgatctgcaagagcagcctcttcctgaagctggtgcgggacaagctgcaggacaggatgagcccctacctggtgtccctgtggaggggctag

SEQ ID NO: 152607 - DNA, 1602 bp, Artificial Sequence
  Description of Artificial Sequence: Synthetic coding sequence
atgaccaagaagagaattgctgtgattggaggcggcgtgtctggcctgagcagcatcaagtgctgcgtggaggagggcctggagcctgtgtgctttgagaggacagatgacatcggcggcctgtggaggttccaggagaaccctgaggagggccgggccagcatctacaagagcgtcatcatcaacaccagcaaggagatgatgtgcttcagtgactaccccatcccagaccactaccccaacttcatgcacaatgcccaggtgctggagtacttcaggatgtatgccaaggagtttgacctgctgaagtacatccgcttcaagaccaccgtgtgcagcgtgaagaagcagcctgactttgccaccagcggccagtgggaggtggtgacagagagcgagggcaagaaggagatgaatgtgtttgatggagtgatggtgtgcaccggccaccacaccaatgcccacctgcccctggagagcttccctggcatcgagaagttcaagggccagtacttccacagccgggactacaagaaccctgagggcttcaccgggaagagggtcatcatcattggaattggcaacagcggcggggacctggccgtggagatcagccagacagccaagcaggtgttcctgagcacccggcggggggcctggatcctgaacagagtgggggactatggctacccagcagatgtgctcttcagcagccggctgacccacttcatctggaagatctgtggccagagcctggccaacaagtacctggagaagaagatcaaccagagatttgaccacgagatgtttggcctgaagcccaagcaccgggccctgagccagcaccccaccctgaatgatgacctgcccaaccgcatcatcagcggcctggtgaaggtgaagggaaatgtgaaggagttcacagaaacagctgccatctttgaagatggcagccgggaggatgacattgatgctgtgatctttgccaccggctacagctttgacttccccttcctggaggacagcgtgaaggtggtgaagaacaagatcagcctgtacaagaaggtgttcccccccaacctggagcggcccaccctggccatcatcggcctcatccagcccctgggcgccatcatgcccatcagcgagctgcagggccgctgggccacccaggtgttcaagggcctgaagaccctgcccagccagagcgagatgatggccgagatcagcaaggcccaggaggagattgacaagcgctacgtggagagccagaggcacaccatccagggcgactacatcgacaccatggaggagctggccgacctggtgggcgtgcggcccaacctgctgagcctggccttcacagaccccaagctggccctgcacctgctgctgggcccctgcacccccatccactacagagtgcagggccctgggaagtgggatggagccaggaaggccatcctgaccacagatgaccgcatcaggaagcccctgatgaccagggtggtggagaggagcagctccatgaccagcaccatgaccatcggcaagttcatgctggccctggccttctttgccatcatcatcgcctacttctag

SEQ ID NO: 152608 - DNA, 858 bp, Artificial Sequence
  Description of Artificial Sequence: Synthetic coding sequence
atgaccaagaagagaattgctgtgattggaggcggcgtgtctggcctgagcagcatcaagtgctgcgtggaggagggcctggagcctgtgtgctttgagaggacagatgacatcggcggcctgtggaggttccaggagaaccctgaggagggccgggccagcatctacaagagcgtcatcatcaacaccagcaaggagatgatgtgcttcagtgactaccccatcccagaccactaccccaacttcatgcacaatgcccaggtgctggagtacttcaggatgtatgccaaggagtttgacctgctgaagtacatccgcttcaagaccaccgtgtgcagcgtgaagaagcagcctgactttgccaccagcggccagtgggaggtggtgacagagagcgagggcaagaaggagatgaatgtgtttgatggagtgatggtgtgcaccggccaccacaccaatgcccacctgcccctggagagcttccctggcatcgagaagttcaagggccagtacttccacagccgggactacaagaaccctgagggcttcaccgggaagagggtcatcatcattggaattggcaacagcggcggggacctggccgtggagatcagccagacagccaagcaggtgttcctgagcacccggcggggggcctggatcctgaacagagtgggggactatggctacccagcagatgtgctcttcagcagccggctgacccacttcatctggaagatctgtggccagagcctggccaacaagtacctggagaagaagatcaaccagagatttgaccacgagatgtttggcctgaagcccaagcacaggagcaaggacatcgccctgacagaatag

SEQ ID NO: 152609 - DNA, 1395 bp, Artificial Sequence
  Description of Artificial Sequence: Synthetic coding sequence
atgaccaagaagagaattgctgtgattggaggcggcgtgtctggcctgagcagcatcaagtgctgcgtggaggagggcctggagcctgtgtgctttgagaggacagatgacatcggcggcctgtggaggttccaggagaaccctgaggagggccgggccagcatctacaagagcgtcatcatcaacaccagcaaggagatgatgtgcttcagtgactaccccatcccagaccactaccccaacttcatgcacaatgcccaggtgctggagtacttcaggatgtatgccaaggagtttgacctgctgaagtacatccgcttcaagaccaccgtgtgcagcgtgaagaagcagcctgactttgccaccagcggccagtgggaggtggtgacagagagcgagggcaagaaggagatgaatgtgtttgatggagtgatggtgtgcaccggccaccacaccaatgcccacctgcccctggagagcttccctggcatcgagaagttcaagggccagtacttccacagccgggactacaagaaccctgagggcttcaccgggaagagggtcatcatcattggaattggcaacagcggcggggacctggccgtggagatcagccagacagccaagcaggtgttcctgagcacccggcggggggcctggatcctgaacagagtgggggactatggctacccagcagatgtgctcttcagcagccggctgacccacttcatctggaagatctgtggccagagcctggccaacaagtacctggagaagaagatcaaccagagatttgaccacgagatgtttggcctgaagcccaagcaccgggccctgagccagcaccccaccctgaatgatgacctgcccaaccgcatcatcagcggcctggtgaaggtgaagggaaatgtgaaggagttcacagaaacagctgccatctttgaagatggcagccgggaggatgacattgatgctgtgatctttgccaccggctacagctttgacttccccttcctggaggacagcgtgaaggtggtgaagaacaagatcagcctgtacaagaaggtgttcccccccaacctggagcggcccaccctggccatcatcggcctcatccagcccctgggcgccatcatgcccatcagcgagctgcagggccgctgggccacccaggtgttcaagggcctgaagaccctgcccagccagagcgagatgatggccgagatcagcaaggcccaggaggagattgacaagagcctgaccatgaggaagaccagtgacaagcccaagctgaagaacatcctgcagatcccagactacctgaagacagtgaagatcatcaacaaggagagcctgaggaactgccccggcatcaagggccccaaggagacctag

SEQ ID NO: 152610 - DNA, 579 bp, Artificial Sequence
  Description of Artificial Sequence: Synthetic coding sequence
atgaccaagaagagaattgctgtgattggaggcggcgtgtctggcctgagcagcatcaagtgctgcgtggaggagggcctggagcctgtgtgctttgagaggacagatgacatcggcggcctgtggaggttccaggagaaccctgaggagggccgggccagcatctacaagagcgtcatcatcaacaccagcaaggagatgatgtgcttcagtgactaccccatcccagaccactaccccaacttcatgcacaatgcccaggtgctggagtacttcaggatgtatgccaaggagtttgacctgctgaagtacatccgcttcaagaccaccgtgtgcagcgtgaagaagcagcctgactttgccaccagcggccagtgggaggtggtgacagagagcgagggcaagaaggagatgaatgtgtttgatggagtgatggtgtgcaccggccaccacaccaatgcccacctgcccctggagagcttccctggcatcgagaagttcaagggccagtacttccacagccgggactacaagaaccctgagggcttcaccgggaagagggtcatcatcattggatag

SEQ ID NO: 152611 - DNA, 438 bp, Artificial Sequence
  Description of Artificial Sequence: Synthetic coding sequence
atgaccaagaagagaattgctgtgattggaggcggcgtgtctggcctgagcagcatcaagtgctgcgtggaggagggcctggagcctgtgtgctttgagaggacagatgacatcggcggcctgtggaggttccaggagaaccctgaggagggccgggccagcatctacaagagcgtcatcatcaacaccagcaaggagatgatgtgcttcagtgactaccccatcccagaccactaccccaacttcatgcacaatgcccaggtgctggagtacttcaggatgtatgccaaggagtttgacctgctgaagtacatccgcttcaagaccaccgtgtgcagcgtgaagaagcagcctgactttgccaccagcggccagtgggaggtggtgacagagagcgagggcaagaaggagatgaatgtgtttgatggagtgatgtag

SEQ ID NO: 152612 - DNA, 3810 bp, Artificial Sequence
  Description of Artificial Sequence: Synthetic coding sequence
atggaggccaccggggtgctgccctttgtgcggggcgtggacctgtctggaaatgacttcaagggcggctacttcccagaaaatgtgaaggccatgaccagcctgcgctggctgaagctgaacagaacaggcctgtgctacctgcctgaggagctggccgccctgcagaagctggagcacctgtctgtgagccacaacaacctgaccaccctgcacggggagctgagcagcctgcccagcctgcgggccatcgtggcccgggccaacagcctgaagaacagcggcgtgcctgatgacatcttcaagctggatgacctgtctgtgctggacctgagccacaaccagctgacagagtgcccccgggagctggagaatgccaagaacatgctggtgctgaacctgagccacaacagcattgacaccatccccaaccagctgttcatcaacctgacagacctgctgtacctggacctgtctgagaaccggctggagagcctgcccccccagatgaggcggctggtgcacctgcagaccctggtgctgaatggaaaccccctgctgcacgcccagctgcggcagctgcctgccatgacagccctgcagaccctgcacctgcggagcacccagaggacccagagcaacctgcccaccagcctggagggcctgagcaacctggctgatgtggacctgagctgcaatgacctgaccagggtgcctgagtgcctgtacaccctgcccagcctgcggcggctgaacctgagcagcaaccagatcacagagctgagcctgtgcatcgaccagtgggtgcacgtggagaccctgaacctgagcaggaaccagctgaccagcctgcccagcgccatctgcaagctgagcaagctgaagaagctgtacctgaacagcaacaagctggactttgatggcctgcccagcggcatcggcaagctgaccaacctggaggagttcatggccgccaacaacaacctggagctggtgcctgagagcctgtgccgctgccccaagctgaggaagctggtgctgaacaagaaccacctggtgaccctgcctgaggccatccacttcctgacagaaattgaggtgctggatgtgcgggagaaccccaacctggtgatgccacccaagccagctgacagagctgctgagtggtacaacatcgacttcagcctgcagaaccagctgcggctggccggggccagccctgccaccgtggccgctgctgctgctgctggcagcggccccaaggaccccatggccaggaagatgaggctgcggcggaggaaggacagcgcccaggatgaccaggccaagcaggtgctgaagggcatgtctgatgtggcccaggagaagaacaagaagcaggaggagagcgcagatgcccgggcccccagcggcaaggtgcggcgctgggaccagggcctggagaagccccggctggactacagcgagttcttcacagaagatgtgggccagctgcccggcctgaccatctggcagattgaaaattttgtgcctgtgctggtggaggaggccttccacggcaagttctatgaagctgactgctacatcgtgctgaagaccttcctggatgacagcggcagcctgaactgggagatctactactggattggaggagaggccaccctggacaagaaggcctgcagcgccatccatgctgtgaacctgaggaactacctgggcgcagaatgtagaacagtgcgggaggagatgggagatgaaagtgaggagttcctgcaggtgtttgacaatgacatctcctacattgaaggaggaacagccagcggcttctacacagtggaggacacccactacgtgaccaggatgtacagagtgtatggcaagaagaacatcaagctggagcctgtgcccctgaagggcaccagcctggaccccaggtttgtgttcctgctggaccggggcctggacatctacgtgtggaggggggcccaggccaccctgagcagcaccaccaaggcccggctgtttgctgagaagatcaacaagaatgaaaggaagggcaaggccgagatcaccctgctggtgcagggccaggagctgcctgagttctgggaggccctgggcggggagcccagcgagatcaagaagcacgtgcctgaggacttctggccaccccagcccaagctgtacaaggtgggcctgggcctgggctacctggagctgccccagatcaactacaagctgtctgtggagcacaagcagaggcccaaggtggagctgatgcccaggatgaggctgctgcagagcctgctggacacccgctgtgtgtacatcctggactgctggagcgatgtgttcatctggctgggcaggaagagcccccggctggtgcgggctgctgccctgaagctgggccaggagctgtgtggcatgctgcaccggcccaggcatgccaccgtgagccgcagcctggagggcacagaggcccaggtgttcaaggccaagttcaagaactgggatgatgtgctgactgtggactacaccagaaatgctgaggccgtgctgcagagccctggcctgagcggcaaggtgaagagagatgctgagaagaaggaccagatgaaggctgacctgacagccctcttcctgccccggcagccccccatgagcctggccgaggccgagcagctgatggaggagtggaatgaagacctggatggcatggagggctttgtgctggagggcaagaagtttgcccggctgcctgaggaggagtttggccacttctacacccaggactgctacgtgttcctgtgccgctactgggtgcctgtggagtatgaggaggaggagaagaaggaggacaaggaggagaaggccgagggcaaggagggggaggaggccacagctgaggccgaggagaagcagcctgaggaggacttccagtgcatcgtgtacttctggcagggccgggaggccagcaacatgggctggctgaccttcaccttcagcctgcagaagaagtttgagagcctcttccctgggaagctggaggtggtgaggatgacccagcagcaggagaaccccaagttcctgagccacttcaagaggaagttcatcatccaccggggcaagaggaaggctgtgcagggcgcccagcagcccagcctgtaccagatccgcaccaacggcagcgccctgtgcacccgctgcatccagatcaacacagacagcagcctgctgaacagcgagttctgcttcatcctgaaggtgccctttgaaagtgaggacaaccagggcatcgtgtatgcctgggtgggccgggccagtgaccctgatgaggccaagctggccgaggacatcctgaacaccatgtttgacaccagctacagcaagcaggtgatcaatgaaggagaggagcctgagaacttcttctgggtgggcatcggggcccagaagccctatgatgatgatgctgagtacatgaagcacaccaggctcttccgctgcagcaatgagaagggctactttgctgtgacagagaagtgcagcgacttctgccaggatgacctggctgatgatgacatcatgctgctggacaatggccaggaggtgtacatgtgggtgggcacccagaccagccaggtggagatcaagctgagcctgaaggcctgccaggtgtacatccagcacatgaggagcaaggagcacgagcggccccggcggctgcggctggtgaggaaaggaaatgagcagcacgccttcacccgctgcttccacgcctggagcgccttctgcaaggccctggcctag

SEQ ID NO: 152613 - DNA, 3552 bp, Artificial Sequence
  Description of Artificial Sequence: Synthetic coding sequence
atgaccagcctgcgctggctgaagctgaacagaacaggcctgtgctacctgcctgaggagctggccgccctgcagaagctggagcacctgtctgtgagccacaacaacctgaccaccctgcatggagagctgagcagcctgcccagcctgcgggccatcgtggcccgggccaacagcctgaagaacagcggcgtgcctgatgacatcttcaagctggatgacctgtctgtgctggacctgagccacaaccagctgacagaatgtccccgggagctggagaatgccaagaacatgctggtgctgaacctgagccacaaccggcagctgcctgccatgacagccctgcagaccctgcacctgcggagcacccagaggacccagagcaacctgcccaccagcctggagggcctgagcaacctggctgatgtggacctgagctgcaatgacctgaccagggtgcctgaatgtctgtacaccctgcccagcctgcggcggctgaacctgagcagcaaccagatcacagagctgagcctgtgcatcgaccagtgggtgcacgtggagaccctgaacctgagcaggaaccagctgaccagcctgcccagcgccatctgcaagctgagcaagctgaagaagctgtacctgaacagcaacaagctggactttgatggcctgcccagcggcatcggcaagctgaccaacctggaggagttcatggccgccaacaacaacctggagctggtgcctgagagcctgtgccgctgccccaagctgaggaagctggtgctgaacaagaaccacctggtgaccctgcctgaggccatccacttcctgacagaaattgaggtgctggatgtgcgggagaaccccaacctggtgatgccacccaagccagctgacagagctgctgagtggtacaacatcgacttcagcctgcagaaccagctgcggctggccggggccagccctgccaccgtggccgctgctgctgctggcagcggccccaaggaccccatggccaggaagatgaggctgcggcggaggaaggacagcgcccaggatgaccaggccaagcaggtgctgaagggcatgtctgatgtggcccaggagaagaacaagaagcaggaggagagcgcagatgcccgggcccccagcggcaaggtgcggcgctgggaccagggcctggagaagccccggctggactacagcgagttcttcacagaagatgtgggccagctgcccggcctgaccatctggcagattgaaaattttgtgcctgtgctggtggaggaggccttccacggcaagttctatgaagctgactgctacatcgtgctgaagaccttcctggatgacagcggcagcctgaactgggagatctactactggattggaggagaggccaccctggacaagaaggcctgcagcgccatccatgctgtgaacctgaggaactacctgggcgcagaatgtagaacagtgcgggaggagatgggagatgaaagtgaggagttcctgcaggtgtttgacaatgacatctcctacattgaaggaggaacagccagcggcttctacacagtggaggacacccactacgtgaccaggatgtacagagtgtatggcaagaagaacatcaagctggagcctgtgcccctgaagggcaccagcctggaccccaggtttgtgttcctgctggaccggggcctggacatctacgtgtggaggggggcccaggccaccctgagcagcaccaccaaggcccggctgtttgctgagaagatcaacaagaatgaaaggaagggcaaggccgagatcaccctgctggtgcagggccaggagctgcctgagttctgggaggccctgggcggggagcccagcgagatcaagaagcacgtgcctgaggacttctggccaccccagcccaagctgtacaaggtgggcctgggcctgggctacctggagctgccccagatcaactacaagctgtctgtggagcacaagcagaggcccaaggtggagctgatgcccaggatgaggctgctgcagagcctgctggacacccgctgtgtgtacatcctggactgctggagcgatgtgttcatctggctgggcaggaagagcccccggctggtgcgggctgctgccctgaagctgggccaggagctgtgtggcatgctgcaccggcccaggcatgccaccgtgagccgcagcctggagggcacagaggcccaggtgttcaaggccaagttcaagaactgggatgatgtgctgactgtggactacaccagaaatgctgaggccgtgctgcagagccctggcctgagcggcaaggtgaagagagatgctgagaagaaggaccagatgaaggctgacctgacagccctcttcctgccccggcagccccccatgagcctggccgaggccgagcagctgatggaggagtggaatgaagacctggatggcatggagggctttgtgctggagggcaagaagtttgcccggctgcctgaggaggagtttggccacttctacacccaggactgctacgtgttcctgtgccgctactgggtgcctgtggagtatgaggaggaggagaagaaggaggacaaggaggagaaggccgagggcaaggagggggaggaggccacagctgaggccgaggagaagcagcctgaggaggacttccagtgcatcgtgtacttctggcagggccgggaggccagcaacatgggctggctgaccttcaccttcagcctgcagaagaagtttgagagcctcttccctgggaagctggaggtggtgaggatgacccagcagcaggagaaccccaagttcctgagccacttcaagaggaagttcatcatccaccggggcaagaggaaggctgtgcagggcgcccagcagcccagcctgtaccagatccgcaccaacggcagcgccctgtgcacccgctgcatccagatcaacacagacagcagcctgctgaacagcgagttctgcttcatcctgaaggtgccctttgaaagtgaggacaaccagggcatcgtgtatgcctgggtgggccgggccagtgaccctgatgaggccaagctggccgaggacatcctgaacaccatgtttgacaccagctacagcaagcaggtgatcaatgaaggagaggagcctgagaacttcttctgggtgggcatcggggcccagaagccctatgatgatgatgctgagtacatgaagcacaccaggctcttccgctgcagcaatgagaagggctactttgctgtgacagagaagtgcagcgacttctgccaggatgacctggctgatgatgacatcatgctgctggacaatggccaggaggtgtacatgtgggtgggcacccagaccagccaggtggagatcaagctgagcctgaaggcctgccaggtgtacatccagcacatgaggagcaaggagcacgagcggccccggcggctgcggctggtgaggaaaggaaatgagcagcacgccttcacccgctgcttccacgcctggagcgccttctgcaaggccctggcctag

SEQ ID NO: 152614 - DNA, 3447 bp, Artificial Sequence
  Description of Artificial Sequence: Synthetic coding sequence
atggaggccaccggggtgctgccctttgtgcggggcgtggacctgtctggaaatgacttcaagggcggctacttcccagaaaatgtgaaggccatgaccagcctgcgctggctgaagctgaacagaacaggcctgtgctacctgcctgaggagctggccgccctgcagaagctggagcacctgtctgtgagccacaacaacctgaccaccctgcacggggagctgagcagcctgcccagcctgcgggccatcgtggcccgggccaacagcctgaagaacagcggcgtgcctgatgacatcttcaagctggatgacctgtctgtgctggacctgagccacaaccagctgacagagtgcccccgggagctggagaatgccaagaacatgctggtgctgaacctgagccacaacagcattgacaccatccccaaccagctgttcatcaacctgacagacctgctgtacctggacctgtctgagaaccggctggagagcctgcccccccagatgaggcggctggtgcacctgcagaccctggtgctgaatggaaaccccctgctgcacgcccagctgcggcagctgcctgccatgacagccctgcagaccctgcacctgcggagcacccagaggacccagagcaacctgcccaccagcctggagggcctgagcaacctggctgatgtggacctgagctgcaatgacctgaccagggtgcctgagtgcctgtacaccctgcccagcctgcggcggctgaacctgagcagcaaccagatcacagagctgagcctgtgcatcgaccagtgggtgcacgtggagaccctgaacctgagcaggaaccagctgaccagcctgcccagcgccatctgcaagctgagcaagctgaagaagctgtacctgaacagcaacaagctggactttgatggcctgcccagcggcatcggcaagctgaccaacctggaggagttcatggccgccaacaacaacctggagctggtgcctgagagcctgtgccgctgccccaagctgaggaagctggtgctgaacaagaaccacctggtgaccctgcctgaggccatccacttcctgacagaaattgaggtgctggatgtgcgggagaaccccaacctggtgatgccacccaagccagctgacagagctgctgagtggtacaacatcgacttcagcctgcagaaccagctgcggctggccggggccagccctgccaccgtggccgctgctgctgctgctggcagcggccccaaggaccccatggccaggaagatgaggctgcggcggaggaaggacagcgcccaggatgaccaggccaagcaggtgctgaagggcatgtctgatgtggcccaggagaagaacaagaagcaggaggagagcgcagatgcccgggcccccagcggcaaggtgcggcgctgggaccagggcctggagaagccccggctggactacagcgagttcttcacagaagatgtgggccagctgcccggcctgaccatctggcagattgaaaattttgtgcctgtgctggtggaggaggccttccacggcaagttctatgaagctgactgctacatcgtgctgaagaccttcctggatgacagcggcagcctgaactgggagatctactactggattggaggagaggccaccctggacaagaaggcctgcagcgccatccatgctgtgaacctgaggaactacctgggcgcagaatgtagaacagtgcgggaggagatgggagatgaaagtgaggagttcctgcaggtgtttgacaatgacatctcctacattgaaggaggaacagccagcggcttctacacagtggaggacacccactacgtgaccaggatgtacagagtgtatggcaagaagaacatcaagctggagcctgtgcccctgaagggcaccagcctggaccccaggtttgtgttcctgctggaccggggcctggacatctacgtgtggaggggggcccaggccaccctgagcagcaccaccaaggcccggctgtttgctgagaagatcaacaagaatgaaaggaagggcaaggccgagatcaccctgctggtgcagggccaggagctgcctgagttctgggaggccctgggcggggagcccagcgagatcaagaagaactgggatgatgtgctgactgtggactacaccagaaatgctgaggccgtgctgcagagccctggcctgagcggcaaggtgaagagagatgctgagaagaaggaccagatgaaggctgacctgacagccctcttcctgccccggcagccccccatgagcctggccgaggccgagcagctgatggaggagtggaatgaagacctggatggcatggagggctttgtgctggagggcaagaagtttgcccggctgcctgaggaggagtttggccacttctacacccaggactgctacgtgttcctgtgccgctactgggtgcctgtggagtatgaggaggaggagaagaaggaggacaaggaggagaaggccgagggcaaggagggggaggaggccacagctgaggccgaggagaagcagcctgaggaggacttccagtgcatcgtgtacttctggcagggccgggaggccagcaacatgggctggctgaccttcaccttcagcctgcagaagaagtttgagagcctcttccctgggaagctggaggtggtgaggatgacccagcagcaggagaaccccaagttcctgagccacttcaagaggaagttcatcatccaccggggcaagaggaaggctgtgcagggcgcccagcagcccagcctgtaccagatccgcaccaatggaagtgccctgtgcacccgctgcatccagatcaacacagacagcagcctgctgaacagcgagttctgcttcatcctgaaggtgccctttgaaagtgaggacaaccagggcatcgtgtatgcctgggtgggccgggccagtgaccctgatgaggccaagctggccgaggacatcctgaacaccatgtttgacaccagctacagcaagcaggtgatcaatgaaggagaggagcctgagaacttcttctgggtgggcattggagcccagaagccctatgatgatgatgctgagtacatgaagcacaccaggctcttccgctgcagcaatgagaagggctactttgctgtgacagagaagtgcagcgacttctgccaggatgacctggctgatgatgacatcatgctgctggacaatggccaggaggtgtacatgtgggtgggcacccagaccagccaggtggagatcaagctgagcctgaaggcctgccaggtgtacatccagcacatgaggagcaaggagcacgagcggccccggcggctgcggctggtgaggaaaggaaatgagcagcacgccttcacccgctgcttccacgcctggagcgccttctgcaaggccctggcctag

SEQ ID NO: 152615 - DNA, 1284 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgtacaccaggcatggagtgcccatctctgtgacaggcatcgcccaggtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagaagagccagctgatcatgcaggccgaggccgaggccgcctctgtgaggatgagaggagaggccgaggcctttgccatcggggcccgggcccgggcagaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgactggagaggtgctggacatcctgacccggctgcctgagagcgtggagcggctgactggagtgtccatcagccaggtgaaccacaagcccctgaggacagcctag

SEQ ID NO: 152616 - DNA, 1284 bp, Artificial Sequence; identical to SEQ ID NO: 152615
  Description of Artificial Sequence: Synthetic coding sequence

SEQ ID NO: 152617 - DNA, 1284 bp, Artificial Sequence; identical to SEQ ID NO: 152615
  Description of Artificial Sequence: Synthetic coding sequence

SEQ ID NO: 152618 - DNA, 438 bp, Artificial Sequence
  Description of Artificial Sequence: Synthetic coding sequence
atgggcgtggagggcaccggccggggcggctgccgcctgggcggcccagatggcaagggcaagggctgggcccctgtggatgccacagcccggctgccccacccccagaggctgagcctgcccctgctgcagctgcagcctgagccctgcttcagcctggtggcccagatgaggccctggtggagcccagactacctgcacagcctgggcaaggccaggacagcccaggtgcagaaggatgccagaattggagaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgtag

SEQ ID NO: 152619 - DNA, 579 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgaatag

SEQ ID NO: 152620 - DNA, 579 bp, Artificial Sequence; identical to SEQ ID NO: 152619
  Description of Artificial Sequence: Synthetic coding sequence

SEQ ID NO: 152621 - DNA, 717 bp, Artificial Sequence
  Description of Artificial Sequence: Synthetic coding sequence
atgaggccctggtggagccctgtgaagatccagggccagaacaaggagatgctggccgccgcctgccagatgttcctgggcaagacagaagctgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgccagaattggagaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagtag

SEQ ID NO: 152622 - DNA, 579 bp, Artificial Sequence; identical to SEQ ID NO: 152619
  Description of Artificial Sequence: Synthetic coding sequence

SEQ ID NO: 152623 - DNA, 579 bp, Artificial Sequence; identical to SEQ ID NO: 152619
  Description of Artificial Sequence: Synthetic coding sequence

SEQ ID NO: 152624 - DNA, 438 bp, Artificial Sequence; identical to SEQ ID NO: 152618
  Description of Artificial Sequence: Synthetic coding sequence

SEQ ID NO: 152625 - DNA, 273 bp, Artificial Sequence
  Description of Artificial Sequence: Synthetic coding sequence
tgagccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgactggagaggtgctggacatcctgacccggctgcctgagagcgtggagcggctgactggagtgtccatcagccaggtgaaccacaagcccctgaggacagcctag

SEQ ID NO: 152626 - DNA, 708 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgtacaccaggcatggagtgcccatctctgtgacaggcatcgcccaggtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgactag

SEQ ID NO: 152627 - DNA, 717 bp, Artificial Sequence; identical to SEQ ID NO: 152621
  Description of Artificial Sequence: Synthetic coding sequence

SEQ ID NO: 152628 - DNA, 417 bp, Artificial Sequence
  Description of Artificial Sequence: Synthetic coding sequence
gtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgaatag

SEQ ID NO: 152629 - DNA, 558 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgtacaccaggcatggagtgcccatctctgtgacaggcatcgcccaggtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagaggtag

SEQ ID NO: 152630 - DNA, 348 bp, Artificial Sequence
  Description of Artificial Sequence: Synthetic coding sequence
atgggcgtggagggcaccggccggggcggctgccgcctgggcggcccagatggcaagggcaagggctgggcccctgtggatgccacagcccggctgccccacccccagaggctgagcctgcccctgctgcagctgcagcctgagccctgcttcagcctggtggcccagatgaggccctggtggagcccagactacctgcacagcctgggcaaggccaggacagcccaggtgcagaaggatgccagaattggagaggccgaggccaagagagatgctggcatccgggaggccaaggccaagcaggagaaggtgtctgcccagtacctgtctgaaattgagatggcctag

SEQ ID NO: 152631 - DNA, 561 bp, Artificial Sequence
  Description of Artificial Sequence: Synthetic coding sequence
gtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagaagagccagctgatcatgcaggccgaggccgaggccgcctctgtgaggatgagaggagaggccgaggcctttgccatcggggcccgggcccgggcagaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgactggagaggtgctggacatcctgacccggctgcctgagagcgtggagcggctgactggagtgtccatcagccaggtgaaccacaagcccctgaggacagcctag

SEQ ID NO: 152632 - DNA, 438 bp, Artificial Sequence; identical to SEQ ID NO: 152618
  Description of Artificial Sequence: Synthetic coding sequence

SEQ ID NO: 152633 - DNA, 558 bp, Artificial Sequence; identical to SEQ ID NO: 152629
  Description of Artificial Sequence: Synthetic coding sequence

SEQ ID NO: 152634 - DNA, 633 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgtacaccaggcatggagtgcccatctctgtgacaggcatcgcccaggtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggcctag

SEQ ID NO: 152635 - DNA, 633 bp, Artificial Sequence; identical to SEQ ID NO: 152634
  Description of Artificial Sequence: Synthetic coding sequence

SEQ ID NO: 152636 - DNA, 759 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgtacaccaggcatggagtgcccatctctgtgacaggcatcgcccaggtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagtag

SEQ ID NO: 152637 - DNA, 444 bp, Artificial Sequence
  Description of Artificial Sequence: Synthetic coding sequence
atgaggccctggtggagccctgtgaagatccagggccagaacaaggagatgctggccgccgcctgccagatgttcctgggcaagacagaagctgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgccagaattggagaggccgaggccaagagagatgctggcatccgggaggccaaggccaagcaggagaaggtgtctgcccagtacctgtctgaaattgagatggcctag

SEQ ID NO: 152638 - DNA, 549 bp, Artificial Sequence
  Description of Artificial Sequence: Synthetic coding sequence
gtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagtag

SEQ ID NO: 152639 - DNA, 348 bp, Artificial Sequence
  Description of Artificial Sequence: Synthetic coding sequence
gtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagaggtag

SEQ ID NO: 152640 - DNA, 708 bp, Artificial Sequence; identical to SEQ ID NO: 152626
  Description of Artificial Sequence: Synthetic coding sequence

SEQ ID NO: 152641 - DNA, 1284 bp, Artificial Sequence; identical to SEQ ID NO: 152615
  Description of Artificial Sequence: Synthetic coding sequence

SEQ ID NO: 152642 - DNA, 498 bp, Artificial Sequence
  Description of Artificial Sequence: Synthetic coding sequence
gtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgactag

SEQ ID NO: 152643 - DNA, 438 bp, Artificial Sequence; identical to SEQ ID NO: 152618
  Description of Artificial Sequence: Synthetic coding sequence

SEQ ID NO: 152644 - DNA, 759 bp, Artificial Sequence; identical to SEQ ID NO: 152636
  Description of Artificial Sequence: Synthetic coding sequence

SEQ ID NO: 152645 - DNA, 759 bp, Artificial Sequence; identical to SEQ ID NO: 152636
  Description of Artificial Sequence: Synthetic coding sequence

SEQ ID NO: 152646 - DNA, 249 bp, Artificial Sequence
  Description of Artificial Sequence: Synthetic coding sequence
gactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgtag

SEQ ID NO: 152647 - DNA, 558 bp, Artificial Sequence; identical to SEQ ID NO: 152629
  Description of Artificial Sequence: Synthetic coding sequence

SEQ ID NO: 152648 - DNA, 759 bp, Artificial Sequence; identical to SEQ ID NO: 152636
  Description of Artificial Sequence: Synthetic coding sequence

SEQ ID NO: 152649 - DNA, 558 bp, Artificial Sequence; identical to SEQ ID NO: 152629
  Description of Artificial Sequence: Synthetic coding sequence

SEQ ID NO: 152650 - DNA, 717 bp, Artificial Sequence; identical to SEQ ID NO: 152621
  Description of Artificial Sequence: Synthetic coding sequence

SEQ ID NO: 152651 - DNA, 1284 bp, Artificial Sequence; identical to SEQ ID NO: 152615
  Description of Artificial Sequence: Synthetic coding sequence

SEQ ID NO: 152652 - DNA, 579 bp, Artificial Sequence; identical to SEQ ID NO: 152619
  Description of Artificial Sequence: Synthetic coding sequence

SEQ ID NO: 152653 - DNA, 708 bp, Artificial Sequence; identical to SEQ ID NO: 152626
  Description of Artificial Sequence: Synthetic coding sequence

SEQ ID NO: 152654 - DNA, 183 bp, Artificial Sequence
  Description of Artificial Sequence: Synthetic coding sequence
gtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagtag

SEQ ID NO: 152655 - DNA, 717 bp, Artificial Sequence; identical to SEQ ID NO: 152621
  Description of Artificial Sequence: Synthetic coding sequence

SEQ ID NO: 152656 - DNA, 708 bp, Artificial Sequence; identical to SEQ ID NO: 152626
  Description of Artificial Sequence: Synthetic coding sequence

SEQ ID NO: 152657 - DNA, 1074 bp, Artificial Sequence
  Description of Artificial Sequence: Synthetic coding sequence
gtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagaagagccagctgatcatgcaggccgaggccgaggccgcctctgtgaggatgagaggagaggccgaggcctttgccatcggggcccgggcccgggcagaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgactggagaggtgctggacatcctgacccggctgcctgagagcgtggagcggctgactggagtgtccatcagccaggtgaaccacaagcccctgaggacagcctag

SEQ ID NO: 152658 - DNA, 36 bp, Artificial Sequence; identical to SEQ ID NO: 81862
  Description of Artificial Sequence: Synthetic coding sequence

SEQ ID NO: 152659 - DNA, 759 bp, Artificial Sequence; identical to SEQ ID NO: 152636
  Description of Artificial Sequence: Synthetic coding sequence

SEQ ID NO: 152660 - DNA, 708 bp, Artificial Sequence; identical to SEQ ID NO: 152626
  Description of Artificial Sequence: Synthetic coding sequence

SEQ ID NO: 152661 - DNA, 558 bp, Artificial Sequence; identical to SEQ ID NO: 152629
  Description of Artificial Sequence: Synthetic coding sequence

SEQ ID NO: 152662 - DNA, 438 bp, Artificial Sequence; identical to SEQ ID NO: 152618
  Description of Artificial Sequence: Synthetic coding sequence

SEQ ID NO: 152663 - DNA, 717 bp, Artificial Sequence; identical to SEQ ID NO: 152621
  Description of Artificial Sequence: Synthetic coding sequence

SEQ ID NO: 152664 - DNA, 1140 bp, Artificial Sequence
  Description of Artificial Sequence: Synthetic coding sequence
atgttcttcacctgtggccccaatgaggccatggtggtgtctggcttctgccgcagcccccctgtgatggtggccggcggccgggtgtttgtgctgccctgcatccagcagatccagaggatcagcctgaacaccctgaccctgaatgtgaagtctgagaaggtgtacaccaggcatggagtgcccatctctgtgacaggcatcgcccaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagaagagccagctgatcatgcaggccgaggccgaggccgcctctgtgaggatgagaggagaggccgaggcctttgccatcggggcccgggcccgggcagaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgactggagaggtgctggacatcctgacccggctgcctgagagcgtggagcggctgactggagtgtccatcagccaggtgaaccacaagcccctgaggacagcctag

SEQ ID NO: 152665 - DNA, 558 bp, Artificial Sequence; identical to SEQ ID NO: 152629
  Description of Artificial Sequence: Synthetic coding sequence

SEQ ID NO: 152666 - DNA, 696 bp, Artificial Sequence
  Description of Artificial Sequence: Synthetic coding sequence
gtgaagatccagggccagaacaaggagatgctggccgccgcctgccagatgttcctgggcaagacagaggccgagatcgcccacatcgccctggagaccctggagggccaccagagggccatcatggcccacatgacagtggaggagatctacaaggaccggcagaagttcagcgagcaggtgttcaaggtggccagcagtgacctggtgaacatgggcatctctgtggtgtcctacaccctgaaggacatccatgatgaccaggactacctgcacagcctgggcaaggccaggacagcccaggtgcagaaggatgcccgcatcggggaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagtag

SEQ ID NO: 152667 - DNA, 633 bp, Artificial Sequence; identical to SEQ ID NO: 152634
  Description of Artificial Sequence: Synthetic coding sequence

SEQ ID NO: 152668 - DNA, 579 bp, Artificial Sequence; identical to SEQ ID NO: 152619
  Description of Artificial Sequence: Synthetic coding sequence

SEQ ID NO: 152669 - DNA, 1140 bp, Artificial Sequence; identical to SEQ ID NO: 152664
  Description of Artificial Sequence: Synthetic coding sequence

SEQ ID NO: 152670 - DNA, 1140 bp, Artificial Sequence; identical to SEQ ID NO: 152664
  Description of Artificial Sequence: Synthetic coding sequence

SEQ ID NO: 152671 - DNA, 1140 bp, Artificial Sequence; identical to SEQ ID NO: 152664
  Description of Artificial Sequence: Synthetic coding sequence

SEQ ID NO: 152672 - DNA, 1140 bp, Artificial Sequence; identical to SEQ ID NO: 152664
  Description of Artificial Sequence: Synthetic coding sequence

SEQ ID NO: 152673 - DNA, 861 bp, Artificial Sequence
  Description of Artificial Sequence: Synthetic coding sequence
atgggcatctctgtggtgtcctacaccctgaaggacatccatgatgaccaggactacctgcacagcctgggcaaggccaggacagcccaggtgcagaaggatgccagaattggagaggccgaggccaagagagatgctggcatccgggaggccaaggccaagcaggagaaggtgtctgcccagtacctgtctgaaattgagatggccaaggcccagagggactatgagctgaagaaggccgcctatgacatcgaggtgaacacccggcgggcccaggccgacctggcctaccagctgcaggtggccaagaccaagcagcagatcgaggagcagagggtgcaggtgcaggtggtggagcgggcccagcaggtggccgtgcaggagcaggagatcgcccggcgggagaaggagctggaggcccgggtgaggaagccagctgaggccgagcgctacaagctggagcggctggccgaggccgagaagagccagctgatcatgcaggccgaggccgaggccgcctctgtgaggatgagaggagaggccgaggcctttgccatcggggcccgggcccgggcagaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgactggagaggtgctggacatcctgacccggctgcctgagagcgtggagcggctgactggagtgtccatcagccaggtgaaccacaagcccctgaggacagcctag

SEQ ID NO: 152674 - DNA, 1452 bp, Artificial Sequence
  Description of Artificial Sequence: Synthetic coding sequence
atgggcaactgccacacagtgggccccaatgaggccctggtggtgtctgggggctgctgcggcagtgactacaagcagtatgtgtttggaggctgggcctgggcctggtggtgcatcagtgacacccagaggctgagcctggaggtgatgaccatcctgtgccgctgtgaaaatattgagaccagcgagggcgtgcccctgtttgtgactggagtggcccaggtgccctgcccctgcctgctggactgcaagtggggcaacagcaagggcttctggaagctgtgccaggtgtgccagatcagcctggagatcatgaccctgcagccccgctgtgaagatgtggagacagctgagggcgtggccctgactgtgactggagtggcccaggtgaagatcatgacagagaaggagctgctggccgtggcctgtgagcagttcctgggcaagaatgtgcaggacatcaagaatgtggtgctgcagaccctggagggccacctgcggagcatcctgggcaccctgactgtggagcagatctaccaggaccgggaccagtttgccaagctggtgcgggaggtggccgccccagatgtgggccgcatgggcatcgagatcctgtccttcaccatcaaggatgtgtatgacaaggtggactacctgagcagcctgggcaagacccagacagctgtggtgcagagagatgctgacatcggcgtggccgaggccgagagagatgctggcatccgggaggccgagtgcaagaaggagatgctggatgtgaagttcatggctgacaccaagattgctgacagcaagagggcctttgagctgcagaagagcgccttcagcgaggaggtgaacatcaagacagctgaggcccagctggcctatgagctgcagggcgcccgggagcagcagaagatccggcaggaggagattgaaattgaggtggtgcagaggaagaagcagattgctgtggaggcccaggagatcctgaggacagacaaggagctgattgccaccgtgcggcggcctgctgaggccgaggcccaccgcatccagcagattgctgagggggagaaggtgaagcaggtgctgctggcccaggccgaggccgagaagatcaggaagattggagaggccgaggccgctgtgattgaggccatgggcaaggccgaggccgagaggatgaagctgaaggccgaggcctaccagaagtatggagatgctgccaagatggccctggtgctggaggccctgccccagattgctgccaagattgctgcccccctgaccaaggtggatgagatcgtggtgctgagcggggacaacagcaaggtgaccagcgaggtgaaccggctgctggccgagctgcctgcctctgtgcacgccctgactggagtggacctgagcaagatccccctcatcaagaaggccactggagtgcaggtgtag

SEQ ID NO: 152675 - DNA, 1287 bp, Artificial Sequence
  Description of Artificial Sequence: Synthetic coding sequence
atgggcaactgccacacagtgggccccaatgaggccctggtggtgtctgggggctgctgcggcagtgactacaagcagtatgtgtttggaggctgggcctgggcctggtggtgcatcagtgacacccagaggatcagcctggagatcatgaccctgcagccccgctgtgaagatgtggagacagctgagggcgtggccctgactgtgactggagtggcccaggtgaagatcatgacagagaaggagctgctggccgtggcctgtgagcagttcctgggcaagaatgtgcaggacatcaagaatgtggtgctgcagaccctggagggccacctgcggagcatcctgggcaccctgactgtggagcagatctaccaggaccgggaccagtttgccaagctggtgcgggaggtggccgccccagatgtgggccgcatgggcatcgagatcctgtccttcaccatcaaggatgtgtatgacaaggtggactacctgagcagcctgggcaagacccagacagctgtggtgcagagagatgctgacattggagtggccgaggccgagagagatgctggcatccgggaggccgagtgcaagaaggagatgctggatgtgaagttcatggctgacaccaagattgctgacagcaagagggcctttgagctgcagaagagcgccttcagcgaggaggtgaacatcaagacagctgaggcccagctggcctatgagctgcagggcgcccgggagcagcagaagatccggcaggaggagattgaaattgaggtggtgcagaggaagaagcagattgctgtggaggcccaggagatcctgaggacagacaaggagctgattgccaccgtgagaagacctgctgaggccgaggcccaccgcatccagcagattgctgagggggagaaggtgaagcaggtgctgctggcccaggccgaggccgagaagatcaggaagatcggggaggccgaggccgccgtcatcgaggccatgggcaaggccgaggccgagaggatgaagctgaaggccgaggcctaccagaagtatggagatgctgccaagatggccctggtgctggaggccctgccccagattgctgccaagattgctgcccccctgaccaaggtggatgaaattgtggtgctgagcggggacaacagcaaggtgaccagcgaggtgaaccggctgctggccgagctgcctgcctctgtgcacgccctgactggagtggacctgagcaagatccccctcatcaagaaggccaccggggtgcaggtgtag

SEQ ID NO: 152676 - DNA, 2982 bp, Artificial Sequence
  Description of Artificial Sequence: Synthetic coding sequence
atgcctgccctggccagagatggcggccagctgcccctgctggtggtgttcagcgccatgatcttcggcaccatcaccaaccaggacctgcctgtgatcaagtgtgtgctgatcaaccacaagaacaatgacagctctgtgggcaagagcagcagctaccccatggtgtctgagagccctgaggacctgggctgtgccctgcggccccagagcagcggcaccgtgtatgaggccgctgctgtggaggtggatgtgtctgccagcatcaccctgcaggtgctggtggatgcccctggcaacatcagctgcctgtgggtgttcaagcacagcagcctgaactgccagccccactttgacctgcagaacagaggagtggtgtccatggtgatcctgaagatgacagagacccaggccggggagtacctgctcttcatccagagcgaggccaccaactacaccatcctcttcaccgtgtccatccggaacaccctgctgtacaccctgcggcggccctacttcaggaagatggagaaccaggatgccctggtgtgcatcagcgagagcgtgcctgagcccatcgtggagtgggtgctgtgtgacagccagggcgagagctgcaaggaggagagccctgctgtggtgaagaaggaggagaaggtgctgcacgagctgtttggaacagacatccgctgctgtgccagaaatgagctgggccgggagtgcaccaggctcttcaccatcgacctgaaccagaccccccagaccaccctgccccagctgttcctgaaggtgggggagcccctgtggatccgctgcaaggctgtgcacgtgaaccacggcttcggcctgacctgggagctggagaacaaggccctggaggagggcaactactttgagatgagcacctacagcaccaacagaaccatgatccgcatcctgtttgcctttgtgtcctctgtggccagaaatgacaccggctactacacctgcagcagcagcaagcaccccagccagagcgccctggtgaccatcgtggagaagggcttcatcaatgccaccaacagcagtgaagattatgaaattgaccagtatgaggagttctgcttctctgtgcgcttcaaggcctacccccagatccgctgcacctggaccttcagcaggaagagcttcccctgtgagcagaagggcctggacaatggctacagcatcagcaagttctgcaaccacaagcaccagcctggagagtacatcttccacgcagaaaatgatgatgcccagttcaccaagatgttcaccctgaacatccggaggaagccccaggtgctggccgaggccagcgccagccaggccagctgcttcagtgatggctaccccctgcccagctggacctggaagaagtgcagcgacaagagccccaactgcacagaggagatcacagaaggagtgtggaacaggaaggccaacaggaaggtgtttggccagtgggtgagcagcagcaccctgaacatgtctgaggccatcaagggcttcctggtgaagtgctgtgcctacaacagcctgggcaccagctgtgagaccatcctgctgaacagccctggccccttccccttcatccaggacaacatctccttctacgccaccatcggcgtgtgcctgctcttcatcgtggtgctgaccctgctgatctgccacaagtacaagaagcagttccgctatgagagccagctgcagatggtgcaggtgacaggcagcagtgacaatgagtacttctacgtggacttccgggagtatgaatatgacctgaagtgggagttcccccgggagaacctggagtttgggaaggtgctgggcagcggggccttcggcaaggtgatgaatgccacagcctacggcatcagcaagacaggagtgtccatccaggtggccgtgaagatgctgaaggagaaggctgacagcagcgagcgggaggccctgatgtctgagctgaagatgatgacccagctgggcagccatgagaacatcgtgaacctgctgggcgcctgcaccctgagcggccccatctacctgatctttgagtactgctgctacggggacctgctgaactacctgcggagcaagcgggagaagttccacaggacctggacagagatcttcaaggagcacaacttctccttctaccccaccttccagagccaccccaacagctccatgcctggcagccgggaggtgcagatccacccagacagcgaccagatcagcggcctgcacggcaacagcttccacagtgaagatgaaattgaatatgagaaccagaagaggctggaggaggaggaggacctgaatgtgctgacctttgaggacctgctgtgctttgcctaccaggtggccaagggcatggagttcctggagttcaagagctgtgtgcaccgggacctggccgccagaaatgtgctggtgacccacggcaaggtggtgaagatctgtgactttggcctggcccgggacatcatgtctgacagcaactacgtggtgagaggaaatgcccggctgcctgtgaagtggatggcccctgagagcctgtttgagggcatctacaccatcaagagtgatgtgtggagctatggcatcctgctgtgggagatcttcagcctgggcgtgaacccctacccaggcatccctgtggatgccaacttctacaagctgatccagaatggcttcaagatggaccagcccttctacgccacagaggagatctacatcatcatgcagagctgctgggcctttgacagcaggaagaggcccagcttccccaacctgaccagcttcctgggctgccagctggctgatgctgaggaggccatgtaccagaatgtggatggccgggtgtctgagtgcccccacacctaccagaacagaagacccttcagccgggagatggacctgggcctgctgagcccccaggcccaggtggaggacagctag

SEQ ID NO: 152677 - DNA, 2991 bp, Artificial Sequence
  Description of Artificial Sequence: Synthetic coding sequence
atgcctgccctggccagagatggcggccagctgcccctgctggtggtgttcagcgccatgatcttcggcaccatcaccaaccaggacctgcctgtgatcaagtgtgtgctgatcaaccacaagaacaatgacagctctgtgggcaagagcagcagctaccccatggtgtctgagagccctgaggacctgggctgtgccctgcggccccagagcagcggcaccgtgtatgaggccgctgctgtggaggtggatgtgtctgccagcatcaccctgcaggtgctggtggatgcccctggcaacatcagctgcctgtgggtgttcaagcacagcagcctgaactgccagccccactttgacctgcagaacagaggagtggtgtccatggtgatcctgaagatgacagagacccaggccggggagtacctgctcttcatccagagcgaggccaccaactacaccatcctcttcaccgtgtccatccggaacaccctgctgtacaccctgcggcggccctacttcaggaagatggagaaccaggatgccctggtgtgcatcagcgagagcgtgcctgagcccatcgtggagtgggtgctgtgtgacagccagggcgagagctgcaaggaggagagccctgctgtggtgaagaaggaggagaaggtgctgcacgagctgtttggaacagacatccgctgctgtgccagaaatgagctgggccgggagtgcaccaggctcttcaccatcgacctgaaccagaccccccagaccaccctgccccagctgttcctgaaggtgggggagcccctgtggatccgctgcaaggctgtgcacgtgaaccacggcttcggcctgacctgggagctggagaacaaggccctggaggagggcaactactttgagatgagcacctacagcaccaacagaaccatgatccgcatcctgtttgcctttgtgtcctctgtggccagaaatgacaccggctactacacctgcagcagcagcaagcaccccagccagagcgccctggtgaccatcgtggagaagggcttcatcaatgccaccaacagcagtgaagattatgaaattgaccagtatgaggagttctgcttctctgtgcgcttcaaggcctacccccagatccgctgcacctggaccttcagcaggaagagcttcccctgtgagcagaagggcctggacaatggctacagcatcagcaagttctgcaaccacaagcaccagcctggagagtacatcttccacgcagaaaatgatgatgcccagttcaccaagatgttcaccctgaacatccggaggaagccccaggtgctggccgaggccagcgccagccaggccagctgcttcagtgatggctaccccctgcccagctggacctggaagaagtgcagcgacaagagccccaactgcacagaggagatcacagaaggagtgtggaacaggaaggccaacaggaaggtgtttggccagtgggtgagcagcagcaccctgaacatgtctgaggccatcaagggcttcctggtgaagtgctgtgcctacaacagcctgggcaccagctgtgagaccatcctgctgaacagccctggccccttccccttcatccaggacaacatctccttctacgccaccatcggcgtgtgcctgctcttcatcgtggtgctgaccctgctgatctgccacaagtacaagaagcagttccgctatgagagccagctgcagatggtgcaggtgacaggcagcagtgacaatgagtacttctacgtggacttccgggagtatgaatatgacctgaagtgggagttcccccgggagaacctggagtttgggaaggtgctgggcagcggggccttcggcaaggtgatgaatgccacagcctacggcatcagcaagacaggagtgtccatccaggtggccgtgaagatgctgaaggagaaggctgacagcagcgagcgggaggccctgatgtctgagctgaagatgatgacccagctgggcagccatgagaacatcgtgaacctgctgggcgcctgcaccctgagcggccccatctacctgatctttgagtactgctgctacggggacctgctgaactacctgcggagcaagcgggagaagttccacaggacctggacagagatcttcaaggagcacaacttctccttctaccccaccttccagagccaccccaacagctccatgcctggcagccgggaggtgcagatccacccagacagcgaccagatcagcggcctgcacggcaacagcttccacagtgaagatgaaattgaatatgagaaccagaagaggctggaggaggaggaggacctgaatgtgctgacctttgaggacctgctgtgctttgcctaccaggtggccaagggcatggagttcctggagttcaagagctgtgtgcaccgggacctggccgccagaaatgtgctggtgacccacggcaaggtggtgaagatctgtgactttggcctggcccgggacatcatgtctgacagcaactacgtggtgagaggaaatgtgcggctggcccggctgcctgtgaagtggatggcccctgagagcctgtttgagggcatctacaccatcaagagtgatgtgtggagctatggcatcctgctgtgggagatcttcagcctgggcgtgaacccctacccaggcatccctgtggatgccaacttctacaagctgatccagaatggcttcaagatggaccagcccttctacgccacagaggagatctacatcatcatgcagagctgctgggcctttgacagcaggaagaggcccagcttccccaacctgaccagcttcctgggctgccagctggctgatgctgaggaggccatgtaccagaatgtggatggccgggtgtctgaatgtccccacacctaccagaacagaagacccttcagccgggagatggacctgggcctgctgagcccccaggcccaggtggaggacagctag

SEQ ID NO: 152678 - DNA, 2859 bp, Artificial Sequence
  Description of Artificial Sequence: Synthetic coding sequence
atgcctgccctggccagagatggcggccagctgcccctgctggtggtgttcagcgccatgatcttcggcaccatcaccaaccaggacctgcctgtgatcaagtgtgtgctgatcaaccacaagaacaatgacagctctgtgggcaagagcagcagctaccccatggtgtctgagagccctgaggacctgggctgtgccctgcggccccagagcagcggcaccgtgtatgaggccgctgctgtggaggtggatgtgtctgccagcatcaccctgcaggtgctggtggatgcccctggcaacatcagctgcctgtgggtgttcaagcacagcagcctgaactgccagccccactttgacctgcagaacagaggagtggtgtccatggtgatcctgaagatgacagagacccaggccggggagtacctgctcttcatccagagcgaggccaccaactacaccatcctcttcaccgtgtccatccggaacaccctgctgtacaccctgcggcggccctacttcaggaagatggagaaccaggatgccctggtgtgcatcagcgagagcgtgcctgagcccatcgtggagtgggtgctgtgtgacagccagggcgagagctgcaaggaggagagccctgctgtggtgaagaaggaggagaaggtgctgcacgagctgtttggaacagacatccgctgctgtgccagaaatgagctgggccgggagtgcaccaggctcttcaccatcgacctgaaccagaccccccagaccaccctgccccagctgttcctgaaggtgggggagcccctgtggatccgctgcaaggctgtgcacgtgaaccacggcttcggcctgacctgggagctggagaacaaggccctggaggagggcaactactttgagatgagcacctacagcaccaacagaaccatgatccgcatcctgtttgcctttgtgtcctctgtggccagaaatgacaccggctactacacctgcagcagcagcaagcaccccagccagagcgccctggtgaccatcgtggagaagggcttcatcaatgccaccaacagcagtgaagattatgaaattgaccagtatgaggagttctgcttctctgtgcgcttcaaggcctacccccagatccgctgcacctggaccttcagcaggaagagcttcccctgtgagcagaagggcctggacaatggctacagcatcagcaagttctgcaaccacaagcaccagcctggagagtacatcttccacgcagaaaatgatgatgcccagttcaccaagatgttcaccctgaacatccggaggaagccccaggtgctggccgaggccagcgccagccaggccagctgcttcagtgatggctaccccctgcccagctggacctggaagaagtgcagcgacaagagccccaactgcacagaggagatcacagaaggagtgtggaacaggaaggccaacaggaaggtgtttggccagtgggtgagcagcagcaccctgaacatgtctgaggccatcaagggcttcctggtgaagtgctgtgcctacaacagcctgggcaccagctgtgagaccatcctgctgaacagccctggccccttccccttcatccaggacaacatctccttctacgccaccatcggcgtgtgcctgctcttcatcgtggtgctgaccctgctgatctgccacaagtacaagaagcagttccgctatgagagccagctgcagatggtgcaggtgacaggcagcagtgacaatgagtacttctacgtggacttccgggagtatgaatatgacctgaagtgggagttcccccgggagaacctggagtttgggaaggtgctgggcagcggggccttcggcaaggtgatgaatgccacagcctacggcatcagcaagacaggagtgtccatccaggtggccgtgaagatgctgaaggagaaggctgacagcagcgagcgggaggccctgatgtctgagctgaagatgatgacccagctgggcagccatgagaacatcgtgaacctgctgggcgcctgcaccctgagcggccccatctacctgatctttgagtactgctgctacggggacctgctgaactacctgcggagcaagcgggagaagttccacaggacctggacagagatcttcaaggagcacaacttctccttctaccccaccttccagagccaccccaacagctccatgcctggcagccgggaggtgcagatccacccagacagcgaccagatcagcggcctgcacggcaacagcttccacagtgaagatgaaattgaatatgagaaccagaagaggctggaggaggaggaggacctgaatgtgctgacctttgaggacctgctgtgctttgcctaccaggtggccaagggcatggagttcctggagttcaagagcgcccggctgcctgtgaagtggatggcccctgagagcctgtttgagggcatctacaccatcaagagtgatgtgtggagctatggcatcctgctgtgggagatcttcagcctgggcgtgaacccctacccaggcatccctgtggatgccaacttctacaagctgatccagaatggcttcaagatggaccagcccttctacgccacagaggagatctacatcatcatgcagagctgctgggcctttgacagcaggaagaggcccagcttccccaacctgaccagcttcctgggctgccagctggctgatgctgaggaggccatgtaccagaatgtggatggccgggtgtctgaatgtccccacacctaccagaacagaagacccttcagccgggagatggacctgggcctgctgagcccccaggcccaggtggaggacagctag

SEQ ID NO: 152679 - DNA, 2253 bp, Artificial Sequence
  Description of Artificial Sequence: Synthetic coding sequence
atgtggaacctgctgcacgagacagacagcgctgtggccacagcccggcggccccgctggctgtgtgccggggccctggtgctggccggcggcttcttcctgctgggcttcctgtttggctggttcatcaagagcagcaatgaggccaccaacatcacccccaagcacaacatgaaggccttcctggatgagctgaaggccgagaacatcaagaagttcctgtacaacttcacccagatcccccacctggccggcacagagcagaacttccagctggccaagcagatccagagccagtggaaggagtttggcctggacagcgtggagctggcccactatgatgtgctgctgagctaccccaacaagacccaccccaactacatcagcatcatcaatgaagatggaaatgagatcttcaacaccagcctgtttgagcccccacctcctggctatgaaaatgtgtctgacatcgtgccccccttcagcgccttcagcccccagggcatgcctgagggggacctggtgtatgtgaactatgccaggacagaggacttcttcaagctggagcgggacatgaagatcaactgcagcggcaagatcgtcatcgcccgctatggcaaggtgttccggggcaacaaggtgaagaatgcccagctggccggggccaagggcgtcatcctgtacagcgaccctgctgactactttgcccctggggtgaagagctacccagatggctggaacctgcccggcggcggcgtgcagaggggcaacatcctgaacctgaatggagctggggaccccctgaccccaggctacccagccaatgaatatgcctaccgccggggcattgctgaggccgtgggcctgcccagcatccctgtgcaccccatcggctactatgatgcccagaagctgctggagaagatgggcggcagcgcccccccagacagctcctggaggggcagcctgaaggtgccctacaacgtgggccctggcttcaccggcaacttcagcacccagaaggtgaagatgcacatccacagcaccaatgaggtgacccgcatctacaacgtgattggcaccctgcggggagctgtggagccagacagatatgtgatcctgggcggccaccgggacagctgggtgtttggaggcatcgacccccagagcggggctgctgtggtgcatgagatcgtgcgcagctttggcaccctgaagaaggagggctggaggcccaggaggaccatcctgtttgcctcctgggatgctgaggagtttggcctgctgggcagcacagagtgggccgaggagaacagccggctgctgcaggagcggggcgtggcctacatcaatgctgacagcagcattgagggcaactacaccctgcgggtggactgcacccccctgatgtacagcctggtgcacaacctgaccaaggagctgaagagcccagatgagggctttgagggcaagagcctgtatgagagctggaccaagaagagccccagccctgagttcagcggcatgccccgcatcagcaagctgggcagcggaaatgactttgaggtgttcttccagaggctgggcatcgccagcggccgggcccgctacaccaagaactgggagaccaacaagttcagcggctaccccctgtaccacagcgtgtatgagacctatgagctggtggagaagttctatgaccccatgttcaagtaccacctgactgtggcccaggtgcggggcggcatggtgtttgagctggccaacagcatcgtgctgccctttgactgccgggactatgctgtggtgctgaggaaatatgctgacaagatctacagcatctccatgaagcacccccaggagatgaagacctacagcgtgtcctttgacagcctcttctctgctgtgaagaacttcacagagatcgccagcaagttcagcgagcggctgcaggactttgacaagagcaaccccatcgtgctgaggatgatgaatgaccagctgatgttcctggagcgggccttcatcgaccccctgggcctgcctgaccggcccttctacagacatgtgatctatgcccccagcagccacaacaagtatgctggggagagcttccctggcatctatgatgccctgtttgatattgagagcaaggtggaccccagcaaggcctggggcgaggtgaagaggcagatctacgtggccgccttcaccgtgcaggccgctgctgagaccctgtctgaggtggcctag

SEQ ID NO: 152680 - DNA, 2208 bp, Artificial Sequence
  Description of Artificial Sequence: Synthetic coding sequence
atgacagctggcagcagctaccccctcttcctggccgcctatgcctgcaccggctgcctggccgagcggctgggctggttcatcaagagcagcaatgaggccaccaacatcacccccaagcacaacatgaaggccttcctggatgagctgaaggccgagaacatcaagaagttcctgtacaacttcacccagatcccccacctggccggcacagagcagaacttccagctggccaagcagatccagagccagtggaaggagtttggcctggacagcgtggagctggcccactatgatgtgctgctgagctaccccaacaagacccaccccaactacatcagcatcatcaatgaagatggaaatgagatcttcaacaccagcctgtttgagcccccacctcctggctatgaaaatgtgtctgacatcgtgccccccttcagcgccttcagcccccagggcatgcctgagggggacctggtgtatgtgaactatgccaggacagaggacttcttcaagctggagcgggacatgaagatcaactgcagcggcaagatcgtgattgcccgctatggcaaggtgttccggggcaacaaggtgaagaatgcccagctggccggggccaagggcgtcatcctgtacagcgaccctgctgactactttgcccctggggtgaagagctacccagatggctggaacctgcccggcggcggcgtgcagaggggcaacatcctgaacctgaatggagctggggaccccctgaccccaggctacccagccaatgaatatgcctacagaagaggaattgctgaggccgtgggcctgcccagcatccctgtgcaccccatcggctactatgatgcccagaagctgctggagaagatgggcggcagcgcccccccagacagctcctggaggggcagcctgaaggtgccctacaacgtgggccctggcttcaccggcaacttcagcacccagaaggtgaagatgcacatccacagcaccaatgaggtgacccgcatctacaacgtcatcggcaccctgcggggagctgtggagccagaccgctacgtgatcctgggcggccaccgggacagctgggtgtttggaggcatcgacccccagagcggggctgctgtggtgcatgaaattgtgcgcagctttggcaccctgaagaaggagggctggaggcccaggaggaccatcctgtttgcctcctgggatgctgaggagtttggcctgctgggcagcacagagtgggccgaggagaacagccggctgctgcaggagcggggcgtggcctacatcaatgctgacagcagcattgagggcaactacaccctgcgggtggactgcacccccctgatgtacagcctggtgcacaacctgaccaaggagctgaagagcccagatgagggctttgagggcaagagcctgtatgaatcctggaccaagaagagccccagccctgagttcagcggcatgccccgcatcagcaagctgggcagcggaaatgactttgaggtgttcttccagaggctgggcatcgccagcggccgggcccgctacaccaagaactgggagaccaacaagttcagcggctaccccctgtaccacagcgtgtatgagacctatgagctggtggagaagttctatgaccccatgttcaagtaccacctgactgtggcccaggtgcggggcggcatggtgtttgagctggccaacagcatcgtgctgccctttgactgccgggactatgctgtggtgctgaggaaatatgctgacaagatctacagcatctccatgaagcacccccaggagatgaagacctacagcgtgtcctttgacagcctcttctctgctgtgaagaacttcacagaaattgccagcaagttcagcgagcggctgcaggactttgacaagagcaaccccatcgtgctgaggatgatgaatgaccagctgatgttcctggagcgggccttcatcgaccccctgggcctgcctgaccggcccttctaccgccacgtgatctatgcccccagcagccacaacaagtatgctggggagagcttccctggcatctatgatgccctgtttgacatcgagagcaaggtggaccccagcaaggcctggggcgaggtgaagaggcagatctacgtggccgccttcaccgtgcaggccgctgctgagaccctgtctgaggtggcctag

SEQ ID NO: 152681 - DNA, 1329 bp, Artificial Sequence
  Description of Artificial Sequence: Synthetic coding sequence
atgggcggcagcgcccccccagacagctcctggaggggcagcctgaaggtgccctacaacgtgggccctggcttcaccggcaacttcagcacccagaaggtgaagatgcacatccacagcaccaatgaggtgacccgcatctacaacgtgattggcaccctgcggggagctgtggagccagacagatatgtgatcctgggcggccaccgggacagctgggtgtttggaggcatcgacccccagagcggggctgctgtggtgcatgagatcgtgcgcagctttggcaccctgaagaaggagggctggaggcccaggaggaccatcctgtttgcctcctgggatgctgaggagtttggcctgctgggcagcacagagtgggccgaggagaacagccggctgctgcaggagcggggcgtggcctacatcaatgctgacagcagcattgagggcaactacaccctgcgggtggactgcacccccctgatgtacagcctggtgcacaacctgaccaaggagctgaagagcccagatgagggctttgagggcaagagcctgtatgagagctggaccaagaagagccccagccctgagttcagcggcatgccccgcatcagcaagctgggcagcggaaatgactttgaggtgttcttccagaggctgggcatcgccagcggccgggcccgctacaccaagaactgggagaccaacaagttcagcggctaccccctgtaccacagcgtgtatgagacctatgagctggtggagaagttctatgaccccatgttcaagtaccacctgactgtggcccaggtgcggggcggcatggtgtttgagctggccaacagcatcgtgctgccctttgactgccgggactatgctgtggtgctgaggaaatatgctgacaagatctacagcatctccatgaagcacccccaggagatgaagacctacagcgtgtcctttgacagcctcttctctgctgtgaagaacttcacagagatcgccagcaagttcagcgagcggctgcaggactttgacaagagcaaccccatcgtgctgaggatgatgaatgaccagctgatgttcctggagcgggccttcatcgaccccctgggcctgcctgaccggcccttctacagacatgtgatctatgcccccagcagccacaacaagtatgctggggagagcttccctggcatctatgatgccctgtttgatattgagagcaaggtggaccccagcaaggcctggggcgaggtgaagaggcagatctacgtggccgccttcaccgtgcaggccgctgctgagaccctgtctgaggtggcctag

SEQ ID NO: 152682 - DNA, 2160 bp, Artificial Sequence
  Description of Artificial Sequence: Synthetic coding sequence
atgtggaacctgctgcacgagacagacagcgctgtggccacagcccggcggccccgctggctgtgtgccggggccctggtgctggccggcggcttcttcctgctgggcttcctgtttggctggttcatcaagagcagcaatgaggccaccaacatcacccccaagcacaacatgaaggccttcctggatgagctgaaggccgagaacatcaagaagttcctgtacaacttcacccagatcccccacctggccggcacagagcagaacttccagctggccaagcagatccagagccagtggaaggagtttggcctggacagcgtggagctggcccactatgatgtgctgctgagctaccccaacaagacccaccccaactacatcagcatcatcaatgaagatggaaatgagatcttcaacaccagcctgtttgagcccccacctcctggctatgaaaatgtgtctgacatcgtgccccccttcagcgccttcagcccccagggcatgcctgagggggacctggtgtatgtgaactatgccaggacagaggacttcttcaagctggagcgggacatgaagatcaactgcagcggcaagatcgtcatcgcccgctatggcaaggtgttccggggcaacaaggtgaagaatgcccagctggccggggccaagggcgtcatcctgtacagcgaccctgctgactactttgcccctggggtgaagagctacccagatggctggaacctgcccggcggcggcgtgcagaggggcaacatcctgaacctgaatggagctggggaccccctgaccccaggctacccagccaatgaatatgcctaccgccggggcattgctgaggccgtgggcctgcccagcatccctgtgcaccccatcggctactatgatgcccagaagctgctggagaagatgggcggcagcgcccccccagacagctcctggaggggcagcctgaaggtgccctacaacgtgggccctggcttcaccggcaacttcagcacccagaaggtgaagatgcacatccacagcaccaatgaggtgacccgcatctacaacgtgattggcaccctgcggggagctgtggagccagacagatatgtgatcctgggcggccaccgggacagctgggtgtttggaggcatcgacccccagagcggggctgctgtggtgcatgagatcgtgcgcagctttggcaccctgaagaaggagggctggaggcccaggaggaccatcctgtttgcctcctgggatgctgaggagtttggcctgctgggcagcacagagtgggccgaggagaacagccggctgctgcaggagcggggcgtggcctacatcaatgctgacagcagcattgagggcaactacaccctgcgggtggactgcacccccctgatgtacagcctggtgcacaacctgaccaaggagctgaagagcccagatgagggctttgagggcaagagcctgtatgagagctggaccaagaagagccccagccctgagttcagcggcatgccccgcatcagcaagctgggcagcggaaatgactttgaggtgttcttccagaggctgggcatcgccagcggccgggcccgctacaccaagaactgggagaccaacaagttcagcggctaccccctgtaccacagcgtgtatgagacctatgagctggtggagaagttctatgaccccatgttcaagtaccacctgactgtggcccaggtgcggggcggcatggtgtttgagctggccaacagcatcgtgctgccctttgactgccgggactatgctgtggtgctgaggaaatatgctgacaagatctacagcatctccatgaagcacccccaggagatgaagacctacagcgtgtcctttgacagcctcttctctgctgtgaagaacttcacagagatcgccagcaagttcagcgagcggctgcaggactttgacaagagcaagcacgtgatctatgcccccagcagccacaacaagtatgctggggagagcttccctggcatctatgatgccctgtttgacatcgagagcaaggtggaccccagcaaggcctggggcgaggtgaagaggcagatctacgtggccgccttcaccgtgcaggccgctgctgagaccctgtctgaggtggcctag

SEQ ID NO: 152683 - DNA, 1638 bp, Artificial Sequence
  Description of Artificial Sequence: Synthetic coding sequence
atgtggaacctgctgcacgagacagacagcgctgtggccacagcccggcggccccgctggctgtgtgccggggccctggtgctggccggcggcttcttcctgctgggcttcctgtttggctggttcatcaagagcagcaatgaggccaccaacatcacccccaagcacaacatgaaggccttcctggatgagctgaaggccgagaacatcaagaagttcctgtacaacttcacccagatcccccacctggccggcacagagcagaacttccagctggccaagcagatccagagccagtggaaggagtttggcctggacagcgtggagctggcccactatgatgtgctgctgagctaccccaacaagacccaccccaactacatcagcatcatcaatgaagatggaaatgagatcttcaacaccagcctgtttgagcccccacctcctggctatgaaaatgtgtctgacatcgtgccccccttcagcgccttcagcccccagggcatgcctgagggggacctggtgtatgtgaactatgccaggacagaggacttcttcaagctggagcgggacatgaagatcaactgcagcggcaagatcgtcatcgcccgctatggcaaggtgttccggggcaacaaggtgaagaatgcccagctggccggggccaagggcgtcatcctgtacagcgaccctgctgactactttgcccctggggtgaagagctacccagatggctggaacctgcccggcggcggcgtgcagaggggcaacatcctgaacctgaatggagctggggaccccctgaccccaggctacccagccaatgaatatgcctaccgccggggcattgctgaggccgtgggcctgcccagcatccctgtgcaccccatcggctactatgatgcccagaagctgctggagaagatgggcggcagcgcccccccagacagctcctggaggggcagcctgaaggtgccctacaacgtgggccctggcttcaccggcaacttcagcacccagaaggtgaagatgcacatccacagcaccaatgaggtgacccgcatctacaacgtgattggcaccctgcggggagctgtggagccagacagatatgtgatcctgggcggccaccgggacagctgggtgtttggaggcatcgacccccagagcggggctgctgtggtgcatgagatcgtgcgcagctttggcaccctgaagaaggaggacatcctgggctggaggcccaggaggaccatcctgtttgcctcctgggatgctgaggagtttggcctgctgggcagcacagagtgggccgaggagaacagccggctgctgcaggagcggggcgtggcctacatcaatgctgacagcagcattgagggcaactacaccctgcgggtggactgcacccccctgatgtacagcctggtgcacaacctgaccaaggagctgaagagcccagatgagggctttgagggcaagagcctgtatgaatcctggaccaagaagagccccagccctgagttcagcggcatgccccgcatcagcaagctgggcagcggaaatgactttgaggtgttcttccagaggctgggcatcgccagcggccgggcccgctacaccaagaagaagaagtag

SEQ ID NO: 152684 - DNA, 2115 bp, Artificial Sequence
  Description of Artificial Sequence: Synthetic coding sequence
atgacagctggcagcagctaccccctcttcctggccgcctatgcctgcaccggctgcctggccgagcggctgggctggttcatcaagagcagcaatgaggccaccaacatcacccccaagcacaacatgaaggccttcctggatgagctgaaggccgagaacatcaagaagttcctgtacaacttcacccagatcccccacctggccggcacagagcagaacttccagctggccaagcagatccagagccagtggaaggagtttggcctggacagcgtggagctggcccactatgatgtgctgctgagctaccccaacaagacccaccccaactacatcagcatcatcaatgaagatggaaatgagatcttcaacaccagcctgtttgagcccccacctcctggctatgaaaatgtgtctgacatcgtgccccccttcagcgccttcagcccccagggcatgcctgagggggacctggtgtatgtgaactatgccaggacagaggacttcttcaagctggagcgggacatgaagatcaactgcagcggcaagatcgtgattgcccgctatggcaaggtgttccggggcaacaaggtgaagaatgcccagctggccggggccaagggcgtcatcctgtacagcgaccctgctgactactttgcccctggggtgaagagctacccagatggctggaacctgcccggcggcggcgtgcagaggggcaacatcctgaacctgaatggagctggggaccccctgaccccaggctacccagccaatgaatatgcctacagaagaggaattgctgaggccgtgggcctgcccagcatccctgtgcaccccatcggctactatgatgcccagaagctgctggagaagatgggcggcagcgcccccccagacagctcctggaggggcagcctgaaggtgccctacaacgtgggccctggcttcaccggcaacttcagcacccagaaggtgaagatgcacatccacagcaccaatgaggtgacccgcatctacaacgtcatcggcaccctgcggggagctgtggagccagaccgctacgtgatcctgggcggccaccgggacagctgggtgtttggaggcatcgacccccagagcggggctgctgtggtgcatgaaattgtgcgcagctttggcaccctgaagaaggagggctggaggcccaggaggaccatcctgtttgcctcctgggatgctgaggagtttggcctgctgggcagcacagagtgggccgaggagaacagccggctgctgcaggagcggggcgtggcctacatcaatgctgacagcagcattgagggcaactacaccctgcgggtggactgcacccccctgatgtacagcctggtgcacaacctgaccaaggagctgaagagcccagatgagggctttgagggcaagagcctgtatgaatcctggaccaagaagagccccagccctgagttcagcggcatgccccgcatcagcaagctgggcagcggaaatgactttgaggtgttcttccagaggctgggcatcgccagcggccgggcccgctacaccaagaactgggagaccaacaagttcagcggctaccccctgtaccacagcgtgtatgagacctatgagctggtggagaagttctatgaccccatgttcaagtaccacctgactgtggcccaggtgcggggcggcatggtgtttgagctggccaacagcatcgtgctgccctttgactgccgggactatgctgtggtgctgaggaaatatgctgacaagatctacagcatctccatgaagcacccccaggagatgaagacctacagcgtgtcctttgacagcctcttctctgctgtgaagaacttcacagaaattgccagcaagttcagcgagcggctgcaggactttgacaagagcaagcacgtgatctatgcccccagcagccacaacaagtatgctggggagagcttccctggcatctatgatgccctgtttgatattgagagcaaggtggaccccagcaaggcctggggcgaggtgaagaggcagatctacgtggccgccttcaccgtgcaggccgctgctgagaccctgtctgaggtggcctag

SEQ ID NO: 152685 - DNA, 774 bp, Artificial Sequence
  Description of Artificial Sequence: Synthetic coding sequence
atggcccagaggatgaccacccagctgctgctgctgctggtgtgggtggccgtggtgggggaggcccagacccgcatcgcctgggccaggacagagctgctgaatgtgtgcatgaatgccaagcaccacaaggagaagccaggccctgaggacaagctgcacgagcagtgccggccctggaggaagaatgcctgctgcagcaccaacaccagccaggaggcccacaaggatgtgtcctacctgtaccgcttcaactggaaccactgtggggagatggccccagcctgcaagaggcacttcatccaggacacctgcctgtatgagtgcagccccaacctgggcccctggatccagcaggtggaccagagctggaggaaggagcgggtgctgaatgtgcccctgtgcaaggaggactgtgagcagtggtgggaggactgcaggaccagctacacctgcaagagcaactggcacaagggctggaactggaccagcggcttcaacaagtgtgctgtgggcgccgcctgccagcccttccacttctacttccccacccccaccgtgctgtgcaatgagatctggacccacagctacaaggtgagcaactacagccggggcagcggccgctgcatccagatgtggtttgatcctgcccagggcaaccccaatgaggaggtggcccgcttctacgccgccgccatgtctggggccggcccctgggccgcctggcccttcctgctgagcctggccctgatgctgctgtggctgctgtcctag

SEQ ID NO: 152686 - DNA, 774 bp, Artificial Sequence; identical to SEQ ID NO: 152685
  Description of Artificial Sequence: Synthetic coding sequence

SEQ ID NO: 152687 - DNA, 774 bp, Artificial Sequence; identical to SEQ ID NO: 152685
  Description of Artificial Sequence: Synthetic coding sequence

SEQ ID NO: 152688 - DNA, 774 bp, Artificial Sequence; identical to SEQ ID NO: 152685
  Description of Artificial Sequence: Synthetic coding sequence

SEQ ID NO: 152689 - DNA, 768 bp, Artificial Sequence
  Description of Artificial Sequence: Synthetic coding sequence
atggtgtggaagtggatgcccctgctgctgctgctggtgtgtgtggccaccatgtgcagcgcccaggacagaacagacctgctgaatgtgtgcatggatgccaagcaccacaagaccaagccaggccctgaggacaagctgcatgaccagtgcagcccctggaagaagaatgcctgctgcacagccagcaccagccaggagctgcacaaggacaccagccggctgtacaacttcaactgggaccactgcggcaagatggagcccgcctgcaagaggcacttcatccaggacacctgcctgtatgagtgcagccccaacctgggcccctggatccagcaggtgaaccagagctggaggaaggagcgcttcctggatgtgcccctgtgcaaggaggactgccagcgctggtgggaggactgccacaccagccacacctgcaagagcaactggcaccggggctgggactggaccagcggcgtgaacaagtgcccagctggggccctgtgcaggacctttgagagctacttccccaccccagctgccctgtgtgagggcctgtggagccacagctacaaggtgagcaactacagccggggcagcggccgctgcatccagatgtggtttgacagcgcccagggcaaccccaatgaggaggtggcccgcttctacgccgccgccatgcacgtgaatgctggggagatgctgcacggcaccggcggcctgctgctgagcctggccctgatgctgcagctgtggctgctgggctag

SEQ ID NO: 152690 - DNA, 729 bp, Artificial Sequence
  Description of Artificial Sequence: Synthetic coding sequence
atgctgcctgctgccacagaggtgcagctgcggctgcagggccagaaggacatggtgtggaagtggatgcccctgctgctgctgctggtgtgtgtggccaccatgtgcagcgcccaggacagaacagacctgctgaatgtgtgcatggatgccaagcaccacaagaccaagccaggccctgaggacaagctgcatgaccagtgcagcccctggaagaagaatgcctgctgcacagccagcaccagccaggagctgcacaaggacaccagccggctgtacaacttcaactgggaccactgtgggaagatggagcccgcctgtgccaccagcagcaggacccctgtgtccatgtctgcccaccctggggccctggaccctgctggggagagcgagctggccaagaatgcctcctggatgtgcccctatgccaagaggacagtgtctgctgggggcagaattgtgaccccacccacccgggcccgggccactggaacagaagatggcaccggcccccaggagctgaccagcgcccagctgggcctgtctgctgcccccctgagccccaccagccccctgcagctgccctttgtgaaggccagcggcgtgacccacaccaggtctgccaccacagctgagggcgctgctgctgccagccgctgtggcctcatccagccccgggccacccccaccaggaagtggaggggctccatgctgcagccctgcatgtag

SEQ ID NO: 152691 - DNA, 516 bp, Artificial Sequence
  Description of Artificial Sequence: Synthetic coding sequence
atggtgtggaagtggatgcccctgctgctgctgctggtgtgtgtggccaccatgtgcagcgcccaggacagaacagacctgctgaatgtgtgcatggatgccaagcaccacaagaccaagccaggccctgaggacaagctgcatgaccagtgcagcccctggaagaagaatgcctgctgcacagccagcaccagccaggagctgcacaaggacaccagccggctgtacaacttcaactgggaccactgcggcaagatggagcccgcctgcaagaggcacttcatccaggacacctgcctgtatgagtgcagccccaacctgggcccctggatccagcaggtgaaccagagctggaggaaggagcgcttcctggatgtgcccctgtgcaaggaggactgccagcgctggtgggaggactgccacaccagccacacctgcaagagcaactggcaccggggctgggactggaccagcggcgtgaacaagtgcccagctggggccctgtgcaggacatag

SEQ ID NO: 152692 - DNA, 2010 bp, Artificial Sequence
  Description of Artificial Sequence: Synthetic coding sequence
atggccctgctgctggtgtccctgctggccttcctgagcctgggcagcggctgccaccaccgcatctgccactgcagcaacagagtcttcctgtgccaggagagcaaggtgacagagatccccagcgacctgcccagaaatgccatcgagctgcgctttgtgctgaccaagctgcgggtcatccagaagggggccttcagcggctttggagacctggagaagattgagatcagccagaatgatgtgctggaggtgattgaagcagatgtgttcagcaacctgcccaagctgcacgagatccgcatcgagaaggccaacaacctgctgtacatcaaccctgaggccttccagaacctgcccaacctgcagtacctgctgatcagcaacacaggcatcaagcacctgcctgatgtgcacaagatccacagcctgcagaaggtgctgctgtggctgaacaagaatggcatccaggagatccacaactgtgccttcaacggcacccagctggatgagctgaacctgagtgacaacaacaacctggaggagctgcccaatgatgtgttccatggagccagcggccctgtgatcctggacatcagcaggacccgcatccacagcctgcccagctatggcctggagaacctgaagaagctgcgggcccggagcacctacaacctgaagaagctgcccaccctggagaagctggtggccctgatggaggccagcctgacctaccccagccactgctgtgcctttgccaactggaggcggcagatcagcgagctgcaccccatctgcaacaagagcatcctgcggcaggaggtggactacatgacccaggcccggggccagaggagcagcctggccgaggacaatgaaagcagctacagccggggctttgacatgacctacacagaatttgattatgacctgtgcaatgaggtggtggatgtgacctgcagccccaagccagatgccttcaacccctgtgaggacatcatgggctacaacatcctgcgggtgctgatctggttcatcagcatcctggccatcaccggcaacatcatcgtgctggtgatcctgaccaccagccagtacaagctgactgtgccccgcttcctgatgtgcaacctggcctttgctgacctgtgcatcggcatctacctgctgctgattgcctctgtggacatccacaccaagagccagtaccacaactatgccatcgactggcagacaggagctggctgtgatgctgctggcttcttcaccgtgtttgccagcgagctgtctgtgtacaccctgacagccatcaccctggagcgctggcacaccatcacccacgccatgcagctggactgcaaggtgcagctgcggcatgctgcctctgtgatggtgatgggctggatctttgcctttgctgctgccctcttccccatcttcggcatcagcagctacatgaaggtgtccatctgcctgcccatggacatcgacagccccctgagccagctgtatgtgatgagcctgctggtgctgaatgtgctggcctttgtggtgatctgtggctgctacatccacatctacctgactgtgaggaaccccaacatcgtgagcagcagcagtgacacccgcatcgccaagaggatggccatgctgatcttcacagacttcctgtgcatggcccccatctccttctttgccatcagcgccagcctgaaggtgcccctcatcaccgtgtccaaggccaagatcctgctggtgctcttccaccccatcaacagctgtgccaaccccttcctgtatgccatcttcaccaagaacttccggcgggacttcttcatcctgctgagcaaatgtggctgctatgagatgcaggcccagatctacagaacagagaccagcagcacagtgcacaacacccaccccagaaatggccactgcagcagcgccccccgggtgaccagcggcagcacctacatcctggtgcccctgagccacctggcccagaactag

SEQ ID NO: 152693 - DNA, 1902 bp, Artificial Sequence
  Description of Artificial Sequence: Synthetic coding sequence
atggccctgctgctggtgtccctgctggccttcctgagcctgggcagcggctgccaccaccgcatctgccactgcagcaacagagtcttcctgtgccaggagagcaaggtgacagagatccccagcgacctgcccagaaatgccatcgagctgcgctttgtgctgaccaagctgcgggtcatccagaagggggccttcagcggctttggagacctggagaagattgagatcagccagaatgatgtgctggaggtgattgaagcagatgtgttcagcaacctgcccaagctgcacgagatccgcatcgagaaggccaacaacctgctgtacatcaaccctgaggccttccagaacctgcccaacctgcagtacctgctgatcagcaacacaggcatcaagcacctgcctgatgtgcacaagatccacagcctgcagaaggtgctgctggacatccaggacaacatcaacatccacaccatcgagaggaacagctttgtgggcctgagctttgagagcgtcatcctgtggctgaacaagaatggcatccaggagatccacaactgtgccttcaacggcacccagctggatgagctgaacctgagtgacaacaacaacctggaggagctgcccaatgatgtgttccatggagccagcggccctgtgatcctgtctgagctgcaccccatctgcaacaagagcatcctgcggcaggaggtggactacatgacccaggcccggggccagaggagcagcctggccgaggacaatgaaagcagctacagccggggctttgacatgacctacacagaatttgattatgacctgtgcaatgaggtggtggatgtgacctgcagccccaagccagatgccttcaacccctgtgaggacatcatgggctacaacatcctgcgggtgctgatctggttcatcagcatcctggccatcaccggcaacatcatcgtgctggtgatcctgaccaccagccagtacaagctgactgtgccccgcttcctgatgtgcaacctggcctttgctgacctgtgcatcggcatctacctgctgctgattgcctctgtggacatccacaccaagagccagtaccacaactatgccatcgactggcagacaggagctggctgtgatgctgctggcttcttcaccgtgtttgccagcgagctgtctgtgtacaccctgacagccatcaccctggagcgctggcacaccatcacccacgccatgcagctggactgcaaggtgcagctgcggcatgctgcctctgtgatggtgatgggctggatctttgcctttgctgctgccctcttccccatcttcggcatcagcagctacatgaaggtgtccatctgcctgcccatggacatcgacagccccctgagccagctgtatgtgatgagcctgctggtgctgaatgtgctggcctttgtggtgatctgtggctgctacatccacatctacctgactgtgaggaaccccaacatcgtgagcagcagcagtgacacccgcatcgccaagaggatggccatgctgatcttcacagacttcctgtgcatggcccccatctccttctttgccatcagcgccagcctgaaggtgcccctcatcaccgtgtccaaggccaagatcctgctggtgctcttccaccccatcaacagctgtgccaaccccttcctgtatgccatcttcaccaagaacttccggcgggacttcttcatcctgctgagcaaatgtggctgctatgagatgcaggcccagatctacagaacagagaccagcagcacagtgcacaacacccaccccagaaatggccactgcagcagcgccccccgggtgaccagcggcagcacctacatcctggtgcccctgagccacctggcccagaactag

SEQ ID NO: 152694 - DNA, 2088 bp, Artificial Sequence
  Description of Artificial Sequence: Synthetic coding sequence
atggccctgctgctggtgtccctgctggccttcctgagcctgggcagcggctgccaccaccgcatctgccactgcagcaacagagtcttcctgtgccaggagagcaaggtgacagagatccccagcgacctgcccagaaatgccatcgagctgcgctttgtgctgaccaagctgcgggtcatccagaagggggccttcagcggctttggagacctggagaagattgagatcagccagaatgatgtgctggaggtgattgaagcagatgtgttcagcaacctgcccaagctgcacgagatccgcatcgagaaggccaacaacctgctgtacatcaaccctgaggccttccagaacctgcccaacctgcagtacctgctgatcagcaacacaggcatcaagcacctgcctgatgtgcacaagatccacagcctgcagaaggtgctgctggacatccaggacaacatcaacatccacaccatcgagaggaacagctttgtgggcctgagctttgagagcgtcatcctgtggctgaacaagaatggcatccaggagatccacaactgtgccttcaacggcacccagctggatgagctgaacctgagtgacaacaacaacctggaggagctgcccaatgatgtgttccatggagccagcggccctgtgatcctggacatcagcaggacccgcatccacagcctgcccagctatggcctggagaacctgaagaagctgcgggcccggagcacctacaacctgaagaagctgcccaccctggagaagctggtggccctgatggaggccagcctgacctaccccagccactgctgtgcctttgccaactggaggcggcagatcagcgagctgcaccccatctgcaacaagagcatcctgcggcaggaggtggactacatgacccaggcccggggccagaggagcagcctggccgaggacaatgaaagcagctacagccggggctttgacatgacctacacagaatttgattatgacctgtgcaatgaggtggtggatgtgacctgcagccccaagccagatgccttcaacccctgtgaggacatcatgggctacaacatcctgcgggtgctgatctggttcatcagcatcctggccatcaccggcaacatcatcgtgctggtgatcctgaccaccagccagtacaagctgactgtgccccgcttcctgatgtgcaacctggcctttgctgacctgtgcatcggcatctacctgctgctgattgcctctgtggacatccacaccaagagccagtaccacaactatgccatcgactggcagacaggagctggctgtgatgctgctggcttcttcaccgtgtttgccagcgagctgtctgtgtacaccctgacagccatcaccctggagcgctggcacaccatcacccacgccatgcagctggactgcaaggtgcagctgcggcatgctgcctctgtgatggtgatgggctggatctttgcctttgctgctgccctcttccccatcttcggcatcagcagctacatgaaggtgtccatctgcctgcccatggacatcgacagccccctgagccagctgtatgtgatgagcctgctggtgctgaatgtgctggcctttgtggtgatctgtggctgctacatccacatctacctgactgtgaggaaccccaacatcgtgagcagcagcagtgacacccgcatcgccaagaggatggccatgctgatcttcacagacttcctgtgcatggcccccatctccttctttgccatcagcgccagcctgaaggtgcccctcatcaccgtgtccaaggccaagatcctgctggtgctcttccaccccatcaacagctgtgccaaccccttcctgtatgccatcttcaccaagaacttccggcgggacttcttcatcctgctgagcaaatgtggctgctatgagatgcaggcccagatctacagaacagagaccagcagcacagtgcacaacacccaccccagaaatggccactgcagcagcgccccccgggtgaccagcggcagcacctacatcctggtgcccctgagccacctggcccagaactag

SEQ ID NO: 152695 - DNA, 1296 bp, Artificial Sequence
  Description of Artificial Sequence: Synthetic coding sequence
atggaggccagcctgacctaccccagccactgctgtgcctttgccaactggaggcggcagatcagcgagctgcaccccatctgcaacaagagcatcctgcggcaggaggtggactacatgacccaggcccggggccagaggagcagcctggccgaggacaatgaaagcagctacagccggggctttgacatgacctacacagaatttgattatgacctgtgcaatgaggtggtggatgtgacctgcagccccaagccagatgccttcaacccctgtgaggacatcatgggctacaacatcctgcgggtgctgatctggttcatcagcatcctggccatcaccggcaacatcatcgtgctggtgatcctgaccaccagccagtacaagctgactgtgccccgcttcctgatgtgcaacctggcctttgctgacctgtgcatcggcatctacctgctgctgattgcctctgtggacatccacaccaagagccagtaccacaactatgccatcgactggcagacaggagctggctgtgatgctgctggcttcttcaccgtgtttgccagcgagctgtctgtgtacaccctgacagccatcaccctggagcgctggcacaccatcacccacgccatgcagctggactgcaaggtgcagctgcggcatgctgcctctgtgatggtgatgggctggatctttgcctttgctgctgccctcttccccatcttcggcatcagcagctacatgaaggtgtccatctgcctgcccatggacatcgacagccccctgagccagctgtatgtgatgagcctgctggtgctgaatgtgctggcctttgtggtgatctgtggctgctacatccacatctacctgactgtgaggaaccccaacatcgtgagcagcagcagtgacacccgcatcgccaagaggatggccatgctgatcttcacagacttcctgtgcatggcccccatctccttctttgccatcagcgccagcctgaaggtgcccctcatcaccgtgtccaaggccaagatcctgctggtgctcttccaccccatcaacagctgtgccaaccccttcctgtatgccatcttcaccaagaacttccggcgggacttcttcatcctgctgagcaaatgtggctgctatgagatgcaggcccagatctacagaacagagaccagcagcacagtgcacaacacccaccccagaaatggccactgcagcagcgccccccgggtgaccagcggcagcacctacatcctggtgcccctgagccacctggcccagaactag

SEQ ID NO: 152696 - DNA, 3417 bp, Artificial Sequence
  Description of Artificial Sequence: Synthetic coding sequence
atggcccccaccctcttccagaagctgttcagcaagaggacaggcctgggcgcccctggaagagatgcccgggaccctgactgtggcttctcctggcccctgcctgagtttgaccccagccagatccggctgattgtgtaccaggactgtgagcggcggggcagaaatgtgctgtttgacagctctgtgaagagaagaaatgaagacatctctgtgtccaagctgggcagtgatgcccaggtgaaggtgtttgggaagtgctgccagctgaagccaggaggagacagcagcagcagcctggacagctctgtgaccagcagcagtgacatcaaggaccagtgcctgaagtaccagggcagccgctgcagcagtgatgccaacatgctgggggagatgatgtttggatctgtggccatgagctacaagggcagcaccctgaagatccaccagatccgcagccccccccagctgatgctgagcaaggtgttcaccgccaggacaggcagcagcatctgtggcagcctgaacaccctgcaggacagcctggagttcatcaaccaggacaacaacaccctgaaggctgacaacaacacagtcatcaatggcctgctgggcaacatcgtgcacagcaaccccatggacatgcctggccgggagctgaatgaagatcgggacagcggcatcgcccggagcgccagcctgagcagcctgctgatcacccccttccccagccccaacagcagcctgaccaggagctgtgccagcagctaccagaggcgctggaggaggagccagaccaccagcctggagaatggagtcttcccccgctggagcattgaggagagcttcaacctgagtgatgagagctgtggccccaaccctggcatcgtgaggaagaagaagatcgccatcggggtcatcttcagcctgagcaaggatgaagatgagaacaacaagttcaatgagttcttcttcagccacttccccctgtttgagagccacatgaacaagctgaagagcgccatcgagcaggccatgaagatgagccgccgctctgcagatgccagccagaggagcctggcctacaacagaattgtggatgccctgaatgagttccgcaccaccatctgcaacctgtacaccatgcccagaattggagagcctgtgtggctgaccatgatgagcggcaccccagagaagaaccacctgtgctaccgcttcatgaaggagttcaccttcctgatggagaatgccagcaagaaccagttcctgcctgccctgatcacagctgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggggacctgtatggagccatcggcagccctgtgcggctggccaggacagtggtggtgggcaagaggcaggacatggtgcagaggctgctgtacttcctgacctacttcatccgctgcagcgagctgcaggagacccacctgctggagaatggagaagatgaggccatcgtgatgcctggcaccgtcatcaccaccaccctggagaagggggagattgaggagagtgaatatgtgctggtgaccatgcacaggaacaagagcagcctgctcttcaaggagagcgaggagatccgcacccccaactgcaactgcaagtactgcagccaccccctgctgggccagaatgtggagaacatcagccagcaggagcgggaggacatccagaacagcagcaaggagctgctgggcatcagtgatgagtgccagatgatcagccccagcgactgccaggaggagaatgctgtggatgtgaagcagtacagagacaagctgcggacctgctttgatgccaagctggagaccgtggtgtgcaccggctctgtgcctgtggacaagtgtgccctgtctgagagcggcctggagagcacagaggagacctggcagagcgagaagctgctggacagcgacagccacacaggcaaggccatgaggagcacaggcatggtggtggagaagaagcccccagacaagatcgtgcctgccagcttcagctgtgaggccgcccagaccaaggtgaccttcctgattggagacagcatgagcccagacagcgacacagagctgcggagccaggccgtggtggaccagatcaccaggcaccacaccaagcccctgaaggaggagcggggggccatcgaccagcaccaggagaccaagcagaccaccaaggaccagagcggggagagtgacacccagaacatggtgtctgaggagccctgtgagctgccctgctggaaccacagcgaccctgagagcatgagcctgtttgatgagtacttcaatgatgacagcattgagaccaggaccattgatgatgtgcccttcaagaccagcacagacagcaaggaccactgctgcatgctggagttcagcaagatcctgtgcaccaagaacaacaagcagaacaatgagttctgcaagtgcatcgagaccgtgccccaggacagctgcaagacctgcttcccccagcaggaccagagggacaccctgagcatcctggtgccccatggagacaaggagagcagtgacaagaagattgctgtgggcacagagtgggacatccccagaaatgaaagcagtgacagcgccctgggggacagcgagagtgaagatactggacatgacatgacccggcaggtgtcctcctactatggaggagagcaggaggactgggccgaggaggatgagatccccttccctggcagcaagctgattgaggtgtctgctgtgcagcccaacatcgccaactttggccgcagcctgctgggcggctactgcagcagctatgtgcctgactttgtgctgcagggcattggaagtgatgagcgcttccggcagtgcctgatgtctgacctgagccatgctgtgcagcaccctgtgctggatgagcccatcgccgaggccgtgtgcatcatcgctgacatggacaagtggacagtgcaggtggccagcagccagaggagagtgacagacaacaagctgggcaaggaggtgctggtgagcagcctggtgagcaacctgctgcacagcaccctgcagctgtacaagcacaacctgagccccaacttctgtgtgatgcacctggaggaccggctgcaggagctgtacttcaagagcaagatgctgtctgagtacctgcggggccagatgagggtgcacgtgaaggagctgggcgtggtgctgggcatcgagagcagtgacctgcccctgctggccgctgtggccagcacccacagcccctacgtggcccagatcctgctgtag

SEQ ID NO: 152697 - DNA, 3501 bp, Artificial Sequence
  Description of Artificial Sequence: Synthetic coding sequence
atggcccccaccctcttccagaagctgttcagcaagaggacaggcctgggcgcccctggaagagatgcccgggaccctgactgtggcttctcctggcccctgcctgagtttgaccccagccagatccggctgattgtgtaccaggactgtgagcggcggggcagaaatgtgctgtttgacagctctgtgaagagaagaaatgaagacatctctgtgtccaagctgggcagtgatgcccaggtgaaggtgtttgggaagtgctgccagctgaagccaggaggagacagcagcagcagcctggacagctctgtgaccagcagcagtgacatcaaggaccagtgcctgaagtaccagggcagccgctgcagcagtgatgccaacatgctgggggagatgatgtttggatctgtggccatgagctacaagggcagcaccctgaagatccaccagatccgcagccccccccagctgatgctgagcaaggtgttcaccgccaggacaggcagcagcatctgtggcagcctgaacaccctgcaggacagcctggagttcatcaaccaggacaacaacaccctgaaggctgacaacaacacagtcatcaatggcctgctgggcaacatcggcctgagccagttctgcagcccccggcgggccttcagcgagcagggccccctgcggctcatccgcagcgccagcttctttgctgtgcacagcaaccccatggacatgcctggccgggagctgaatgaagatcgggacagcggcatcgcccggagcgccagcctgagcagcctgctgatcacccccttccccagccccaacagcagcctgaccaggagctgtgccagcagctaccagaggcgctggaggaggagccagaccaccagcctggagaatggagtcttcccccgctggagcattgaggagagcttcaacctgagtgatgagagctgtggccccaaccctggcatcgtgaggaagaagaagatcgccatcggggtcatcttcagcctgagcaaggatgaagatgagaacaacaagttcaatgagttcttcttcagccacttccccctgtttgagagccacatgaacaagctgaagagcgccatcgagcaggccatgaagatgagccgccgctctgcagatgccagccagaggagcctggcctacaacagaattgtggatgccctgaatgagttccgcaccaccatctgcaacctgtacaccatgcccagaattggagagcctgtgtggctgaccatgatgagcggcaccccagagaagaaccacctgtgctaccgcttcatgaaggagttcaccttcctgatggagaatgccagcaagaaccagttcctgcctgccctgatcacagctgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggggacctgtatggagccatcggcagccctgtgcggctggccaggacagtggtggtgggcaagaggcaggacatggtgcagaggctgctgtacttcctgacctacttcatccgctgcagcgagctgcaggagacccacctgctggagaatggagaagatgaggccatcgtgatgcctggcaccgtcatcaccaccaccctggagaagggggagattgaggagagtgaatatgtgctggtgaccatgcacaggaacaagagcagcctgctcttcaaggagagcgaggagatccgcacccccaactgcaactgcaagtactgcagccaccccctgctgggccagaatgtggagaacatcagccagcaggagcgggaggacatccagaacagcagcaaggagctgctgggcatcagtgatgagtgccagatgatcagccccagcgactgccaggaggagaatgctgtggatgtgaagcagtacagagacaagctgcggacctgctttgatgccaagctggagaccgtggtgtgcaccggctctgtgcctgtggacaagtgtgccctgtctgagagcggcctggagagcacagaggagacctggcagagcgagaagctgctggacagcgacagccacacaggcaaggccatgaggagcacaggcatggtggtggagaagaagcccccagacaagatcgtgcctgccagcttcagctgtgaggccgcccagaccaaggtgaccttcctgattggagacagcatgagcccagacagcgacacagagctgcggagccaggccgtggtggaccagatcaccaggcaccacaccaagcccctgaaggaggagcggggggccatcgaccagcaccaggagaccaagcagaccaccaaggaccagagcggggagagtgacacccagaacatggtgtctgaggagccctgtgagctgccctgctggaaccacagcgaccctgagagcatgagcctgtttgatgagtacttcaatgatgacagcattgagaccaggaccattgatgatgtgcccttcaagaccagcacagacagcaaggaccactgctgcatgctggagttcagcaagatcctgtgcaccaagaacaacaagcagaacaatgagttctgcaagtgcatcgagaccgtgccccaggacagctgcaagacctgcttcccccagcaggaccagagggacaccctgagcatcctggtgccccatggagacaaggagagcagtgacaagaagattgctgtgggcacagagtgggacatccccagaaatgaaagcagtgacagcgccctgggggacagcgagagtgaagatactggacatgacatgacccggcaggtgtcctcctactatggaggagagcaggaggactgggccgaggaggatgagatccccttccctggcagcaagctgattgaggtgtctgctgtgcagcccaacatcgccaactttggccgcagcctgctgggcggctactgcagcagctatgtgcctgactttgtgctgcagggcattggaagtgatgagcgcttccggcagtgcctgatgtctgacctgagccatgctgtgcagcaccctgtgctggatgagcccatcgccgaggccgtgtgcatcatcgctgacatggacaagtggacagtgcaggtggccagcagccagaggagagtgacagacaacaagctgggcaaggaggtgctggtgagcagcctggtgagcaacctgctgcacagcaccctgcagctgtacaagcacaacctgagccccaacttctgtgtgatgcacctggaggaccggctgcaggagctgtacttcaagagcaagatgctgtctgagtacctgcggggccagatgagggtgcacgtgaaggagctgggcgtggtgctgggcatcgagagcagtgacctgcccctgctggccgctgtggccagcacccacagcccctacgtggcccagatcctgctgtag

SEQ ID NO: 152698 - DNA, 1527 bp, Artificial Sequence
  Description of Artificial Sequence: Synthetic coding sequence
atggcccccaccctcttccagaagctgttcagcaagaggacaggcctgggcgcccctggaagagatgcccgggaccctgactgtggcttctcctggcccctgcctgagtttgaccccagccagatccggctgattgtgtaccaggactgtgagcggcggggcagaaatgtgctgtttgacagctctgtgaagagaagaaatgaagacatctctgtgtccaagctgggcagtgatgcccaggtgaaggtgtttgggaagtgctgccagctgaagccaggaggagacagcagcagcagcctggacagctctgtgaccagcagcagtgacatcaaggaccagtgcctgaagtaccagggcagccgctgcagcagtgatgccaacatgctgggggagatgatgtttggatctgtggccatgagctacaagggcagcaccctgaagatccaccagatccgcagccccccccagctgatgctgagcaaggtgttcaccgccaggacaggcagcagcatctgtggcagcctgaacaccctgcaggacagcctggagttcatcaaccaggacaacaacaccctgaaggctgacaacaacacagtcatcaatggcctgctgggcaacatcggcctgagccagttctgcagcccccggcgggccttcagcgagcagggccccctgcggctcatccgcagcgccagcttctttgctgtgcacagcaaccccatggacatgcctggccgggagctgaatgaagatcgggacagcggcatcgcccggagcgccagcctgagcagcctgctgatcacccccttccccagccccaacagcagcctgaccaggagctgtgccagcagctaccagaggcgctggaggaggagccagaccaccagcctggagaatggagtcttcccccgctggagcattgaggagagcttcaacctgagtgatgagagctgtggccccaaccctggcatcgtgaggaagaagaagatcgccatcggggtcatcttcagcctgagcaaggatgaagatgagaacaacaagttcaatgagttcttcttcagccacttccccctgtttgagagccacatgaacaagctgaagagcgccatcgagcaggccatgaagatgagccgccgctctgcagatgccagccagaggagcctggcctacaacagaattgtggatgccctgaatgagttccgcaccaccatctgcaacctgtacaccatgcccagaattggagagcctgtgtggctgaccatgatgagcggcaccccagagaagaaccacctgtgctaccgcttcatgaaggagttcaccttcctgatggagaatgccagcaagaaccagttcctgcctgccctgatcacagctgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggcatgtag

SEQ ID NO: 152699 - DNA, 2757 bp, Artificial Sequence
  Description of Artificial Sequence: Synthetic coding sequence
atggacatgcctggccgggagctgaatgaagatcgggacagcggcatcgcccggagcgccagcctgagcagcctgctgatcacccccttccccagccccaacagcagcctgaccaggagctgtgccagcagctaccagaggcgctggaggaggagccagaccaccagcctggagaatggagtcttcccccgctggagcattgaggagagcttcaacctgagtgatgagagctgtggccccaaccctggcatcgtgaggaagaagaagatcgccatcggggtcatcttcagcctgagcaaggatgaagatgagaacaacaagttcaatgagttcttcttcagccacttccccctgtttgagagccacatgaacaagctgaagagcgccatcgagcaggccatgaagatgagccgccgctctgcagatgccagccagaggagcctggcctacaacagaattgtggatgccctgaatgagttccgcaccaccatctgcaacctgtacaccatgcccagaattggagagcctgtgtggctgaccatgatgagcggcaccccagagaagaaccacctgtgctaccgcttcatgaaggagttcaccttcctgatggagaatgccagcaagaaccagttcctgcctgccctgatcacagctgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggggacctgtatggagccatcggcagccctgtgcggctggccaggacagtggtggtgggcaagaggcaggacatggtgcagaggctgctgtacttcctgacctacttcatccgctgcagcgagctgcaggagacccacctgctggagaatggagaagatgaggccatcgtgatgcctggcaccgtcatcaccaccaccctggagaagggggagattgaggagagtgaatatgtgctggtgctgctcttcaaggagagcgaggagatccgcacccccaactgcaactgcaagtactgcagccaccccctgctgggccagaatgtggagaacatcagccagcaggagcgggaggacatccagaacagcagcaaggagctgctgggcatcagtgatgagtgccagatgatcagccccagcgactgccaggaggagaatgctgtggatgtgaagcagtacagagacaagctgcggacctgctttgatgccaagctggagaccgtggtgtgcaccggctctgtgcctgtggacaagtgtgccctgtctgagagcggcctggagagcacagaggagacctggcagagcgagaagctgctggacagcgacagccacacaggcaaggccatgaggagcacaggcatggtggtggagaagaagcccccagacaagatcgtgcctgccagcttcagctgtgaggccgcccagaccaaggtgaccttcctgattggagacagcatgagcccagacagcgacacagagctgcggagccaggccgtggtggaccagatcaccaggcaccacaccaagcccctgaaggaggagcggggggccatcgaccagcaccaggagaccaagcagaccaccaaggaccagagcggggagagtgacacccagaacatggtgtctgaggagccctgtgagctgccctgctggaaccacagcgaccctgagagcatgagcctgtttgatgagtacttcaatgatgacagcattgagaccaggaccattgatgatgtgcccttcaagaccagcacagacagcaaggaccactgctgcatgctggagttcagcaagatcctgtgcaccaagaacaacaagcagaacaatgagttctgcaagtgcatcgagaccgtgccccaggacagctgcaagacctgcttcccccagcaggaccagagggacaccctgagcatcctggtgccccatggagacaaggagagcagtgacaagaagattgctgtgggcacagagtgggacatccccagaaatgaaagcagtgacagcgccctgggggacagcgagagtgaagatactggacatgacatgacccggcaggtgtcctcctactatggaggagagcaggaggactgggccgaggaggatgagatccccttccctggcagcaagctgattgaggtgtctgctgtgcagcccaacatcgccaactttggccgcagcctgctgggcggctactgcagcagctatgtgcctgactttgtgctgcagggcattggaagtgatgagcgcttccggcagtgcctgatgtctgacctgagccatgctgtgcagcaccctgtgctggatgagcccatcgccgaggccgtgtgcatcatcgctgacatggacaagtggacagtgcaggtggccagcagccagaggagagtgacagacaacaagctgggcaaggaggtgctggtgagcagcctggtgagcaacctgctgcacagcaccctgcagctgtacaagcacaacctgagccccaacttctgtgtgatgcacctggaggaccggctgcaggagctgtacttcaagagcaagatgctgtctgagtacctgcggggccagatgagggtgcacgtgaaggagctgggcgtggtgctgggcatcgagagcagtgacctgcccctgctggccgctgtggccagcacccacagcccctacgtggcccagatcctgctgtag

SEQ ID NO: 152700 - DNA, 3345 bp, Artificial Sequence
  Description of Artificial Sequence: Synthetic coding sequence
atggcccccaccctgctgcagaagctgttcaacaagaggggcagcagcggcagcagcgctgctgccagcgcccagggccgggcccccaaggagggccctgccttctcctggagctgcagcgagtttgacctgaatgagatccgcctcatcgtgtaccaggactgtgacagaagaggccggcaggtgctgtttgacagcaaggctgtgcagaagattgaggaggtgacagcccagaagacagaagatgtgcccatcaagatcagcgccaagtgctgccagggcagcagctctgtgagcagcagcagcagcagcagcatcagcagccacagcagcagcggcggcagcagccaccacgccaaggagcagctgcccaagtaccagtacaccaggcctgccagtgatgtgaacatgctgggggagatgatgtttggatctgtggccatgagctacaagggcagcaccctgaagatccactacatccgcagccccccccagctgatgatcagcaaggtgttttctgccaggatgggcagcttctgtggcagcaccaacaacctgcaggacagctttgagtacatcaaccaggaccccaacctgggcaagctgaacaccaaccagaacagcctgggcccctgcaggacaggcagcaacctggcccacagcacccctgtggacatgcccagccggggccagaatgaagatcgggacagcggcatcgcccggagcgccagcctgagcagcctgctgatcacccccttccccagccccagcagcagcaccagcagcagcagcagctaccagaggcgctggctgcggagccagaccaccagcctggagaatggcatcatccccaggaggagcacagatgagaccttcagcctggccgaggagacctgcagcagcaacccagccatggtgcggaggaagaagatcgccatcagcatcatcttcagcctgtgtgagaaggaggaggcccagaggaacttccaggacttcttcttcagccacttccccctgtttgagagccacatgaaccggctgaagagcgccatcgagaaggccatgatcagctgcaggaagattgctgagagcagcctgcgggtgcagttctacgtgtcccggctgatggaggccctgggggagttccggggcaccatctggaacctgtacagcgtgcccagaattgctgagcctgtgtggctgaccatgatgagcggcaccctggagaagaaccagctgtgccagcgcttcctgaaggagttcaccctgctgattgagcagatcaacaagaaccagttctttgctgccctgctgacagctgtgctgacctaccacctggcctgggtgcccaccgtgatgcctgtggaccacccccccatcaaggccttcagcgagaagaggaccagccagagcgtgaacatgctggccaagacccacccctacaaccccctgtgggcccagctgggggacctgtatggagccatcggcagccctgtgcggctgaccaggacagtggtggtgggcaagcagaaggacctggtgcagaggatcctgtatgtgctgacctacttcctgcgctgcagcgagctgcaggagaaccagctgacctggagcggcaaccacggggagggggaccaggtgctgaatggcagcaagatcatcacagccctggagaagggggaggtggaggagagtgaatatgtggtgatcaccgtgagaaatgagcccgccctggtgccccccatcctgcccccaacagctgctgagcggcacaacccctggcccaccggcttccctgagtgcccagagggcacagacagccgggacctgggcctgaagccagacaaggaggccaacagaagacctgagcagggcagcgaggcctgcagcgctggctgcctgggccctgccagtgatgcctcctggaagccccagaatgccttctgtggagatgagaagaacaaggaggccccccaggacggcagcagccggctgcccagctgtgaggtgctgggcgccggcatgaagatggaccagcaggccgtgtgtgagctgctgaaggtggagatgcccacccggctgcctgacagatctgtggcctggccctgcccagacagacacctgcgggagaagcccagcctggagaaggtgaccttccagatcggcagctttgccagccctgagagtgactttgagagcaggatgaagaagatggaggagcgggtgaaggcctgtggccccagcctggaggccagcgaggccgcagatgtggcccaggacccccaggtgagccgcagccccttcaagccaggcttccaggagaatgtgtgctgcccccagaaccggctgtctgaaggagatgaaggagagagtgacaagggctttgctgaagatcggggcagcagaaatgacatggctgctgacattgctggccagctgagccacgccgctgacctgggcacagccagccacggggccggcggcactggaggccggcggctggaggccacccggggcctgtatgtgaaggctgctgagggccctgtgctggagcctgtggccccccgctgtgtgcagaggggccctggcctggtggccggggccaacatcccctgtggagatgacaacaagaaggccaacttcagaacagaaggagacatccccagaaatgaaagcagtgacagcgccctgggggacagtgatgatgaggcctgtgccagcgccatgctggacctgggccacggcggggacagaactggaggcagcctggaggtggagctgcccctgcccaggagccagagcatcagcacccagaatgtgaggaactttggccgcagcctgctggccggctactgccccacctacatgccagacctggtgctgcacggcaccggcagtgatgagaagctgaagcagtgcctggtggccgacctggtgcacacagtgcaccaccctgtgctggatgagcccatcgccgaggccgtgtgcatcatcgctgacacagacaagtggagcgtgcaggtggccaccagccagaggaaggtgacagacaacatgaagctgggccaggatgtgctggtgagcagccaggtgagcagcctgctgcagagcatcctgcagctgtacaagctgcacctgcctgctgacttctgcatcatgcacctggaggaccggctgcaggagatgtacctgaagagcaagatgctgtctgagtacctgcggggccacaccagggtgcacgtgaaggagctgggcgtggtgctgggcatcgagagcaatgacctgcccctgctgacagccatcgccagcacccacagcccctacgtggcccagatcctgctgtag

SEQ ID NO: 152701 - DNA, 3414 bp, Artificial Sequence
  Description of Artificial Sequence: Synthetic coding sequence
atgtgtggcggcacagccaacaccaccaaccagcctgagagctggcaggacagcgcccgctgtgtgtctgatgctgtgcctggagctggccgcatctaccgggccctgctgtgcaccaagatcaagaagcacactggagtggacaggagcacagaccacacagagctggacaacagctggagctgcagcgagtttgacctgaatgagatccggctgattgtgtaccaggactgtgaccggcggggccggcaggtgctgtttgacagcaaggctgtgcagaagattgaggaggtgacagcccagaagacagaagatgtgcccatcaagatcagcgccaagtgctgccagggcagcagctctgtgagcagcagcagcagcagcagcatcagcagccacagcagcagcggcggcagcagccaccacgccaaggagcagctgcccaagtaccagtacaccaggcctgccagtgatgtgaacatgctgggggagatgatgtttggatctgtggccatgagctacaagggcagcaccctgaagatccactacatccgcagccccccccagctgatgatcagcaaggtgttcagcgccaggatgggcagcttctgtggcagcaccaacaacctgcaggacagctttgagtacatcaaccaggaccccaacctgggcaagctgaacaccaaccagaacagcctgggcccctgcaggacaggcagcaacctggcccacagcacccctgtggacatgcccagccggggccagaatgaagatcgggacagcggcatcgcccggagcgccagcctgagcagcctgctgatcacccccttccccagccccagcagcagcaccagcagcagcagcagctaccagaggcgctggctgcggagccagaccaccagcctggagaatggcatcatcccccggcgcagcacagatgagaccttcagcctggccgaggagacctgcagcagcaacccagccatggtgcggaggaagaagatcgccatcagcatcatcttcagcctgtgtgagaaggaggaggcccagaggaacttccaggacttcttcttcagccacttccccctgtttgagagccacatgaaccggctgaagagcgccatcgagaaggccatgatcagctgcaggaagattgctgagagcagcctgcgggtgcagttctacgtgtcccggctgatggaggccctgggggagttccggggcaccatctggaacctgtacagcgtgcccagaattgctgagcctgtgtggctgaccatgatgagcggcaccctggagaagaaccagctgtgccagcgcttcctgaaggagttcaccctgctgattgagcagatcaacaagaaccagttctttgctgccctgctgacagctgtgctgacctaccacctggcctgggtgcccaccgtgatgcctgtggaccacccccccatcaaggccttcagcgagaagaggaccagccagagcgtgaacatgctggccaagacccacccctacaaccccctgtgggcccagctgggggacctgtatggagccatcggcagccctgtgcggctgaccaggacagtggtggtgggcaagcagaaggacctggtgcagaggatcctgtatgtgctgacctacttcctgcgctgcagcgagctgcaggagaaccagctgacctggagcggcaaccacggggagggggaccaggtgctgaatggcagcaagatcatcacagccctggagaagggggaggtggaggagagtgaatatgtggtgatcaccgtgagaaatgaaccagccctggtgccccccatcctgcccccaacagctgctgagcggcacaacccctggcccaccggcttcccagaatgtcctgagggcacagacagccgggacctgggcctgaagccagacaaggaggccaacagaagacctgagcagggcagcgaggcctgcagcgctggctgcctgggccctgccagtgatgcctcctggaagccccagaatgccttctgtggagatgagaagaacaaggaggccccccaggacggcagcagccggctgcccagctgtgaggtgctgggcgccggcatgaagatggaccagcaggccgtgtgtgagctgctgaaggtggagatgcccacccggctgcctgacagatctgtggcctggccctgcccagacagacacctgcgggagaagcccagcctggagaaggtgaccttccagatcggcagctttgccagccctgagagtgactttgagagcaggatgaagaagatggaggagcgggtgaaggcctgtggccccagcctggaggccagcgaggccgcagatgtggcccaggacccccaggtgagccgcagccccttcaagccaggcttccaggagaatgtgtgctgcccccagaaccggctgtctgaaggagatgaaggagagagtgacaagggctttgctgaggaccggggcagcagaaatgacatggctgctgacattgctggccagctgagccatgctgctgacctgggcacagccagccatggagctgggggcaccggcggccgccgcctggaggccacccggggcctgtatgtgaaggctgctgagggccctgtgctggagcctgtggccccccgctgtgtgcagaggggccctggcctggtggccggggccaacatcccctgtggagatgacaacaagaaggccaacttcagaacagaaggagacatccccagaaatgaaagcagtgacagcgccctgggggacagtgatgatgaggcctgtgccagcgccatgctggacctgggccatggaggagacagaactggaggcagcctggaggtggagctgcccctgcccaggagccagagcatcagcacccagaatgtgaggaactttggccgcagcctgctggccggctactgccccacctacatgccagacctggtgctgcatggaactggaagtgatgagaagctgaagcagtgcctggtggccgacctggtgcacacagtgcaccaccctgtgctggatgagcccatcgccgaggccgtgtgcatcatcgctgacacagacaagtggagcgtgcaggtggccaccagccagaggaaggtgacagacaacatgaagctgggccaggatgtgctggtgagcagccaggtgagcagcctgctgcagagcatcctgcagctgtacaagctgcacctgcctgctgacttctgcatcatgcacctggaggaccggctgcaggagatgtacctgaagagcaagatgctgtctgagtacctgcggggccacaccagggtgcacgtgaaggagctgggcgtggtgctgggcatcgagagcaatgacctgcccctgctgacagccatcgccagcacccacagcccctacgtggcccagatcctgctgtag

SEQ ID NO: 152702 - DNA, 2022 bp, Artificial Sequence
  Description of Artificial Sequence: Synthetic coding sequence
atgtgtggcggcacagccaacaccaccaaccagcctgagagctggcaggacagcgcccgctgtgtgtctgatgctgtgcctggagctggccgcatctaccgggccctgctgtgcaccaagatcaagaagcacactggagtggacaggagcacagaccacacagagctggacaacagctggagctgcagcgagtttgacctgaatgagatccggctgattgtgtaccaggactgtgaccggcggggccggcaggtgctgtttgacagcaaggctgtgcagaagattgaggaggtgacagcccagaagacagaagatgtgcccatcaagatcagcgccaagtgctgccagggcagcagctctgtgagcagcagcagcagcagcagcatcagcagccacagcagcagcggcggcagcagccaccacgccaaggagcagctgcccaagtaccagtacaccaggcctgccagtgatgtgaacatgctgggggagatgatgtttggatctgtggccatgagctacaagggcagcaccctgaagatccactacatccgcagccccccccagctgatgatcagcaaggtgttcagcgccaggatgggcagcttctgtggcagcaccaacaacctgcaggacagctttgagtacatcaaccaggaccccaacctgggcaagctgaacaccaaccagaacagcctgggcccctgcaggacaggcagcaacctggcccacagcacccctgtggacatgcccagccggggccagaatgaagatcgggacagcggcatcgcccggagcgccagcctgagcagcctgctgatcacccccttccccagccccagcagcagcaccagcagcagcagcagctaccagaggcgctggctgcggagccagaccaccagcctggagaatggcatcatcccccggcgcagcacagatgagaccttcagcctggccgaggagacctgcagcagcaacccagccatggtgcggaggaagaagatcgccatcagcatcatcttcagcctgtgtgagaaggaggaggcccagaggaacttccaggacttcttcttcagccacttccccctgtttgagagccacatgaaccggctgaagagcgccatcgagaaggccatgatcagctgcaggaagattgctgagagcagcctgcgggtgcagttctacgtgtcccggctgatggaggccctgggggagttccggggcaccatctggaacctgtacagcgtgcccagaattgctgagcctgtgtggctgaccatgatgagcggcaccctggagaagaaccagctgtgccagcgcttcctgaaggagttcaccctgctgattgagcagatcaacaagaaccagttctttgctgccctgctgacagctgtgctgacctaccacctggcctgggtgcccaccgtgatgcctgtggaccacccccccatcaaggccttcagcgagaagaggaccagccagagcgtgaacatgctggccaagacccacccctacaaccccctgtgggcccagctgggggacctgtatggagccatcggcagccctgtgcggctgaccaggacagtggtggtgggcaagcagaaggacctggtgcagaggatcctgtatgtgctgacctacttcctgcgctgcagcgagctgcaggagaaccagctgacctggagcggcaaccacggggagggggaccaggtgctgaatggcagcaagatcatcacagccctggagaagggggaggtggaggagagtgaatatgtggtgatcaccgtgagaaatgaaccagccctggtgccccccatcctgcccccaacagctgctgagcggcacaacccctggcccaccggcttcccagaatgtcctgagggcacagacagccgggacctgggcctgaagccagacaaggaggccaacagaagacctgagcagggcagcgaggcctgcagcgctggctgcctgggccctgccagtgatgcctcctggaagccccagaatgccttctgtggctag

SEQ ID NO: 152703 - DNA, 660 bp, Artificial Sequence
  Description of Artificial Sequence: Synthetic coding sequence
atggaccctgcccctggggtgctggacccccgggccgcccccccagccctgctgggcaccccccaggccgaggtgctggaggatgtgctgcgggagcagtttggccccctgccccagctggccgctgtgtgccgcctgaagaggctgcccagcggcggctacagcagcacagagaacctgcagctggtgctggagaggagaagagtggccaatgccaaggagcgggagcgcatcaagaacctgaacagaggatttgcccggctgaaggccctggtgcccttcctgccccagagcaggaagcccagcaaggtggacatcctgaagggggccacagagtacatccaggtgctgagtgacctgctggagggcgccaaggacagcaagaagcaggaccctgatgagcagagctacagcaacaacagcagcgagagccacaccagcagcgcccggcagctgagcaggaacatcacccagcacatcagctgtgccttcggcctgaagaatgaggaggagggcccctgggcagatggcggcagcggggagcccgcccacgcctgccgccacagcgtgatgagcaccacagagatcatcagccccaccaggagcctggaccgcttccctgaggtggagctgctgagccaccggctgccccaggtgtag

SEQ ID NO: 152704 - DNA, 1035 bp, Artificial Sequence
  Description of Artificial Sequence: Synthetic coding sequence
atggtgcgggcccggcaccagcccggcggcctgtgcctgctgctgctgctgctgtgccagttcatggaggacagaagtgcccaggccggcaactgctggctgcggcaggccaagaatggccgctgccaggtgctgtacaagacagagctgagcaaggaggagtgctgcagcacaggccgcctgagcacctcctggacagaggaggatgtgaatgacaacaccctcttcaagtggatgatcttcaacggcggggcccccaactgcatcccctgcaaggagacctgtgaaaatgtggactgtggccctgggaagaagtgcaggatgaacaagaagaacaagccccgctgtgtgtgtgccccagactgcagcaacatcacctggaagggccctgtgtgtggcctggatggcaagacctacagaaatgaatgtgccctgctgaaggcccgctgcaaggagcagcctgagctggaggtgcagtaccagggccgctgcaagaagacctgcagagatgtgttctgccccggcagcagcacctgtgtggtggaccagaccaacaatgcctactgtgtgacctgcaaccgcatctgcccagagcccgccagcagcgagcagtacctgtgtggaaatgatggagtgacctacagcagcgcctgccacctgaggaaggccacctgcctgctgggccgcagcatcggcctggcctatgagggcaagtgcatcaaggccaagagctgtgaggacatccagtgcacaggaggcaagaagtgcctgtgggacttcaaggtgggccggggccgctgcagcctgtgtgatgagctgtgcccagacagcaagagtgatgagcctgtgtgtgccagtgacaatgccacctacgcctctgaatgtgccatgaaggaggccgcctgcagcagcggcgtgctgctggaggtgaagcacagcggcagctgcaacagcatcagcgaggacacagaggaggaggaggaggatgaggaccaggactacagcttccccatcagcagcatcctggagtggtag

SEQ ID NO: 152705 - DNA, 954 bp, Artificial Sequence
  Description of Artificial Sequence: Synthetic coding sequence
atggtgcgggcccggcaccagcccggcggcctgtgcctgctgctgctgctgctgtgccagttcatggaggacagaagtgcccaggccggcaactgctggctgcggcaggccaagaatggccgctgccaggtgctgtacaagacagagctgagcaaggaggagtgctgcagcacaggccgcctgagcacctcctggacagaggaggatgtgaatgacaacaccctcttcaagtggatgatcttcaacggcggggcccccaactgcatcccctgcaaggagacctgtgaaaatgtggactgtggccctgggaagaagtgcaggatgaacaagaagaacaagccccgctgtgtgtgtgccccagactgcagcaacatcacctggaagggccctgtgtgtggcctggatggcaagacctacagaaatgaatgtgccctgctgaaggcccgctgcaaggagcagcctgagctggaggtgcagtaccagggccgctgcaagaagacctgcagagatgtgttctgccccggcagcagcacctgtgtggtggaccagaccaacaatgcctactgtgtgacctgcaaccgcatctgcccagagcccgccagcagcgagcagtacctgtgtggaaatgatggagtgacctacagcagcgcctgccacctgaggaaggccacctgcctgctgggccgcagcatcggcctggcctatgagggcaagtgcatcaaggccaagagctgtgaggacatccagtgcacaggaggcaagaagtgcctgtgggacttcaaggtgggccggggccgctgcagcctgtgtgatgagctgtgcccagacagcaagagtgatgagcctgtgtgtgccagtgacaatgccacctacgcctctgaatgtgccatgaaggaggccgcctgcagcagcggcgtgctgctggaggtgaagcacagcggcagctgcaactag

SEQ ID NO: 152706 - DNA, 1023 bp, Artificial Sequence
  Description of Artificial Sequence: Synthetic coding sequence
atggtgcgggcccggcaccagcccggcggcctgtgcctgctgctgctgctgctgtgccagttcatggaggacagaagtgcccaggccggcaactgctggctgcggcaggccaagaatggccgctgccaggtgctgtacaagacagagctgagcaaggaggagtgctgcagcacaggccgcctgagcacctcctggacagaggaggatgtgaatgacaacaccctcttcaagtggatgatcttcaacggcggggcccccaactgcatcccctgcaaggagacctgtgaaaatgtggactgtggccctgggaagaagtgcaggatgaacaagaagaacaagccccgctgtgtgtgtgccccagactgcagcaacatcacctggaagggccctgtgtgtggcctggatggcaagacctacagaaatgaatgtgccctgctgaaggcccgctgcaaggagcagcctgagctggaggtgcagtaccagggccgctgcaagaagacctgcagagatgtgttctgccccggcagcagcacctgtgtggtggaccagaccaacaatgcctactgtgtgacctgcaaccgcatctgcccagagcccgccagcagcgagcagtacctgtgtggaaatgatggagtgacctacagcagcgcctgccacctgaggaaggccacctgcctgctgggccgcagcatcggcctggcctatgagggcaagtgcatcaaggccaagagctgtgaggacatccagtgcacaggaggcaagaagtgcctgtgggacttcaaggtgggccggggccgctgcagcctgtgtgatgagctgtgcccagacagcaagagtgatgagcctgtgtgtgccagtgacaatgccacctacgcctctgaatgtgccatgaaggaggccgcctgcagcagcggcgtgctgctggaggtgaagcacagcggcagctgcaactacacagaggaggaggaggaggatgaggaccaggactacagcttccccatcagcagcatcctggagtggtag

SEQ ID NO: 152707 - DNA, 927 bp, Artificial Sequence
  Description of Artificial Sequence: Synthetic coding sequence
atgtggaagcgctggctggccctggccctggccctggtggccgtggcctgggtgcgggcagaggaggagctgcggagcaagagcaagatctgtgccaacgtgttctgtggggccggcagagaatgtgctgtgacagagaagggggagcccacctgcctgtgcatcgagcagtgcaagccccacaagaggcctgtgtgtggcagcaatggcaagacctacctgaaccactgtgagctgcacagagatgcctgcctgaccggcagcaagatccaggtggactatgatggccactgcaaggagaagaagtctgtgagccccagcgccagccctgtggtgtgctaccagagcaacagagatgagctgcggcggcgcatcatccagtggctggaggccgagatcatcccagatggctggttcagcaagggcagcaactacagcgagatcctggacaagtacttcaagaactttgacaacggggacagccggctggacagcagcgagttcctgaagtttgtggagcagaatgaaacagccatcaacatcaccacctacccagaccaggagaacaacaagctgctgcggggcctgtgtgtggatgccctgattgagctgagtgatgaaaatgctgactggaagctgtccttccaggagttcctgaagtgcctgaaccccagcttcaaccccccagagaagaagtgtgccctggaggatgagacctatgcagatggagctgagacagaggtggactgcaacagatgtgtgtgtgcctgtggcaactgggtgtgcacagccatgacctgtgatggcaagaaccagaagggggcccagacccagacagaggaggagatgacccgctacgtgcaggagctgcagaagcaccaggagacagctgagaagaccaagagggtgtccaccaaggagatctag

SEQ ID NO: 152708 - DNA, 423 bp, Artificial Sequence
  Description of Artificial Sequence: Synthetic coding sequence
atgtggaagcgctggctggccctggccctggccctggtggccgtggcctgggtgcgggcagaggaggagctgcggagcaagagcaagatctgtgccaacgtgttctgtggggccggcagagaatgtgctgtgacagagaagggggagcccacctgcctgtgcatcgagcagtgcaagccccacaagaggcctgtgtgtggcagcaatggcaagacctacctgaaccactgtgagctgcacagagatgcctgcctgaccggcagcaagatccaggtggactatgatggccactgcaaggagaagaagtctgtgagccccagcgccagccctgtggtgtgctaccagagcaacagagatgagctgcggcggcgcatcatccagtggctggaggccgagatcatcccagatggctggttctcctag

SEQ ID NO: 152709 - DNA, 756 bp, Artificial Sequence
  Description of Artificial Sequence: Synthetic coding sequence
atgtgctttgtggagcctgctggaaatgtgcagagccagaggaaaggaaacccccctgtgtctgccctgagcaatgccaacctgaccggcagcaagatccaggtggactatgatggccactgcaaggagaagaagtctgtgagccccagcgccagccctgtggtgtgctaccagagcaacagagatgagctgcggcggcgcatcatccagtggctggaggccgagatcatcccagatggctggttcagcaagggcagcaactacagcgagatcctggacaagtacttcaagaactttgacaatggagacagccggctggacagcagcgagttcctgaagtttgtggagcagaatgaaacagccatcaacatcaccacctacccagaccaggagaacaacaagctgctgcggggcctgtgtgtggatgccctgattgagctgagtgatgaaaatgctgactggaagctgtccttccaggagttcctgaagtgcctgaaccccagcttcaaccccccagagaagaagtgtgccctggaggatgagacctatgcagatggagctgagacagaggtggactgcaacagatgtgtgtgtgcctgtggcaactgggtgtgcacagccatgacctgtgatggcaagaaccagaagggggcccagacccagacagaggaggagatgaccaggtatgtgcaggagctgcagaagcaccaggagacagctgagaagaccaagagggtgtccaccaaggagatctag

SEQ ID NO: 152710 - DNA, 792 bp, Artificial Sequence
  Description of Artificial Sequence: Synthetic coding sequence
atgaggcctggggcccctggccccctgtggcccctgccctggggcgccctggcctgggccgtgggctttgtgtcctccatgggcagcggcaacccagcccctgggggcgtgtgctggctgcagcagggccaggaggccacctgcagcctggtgctgcagacagatgtgaccagggctgagtgctgtgccagcggcaacatcgacacagcctggagcaacctgacccaccctggcaacaagatcaacctgctgggcttcctgggcctggtgcactgcctgccctgcaaggacagctgtgatggagtggagtgtggccctgggaaggcctgcaggatgctgggcggccggccccgctgtgaatgtgccccagactgcagcggcctgcctgcccggctgcaggtgtgtggcagtgatggagccacctacagagatgaatgtgagctgcgggccgcccgctgccggggccacccagacctgtctgtgatgtaccggggccgctgcaggaagagctgtgaacatgtggtgtgcccccggccccagagctgtgtggtggaccagacaggcagcgcccactgtgtggtgtgcagagctgccccctgccctgtgcccagcagccctggccaggagctgtgtggcaacaacaacgtgacctacatcagcagctgccacatgaggcaggccacctgcttcctgggccgcagcattggagtgagacatgctggcagctgtgccggcaccccagaggagcccccaggaggagagagcgctgaggaggaggagaactttgtgtag

SEQ ID NO: 152711 - DNA, 1614 bp, Artificial Sequence
  Description of Artificial Sequence: Synthetic coding sequence
atgctgaacaccctgcagaccaatgccggctacctggagcaggtgaagaggcagagaggagacccccagacccagctggaggccatggagctgtacctggcccggagcggcctgcaggtggaggacctggaccggctgaacatcatccacgtgacaggcaccaagggcaagggcagcacctgtgccttcacagagtgcatcctgcggagctatggcctgaagacaggcttcttcagcagcccccacctggtgcaggtgcgggagcgcatccgcatcaatggccagcccatcagccctgagctgttcaccaagtacttctggaggctgtaccaccggctggaggagaccaaggatggcagctgtgtgtccatgccaccctacttccgcttcctgaccctgatggccttccacgtgttcctgcaggagaaggtggacctggccgtggtggaggtgggcattggaggagcctatgactgcaccaacatcatcaggaagcctgtggtgtgtggggtgagcagcctgggcatcgaccacaccagcctgctgggggacacagtggagaagatcgcctggcagaagggcggcatcttcaagcagggcgtgcctgccttcaccgtgctgcagcctgagggccccctggccgtgctgcgggaccgggcccagcagatcagctgccccctgtacctgtgccccatgctggaggccctggaggagggcggcccccccctgaccctgggcctggagggggagcaccagaggagcaatgctgccctggccctgcagctggcccactgctggctgcagaggcaggacagacatggagctggggagcccaaggccagcaggcctggcctgctgtggcagctgcccctggcccctgtgttccagcccaccagccacatgaggctgggcctgaggaacacagagtggccaggccgcacccaggtgctgcggcggggccccctgacctggtacctggatggagcccacacagccagcagcgcccaggcctgtgtgcgctggttccggcaggccctgcagggccgggagcggcccagcggcggccctgaggtgcgggtgctgctcttcaatgccaccggggaccgggaccctgctgccctgctgaagctgctgcagccctgccagtttgattatgctgtgttctgccccaacctgacagaggtgagcagcactggaaatgctgaccagcagaacttcaccgtgaccctggaccaggtgctgctgcgctgcctggagcaccagcagcactggaaccacctggatgaggagcaggccagcccagacctgtggagcgcccccagccctgagcccggcggcagcgccagcctgctgctggccccccaccccccccacacctgcagcgccagcagcctggtgttcagctgcatcagccacgccctgcagtggatcagccagggccgggaccccatcttccagccccccagcccccccaagggcctgctgacccaccctgtggcccacagcggggccagcatcctgcgggaggccgccgccatccacgtgctggtgacaggcagcctgcacctggtgggcggcgtgctgaagctgctggagcccgccctgagccagtag

SEQ ID NO: 152712 - DNA, 1128 bp, Artificial Sequence
  Description of Artificial Sequence: Synthetic coding sequence
atgagccgggcccggagccacctgcgggccgccctcttcctggccgccgccagcgcccggggcatcaccacccaggtggccgcccggcggggcctgagcgcctggcctgtgccccaggagcccagcatggagtaccaggatgctgtgaggatgctgaacaccctgcagaccaatgccggctacctggagcaggtgaagaggcagagaggagacccccagacccagctggaggccatggagctgtacctggcccggagcggcctgcaggtggaggacctggaccggctgaacatcatccacgtgacaggcaccaagggcaagggcagcacctgtgccttcacagagtgcatcctgcggagctatggcctgaagacaggcttcttcagcagcccccacctggtgcaggtgcgggagcgcatccgcatcaatggccagcccatcagccctgagctgttcaccaagtacttctggaggctgtaccaccggctggaggagaccaaggatggcagctgtgtgtccatgccaccctacttccgcttcctgaccctgatggccttccacgtgttcctgcaggagaaggtggacctggccgtggtggaggtgggcattggaggagcctatgactgcaccaacatcatcaggaagcctgtggtgtgtggggtgagcagcctgggcatcgaccacaccagcctgctgggggacacagtggagaagatcgcctggcagaagggcggcatcttcaagcagggcgtgcctgccttcaccgtgctgcagcctgagggccccctggccgtgctgcgggaccgggcccagcagatctctgtgctgggcagccagaggcaccctggccagggcagctgtggcagctgcccctggcacctgtgcagcagcccccaccccacctgtggcagcggcttcggcaccaggagcggccgggccggccgccgctgctgcggggccggccccagccctggcacctggacagtgaggaccccacctgctgcccggcggcctgcctgtgccggcagcgcccggcgctgcagagctgcccggggccgggctgtggcccccaggtttgagagctgcagctccatgctgcccggcaccggcacccggcggccctgctag

SEQ ID NO: 152713 - DNA, 1128 bp, Artificial Sequence; identical to SEQ ID NO: 152712
  Description of Artificial Sequence: Synthetic coding sequence

SEQ ID NO: 152714 - DNA, 1764 bp, Artificial Sequence
  Description of Artificial Sequence: Synthetic coding sequence
atgagccgggcccggagccacctgcgggccgccctcttcctggccgccgccagcgcccggggcatcaccacccaggtggccgcccggcggggcctgagcgcctggcctgtgccccaggagcccagcatggagtaccaggatgctgtgaggatgctgaacaccctgcagaccaatgccggctacctggagcaggtgaagaggcagagaggagacccccagacccagctggaggccatggagctgtacctggcccggagcggcctgcaggtggaggacctggaccggctgaacatcatccacgtgacaggcaccaagggcaagggcagcacctgtgccttcacagagtgcatcctgcggagctatggcctgaagacaggcttcttcagcagcccccacctggtgcaggtgcgggagcgcatccgcatcaatggccagcccatcagccctgagctgttcaccaagtacttctggaggctgtaccaccggctggaggagaccaaggatggcagctgtgtgtccatgccaccctacttccgcttcctgaccctgatggccttccacgtgttcctgcaggagaaggtggacctggccgtggtggaggtgggcattggaggagcctatgactgcaccaacatcatcaggaagcctgtggtgtgtggggtgagcagcctgggcatcgaccacaccagcctgctgggggacacagtggagaagatcgcctggcagaagggcggcatcttcaagcagggcgtgcctgccttcaccgtgctgcagcctgagggccccctggccgtgctgcgggaccgggcccagcagatcagctgccccctgtacctgtgccccatgctggaggccctggaggagggcggcccccccctgaccctgggcctggagggggagcaccagaggagcaatgctgccctggccctgcagctggcccactgctggctgcagaggcaggacagacatggagctggggagcccaaggccagcaggcctggcctgctgtggcagctgcccctggcccctgtgttccagcccaccagccacatgaggctgggcctgaggaacacagagtggccaggccgcacccaggtgctgcggcggggccccctgacctggtacctggatggagcccacacagccagcagcgcccaggcctgtgtgcgctggttccggcaggccctgcagggccgggagcggcccagcggcggccctgaggtgcgggtgctgctcttcaatgccaccggggaccgggaccctgctgccctgctgaagctgctgcagccctgccagtttgattatgctgtgttctgccccaacctgacagaggtgagcagcactggaaatgctgaccagcagaacttcaccgtgaccctggaccaggtgctgctgcgctgcctggagcaccagcagcactggaaccacctggatgaggagcaggccagcccagacctgtggagcgcccccagccctgagcccggcggcagcgccagcctgctgctggccccccaccccccccacacctgcagcgccagcagcctggtgttcagctgcatcagccacgccctgcagtggatcagccagggccgggaccccatcttccagccccccagcccccccaagggcctgctgacccaccctgtggcccacagcggggccagcatcctgcgggaggccgccgccatccacgtgctggtgacaggcagcctgcacctggtgggcggcgtgctgaagctgctggagcccgccctgagccagtag

SEQ ID NO: 152715 - DNA, 1686 bp, Artificial Sequence
  Description of Artificial Sequence: Synthetic coding sequence
atgagccgggcccggagccacctgcgggccgccctcttcctggccgccgccagcgcccggggcatcaccacccaggtggccgcccggcggggcctgagcgcctggcctgtgccccaggagcccagcatggagtaccaggatgctgtgaggatgctgaacaccctgcagaccaatgccggctacctggagcaggtgaagaggcagagaggagacccccagacccagctggaggccatggagctgtacctggcccggagcggcctgcaggtggaggacctggaccggctgaacatcatccacgtgacaggcaccaagggcaagggcagcacctgtgccttcacagagtgcatcctgcggagctatggcctgaagacaggcttcttcagcagcccccacctggtgcaggtgcgggagcgcatccgcatcaatggccagcccatcagccctgagctgttcaccaagtacttctggaggctgtaccaccggctggaggagaccaaggtggacctggccgtggtggaggtgggcattggaggagcctatgactgcaccaacatcatcaggaagcctgtggtgtgtggggtgagcagcctgggcatcgaccacaccagcctgctgggggacacagtggagaagatcgcctggcagaagggcggcatcttcaagcagggcgtgcctgccttcaccgtgctgcagcctgagggccccctggccgtgctgcgggaccgggcccagcagatcagctgccccctgtacctgtgccccatgctggaggccctggaggagggcggcccccccctgaccctgggcctggagggggagcaccagaggagcaatgctgccctggccctgcagctggcccactgctggctgcagaggcaggacagacatggagctggggagcccaaggccagcaggcctggcctgctgtggcagctgcccctggcccctgtgttccagcccaccagccacatgaggctgggcctgaggaacacagagtggccaggccgcacccaggtgctgcggcggggccccctgacctggtacctggatggagcccacacagccagcagcgcccaggcctgtgtgcgctggttccggcaggccctgcagggccgggagcggcccagcggcggccctgaggtgcgggtgctgctcttcaatgccaccggggaccgggaccctgctgccctgctgaagctgctgcagccctgccagtttgattatgctgtgttctgccccaacctgacagaggtgagcagcactggaaatgctgaccagcagaacttcaccgtgaccctggaccaggtgctgctgcgctgcctggagcaccagcagcactggaaccacctggatgaggagcaggccagcccagacctgtggagcgcccccagccctgagcccggcggcagcgccagcctgctgctggccccccaccccccccacacctgcagcgccagcagcctggtgttcagctgcatcagccacgccctgcagtggatcagccagggccgggaccccatcttccagccccccagcccccccaagggcctgctgacccaccctgtggcccacagcggggccagcatcctgcgggaggccgccgccatccacgtgctggtgacaggcagcctgcacctggtgggcggcgtgctgaagctgctggagcccgccctgagccagtag

SEQ ID NO: 152716 - DNA, 585 bp, Artificial Sequence
  Description of Artificial Sequence: Synthetic coding sequence
atgctgaacaccctgcagaccaatgccggctacctggagcaggtgaagaggcagagaggagacccccagacccagctggaggccatggagctgtacctggcccggagcggcctgcaggtggaggacctggaccggctgaacatcatccacgtgacaggcaccaagggcaagggcagcacctgtgccttcacagagtgcatcctgcggagctatggcctgaagacaggcttcttcagcagcccccacctggtgcaggtgcgggagcgcatccgcatcaatggccagcccatcagccctgagctgttcaccaagtacttctggaggctgtaccaccggctggaggagaccaaggtggacctggccgtggtggaggtgggcattggaggagcctatgactgcaccaacatcatcaggaagcctgtggtgtgtggggtgagcagcctgggcatcgaccacaccagcctgctgggggacacagtggagaagatcgcctggcagaagggcggcatcttcaagcagggcgtgcctgccttcaccgtgctgcagcctgagggccccctggccgtgctgcgggaccgggcctag

SEQ ID NO: 152717 - DNA, 798 bp, Artificial Sequence
  Description of Artificial Sequence: Synthetic coding sequence
atgctgaacaccctgcagaccaatgccggctacctggagcaggtgaagaggcagagaggagacccccagacccagctggaggccatggagctgtacctggcccggagcggcctgcaggtggaggacctggaccggctgaacatcatccacgtgacaggcaccaagggcaagggcagcacctgtgccttcacagagtgcatcctgcggagctatggcctgaagacaggcttcttcagcagcccccacctggtgcaggtgcgggagcgcatccgcatcaatggccagcccatcagccctgagctgttcaccaagtacttctggaggctgtaccaccggctggaggagaccaaggatggcagctgtgtgtccatgccaccctacttccgcttcctgaccctgatggccttccacgtgttcctgcaggagaaggtggacctggccgtggtggaggtgggcattggaggagcctatgactgcaccaacatcatcaggaagcctgtggtgtgtggggtgagcagcctgggcatcgaccacaccagcctgctgggggacacagtggagaagatcgcctggcagaagggcggcatcttcaagcagggcgtgcctgccttcaccgtgctgcagcctgagggccccctggccgtgctgcgggaccgggcccagcagatctctgtgctgggcagccagaggcaccctggccagggcagctgtggcagctgcccctggcacctgtgcagcagcccccaccccacctgtggcagcggcttcggcaccaggagcggccgggccggccgctag

SEQ ID NO: 152718 - DNA, 1392 bp, Artificial Sequence
  Description of Artificial Sequence: Synthetic coding sequence
atgcacagcgccagctccatgctgggcgctgtgaagatggagggccacgagcccagcgactggagcagctactatgcagagcctgagggctacagctctgtgagcaacatgaatgccggcctgggcatgaatggcatgaacacctacatgtccatgtctgctgctgccatgggcagcggcagcggcaacatgtctgctggctccatgaacatgagcagctatgtgggcgccggcatgagccccagcctggccggcatgagccctggggccggggccatggccggcatgggcggcagcgctggagctgctggggtggccggcatgggcccccacctgagccccagcctgagccccctgggcggccaggccgccggggccatgggcggcctggccccctatgccaacatgaacagcatgagccccatgtatggccaggccggcctgagccgggcccgggaccccaagacctaccgccgcagctacacccacgccaagccaccctacagctacatcagcctcatcaccatggccatccagcagagccccaacaagatgctgaccctgtctgagatctaccagtggatcatggacctcttccccttctaccggcagaaccagcagcgctggcagaacagcatccgccacagcctgtccttcaatgactgcttcctgaaggtgcccaggagcccagacaagccaggcaagggcagcttctggaccctgcacccagattctggcaacatgtttgaaaatggctgctacctgcggcggcagaagcgcttcaagtgtgagaagcagctggccctgaaggaggccgccggggccgccggcagcggcaagaaggctgctgctggggcccaggccagccaggcccagctgggggaggccgccggccctgccagcgagaccccagctggaacagagagcccccacagcagcgccagcccctgccaggagcacaagagaggaggcctgggggagctgaagggcaccccagctgctgccctgagccccccagagcccgcccccagccctggccagcagcagcaggccgccgcccacctgctgggccccccccaccaccctggcctgcccccagaggcccacctgaagccagagcaccactacgccttcaaccaccccttcagcatcaacaacctgatgagcagcgagcagcagcaccaccacagccaccaccaccaccagccccacaagatggacctgaaggcctatgagcaggtgatgcactacccaggctacggcagccccatgcctggcagcctggccatgggccctgtgaccaacaagacaggcctggatgccagccccctggccgctgacaccagctactaccagggcgtgtacagccggcccatcatgaacagcagctag

SEQ ID NO: 152719 - DNA, 1374 bp, Artificial Sequence
  Description of Artificial Sequence: Synthetic coding sequence
atgctgggcgctgtgaagatggagggccacgagcccagcgactggagcagctactatgcagagcctgagggctacagctctgtgagcaacatgaatgccggcctgggcatgaatggcatgaacacctacatgtccatgtctgctgctgccatgggcagcggcagcggcaacatgtctgctggctccatgaacatgagcagctatgtgggcgccggcatgagccccagcctggccggcatgagccctggggccggggccatggccggcatgggcggcagcgctggagctgctggggtggccggcatgggcccccacctgagccccagcctgagccccctgggcggccaggccgccggggccatgggcggcctggccccctatgccaacatgaacagcatgagccccatgtatggccaggccggcctgagccgggcccgggaccccaagacctaccgccgcagctacacccacgccaagccaccctacagctacatcagcctcatcaccatggccatccagcagagccccaacaagatgctgaccctgtctgagatctaccagtggatcatggacctcttccccttctaccggcagaaccagcagcgctggcagaacagcatccgccacagcctgtccttcaatgactgcttcctgaaggtgcccaggagcccagacaagccaggcaagggcagcttctggaccctgcacccagattctggcaacatgtttgaaaatggctgctacctgcggcggcagaagcgcttcaagtgtgagaagcagctggccctgaaggaggccgccggggccgccggcagcggcaagaaggctgctgctggggcccaggccagccaggcccagctgggggaggccgccggccctgccagcgagaccccagctggaacagagagcccccacagcagcgccagcccctgccaggagcacaagagaggaggcctgggggagctgaagggcaccccagctgctgccctgagccccccagagcccgcccccagccctggccagcagcagcaggccgccgcccacctgctgggccccccccaccaccctggcctgcccccagaggcccacctgaagccagagcaccactacgccttcaaccaccccttcagcatcaacaacctgatgagcagcgagcagcagcaccaccacagccaccaccaccaccagccccacaagatggacctgaaggcctatgagcaggtgatgcactacccaggctacggcagccccatgcctggcagcctggccatgggccctgtgaccaacaagacaggcctggatgccagccccctggccgctgacaccagctactaccagggcgtgtacagccggcccatcatgaacagcagctag

SEQ ID NO: 152720 - DNA, 1374 bp, Artificial Sequence; identical to SEQ ID NO: 152719
  Description of Artificial Sequence: Synthetic coding sequence

SEQ ID NO: 152721 - DNA, 1032 bp, Artificial Sequence
  Description of Artificial Sequence: Synthetic coding sequence
atgctgggcgctgtgaagatggagggccacgagcccagcgactggagcagctactatgcagagcctgagggctacagctctgtgtcccgggcccgggaccccaagacctaccgccgcagctacacccacgccaagccaccctacagctacatcagcctcatcaccatggccatccagcagagccccaacaagatgctgaccctgtctgagatctaccagtggatcatggacctcttccccttctaccggcagaaccagcagcgctggcagaacagcatccgccacagcctgtccttcaatgactgcttcctgaaggtgcccaggagcccagacaagccaggcaagggcagcttctggaccctgcacccagattctggcaacatgtttgaaaatggctgctacctgcggcggcagaagcgcttcaagtgtgagaagcagctggccctgaaggaggccgccggggccgccggcagcggcaagaaggctgctgctggggcccaggccagccaggcccagctgggggaggccgccggccctgccagcgagaccccagctggaacagagagcccccacagcagcgccagcccctgccaggagcacaagagaggaggcctgggggagctgaagggcaccccagctgctgccctgagccccccagagcccgcccccagccctggccagcagcagcaggccgccgcccacctgctgggccccccccaccaccctggcctgcccccagaggcccacctgaagccagagcaccactacgccttcaaccaccccttcagcatcaacaacctgatgagcagcgagcagcagcaccaccacagccaccaccaccaccagccccacaagatggacctgaaggcctatgagcaggtgatgcactacccaggctacggcagccccatgcctggcagcctggccatgggccctgtgaccaacaagacaggcctggatgccagccccctggccgctgacaccagctactaccagggcgtgtacagccggcccatcatgaacagcagctag

SEQ ID NO: 152722 - DNA, 1053 bp, Artificial Sequence
  Description of Artificial Sequence: Synthetic coding sequence
atgctgggctctgtgaagatggaggcccatgacctggccgagtggagctactacccagaggccggggaggtgtacagccctgtgacccctgtgcccaccatggcccccctgaacagctacatgaccctgaaccccctgagcagcccctacccacctgggggcctgcctgccagccccctgcccagcggccccctggcccccccagccccagctgcccccctgggccccaccttccctggcctgggcgtgtctgggggcagcagcagcagcggctacggggcccctggccctggcctggtgcacggcaaggagatgcccaagggctaccgccggcccctggcccacgccaagccaccctacagctacatcagcctcatcaccatggccatccagcaggcccctgggaagatgctgaccctgtctgagatctaccagtggatcatggacctcttcccctactaccgggagaaccagcagcgctggcagaacagcatccgccacagcctgtccttcaatgactgctttgtgaaggtggcccggagcccagacaagccaggcaagggcagctactgggccctgcaccccagcagcggcaacatgtttgaaaatggctgctacctgcggcggcagaagcgcttcaagctggaggagaaggtgaagaagggcggcagcggggccgccaccaccaccagaaatggcaccggcagcgctgccagcaccaccaccccagctgccaccgtgaccagccccccccagcccccacctccagcccctgagcctgaggcccagggcggggaggatgtgggcgccctggactgtggcagccctgccagcagcaccccctacttcaccggcctggagctgcctggagagctgaagctggatgccccctacaacttcaaccaccccttcagcatcaacaacctgatgtctgagcagaccccagccccacccaagctggatgtgggctttggaggctatggagctgagggcggggagcccggggtgtactaccagggcctgtacagccgcagcctgctgaatgccagctag

SEQ ID NO: 152723 - DNA, 1662 bp, Artificial Sequence
  Description of Artificial Sequence: Synthetic coding sequence
atgcaggcccgctacagcgtgagcagccccaacagcctgggcgtggtgccctacctgggcggggagcagagctactacagagctgctgctgctgctgctgggggcggctacacagccatgcctgcccccatgtctgtgtacagccacccagcccatgctgagcagtacccaggcggcatggcccgggcctacggcccctacaccccccagccccagcccaaggacatggtgaagccaccctacagctacatcgccctgatcaccatggccatccagaatgccccagacaagaagatcaccctgaatggcatctaccagttcatcatggaccgcttccccttctacagagacaacaagcagggctggcagaacagcatccgccacaacctgagcctgaatgaatgttttgtgaaggtgcccagagatgacaagaagccaggcaagggcagctactggaccctggaccctgacagctacaacatgtttgaaaatggcagcttcctgcggaggagaagacgcttcaagaagaaggatgctgtgaaggacaaggaggagaaggaccggctgcacctgaaggagcccccacctcctggccggcagcccccaccagcccctcctgagcaggctgatggaaatgcccctggcccccagcccccacctgtgcgcatccaggacatcaagacagaaaatggcacctgccccagccccccccagcccctgagccctgctgctgccctgggcagcggcagcgctgctgctgtgcccaagattgagagcccagacagcagcagcagcagcctgagcagcggcagcagccccccaggcagcctgcccagcgcccggcccctgagcctggatggagctgacagcgcccctcctcctccagcccccagcgcccccccaccccaccacagccagggcttctctgtggacaacatcatgaccagcctgcggggcagcccccagagcgctgctgctgagctgagcagcggcctgctggccagcgctgctgccagcagccgggccggcatcgccccacccctggccctgggcgcctacagccctggccagagcagcctgtacagcagcccctgcagccagaccagcagcgctggcagcagcggcggcggcggcggcggggccggggccgccggcggggccggcggggccggcacctaccactgcaacctgcaggccatgagcctgtatgctgctggggagcggggcggccacctgcagggcgcccctgggggcgccggcggcagcgctgtggatgaccccctgcctgactacagcctgccccctgtgaccagcagcagcagcagcagcctgagccacggcggcggcggcggcggcggcggcggcggccaggaggccggccaccaccctgctgcccaccagggccgcctgacctcctggtacctgaaccaggccggcggggacctgggccacctggccagcgctgctgctgctgctgctgctgctggctacccaggccagcagcagaacttccacagcgtgcgggagatgtttgagagccagagaattggcctgaacaacagccctgtgaatggaaacagcagctgccagatggccttccccagcagccagagcctgtaccgcaccagcggggcctttgtgtatgactgcagcaagttctag

SEQ ID NO: 152724 - DNA, 639 bp, Artificial Sequence
  Description of Artificial Sequence: Synthetic coding sequence
atgcaggcccgctacagcgtgagcagccccaacagcctgggcgtggtgccctacctgggcggggagcagagctactacagagctgctgctgctgctgctgggggcggctacacagccatgcctgcccccatgtctgtgtacagccacccagcccatgctgagcagtacccaggcggcatggcccgggcctacggcccctacaccccccagccccagcccaaggacatggtgaagccaccctacagctacatcgccctgatcaccatggccatccagaatgccccagacaagaagatcaccctgaatggcatctaccagttcatcatggaccgcttccccttctacagagacaacaagcagggctggcagaacagcatccgccacaacctgagcctgaatgaatgttttgtgaaggtgcccagagatgacaagaagccaggcaagggcagctactggaccctggaccctgacagctacaacatgtttgaaaatggcagcttcctgcggaggagaagacgcttcaagaagaaggatgctgtgaaggacaaggaggagaaggaccggccccaggccacccgggccagcagcaggaccagcacccgctgtggccgctgcagcagccaccggggcagcgcctag

SEQ ID NO: 152725 - DNA, 1488 bp, Artificial Sequence
  Description of Artificial Sequence: Synthetic coding sequence
atgaccctgggcagctgctgctgtgagatcatgagcagcgagagcagccctgctgccctgtctgaggctgatgctgacattgatgtggtgggcggcggcagcggcggcggggagctgcctgcccggagcggcccccgggcccccagagatgtgctgccccacggccacgagcccccagctgaggaggccgaggccgacctggctgaagatgaggaggagagcggcggctgcagtgatggagagccccgggccctggccagcagaggagctgctgctgctgctggcagccctggccctggagctgctgctgcccggggagctgctggccctggccctggcccccccagcggcggggccgccaccaggagccccctggtgaagccaccctacagctacatcgccctgatcaccatggccatcctgcagagccccaagaagaggctgaccctgtctgagatctgtgagttcatcagcggccgcttcccctactaccgggagaagtttcctgcctggcagaacagcatccgccacaacctgagcctgaatgactgctttgtgaagatcccccgggagcccggcaaccctggaaaaggaaactactggaccctggaccctgagagcgctgacatgtttgacaatggcagcttcctgcggcggaggaagcgcttcaagaggcagcccctgcccccaccccacccccacccccacccccaccctgagctgctgctgcggggcggcgctgctgctgctggggaccccggggccttcctgcccggctttgctgcctatggagcctacggctacggctacggcctggccctgcctgcctatggagcccctcctcctggccctgccccccacccccacccccacccccacgcctttgcctttgctgctgctgctgctgctgccccctgccagctgtctgtgcccccaggccgggccgccgcccctcctcctggccccccaacagcctctgtgtttgctggagctggcagcgccccagccccagccccagccagcggcagcggccctggccctggccctgctggcctgcctgccttcctgggcgctgagctgggctgtgccaaggccttctacgccgccagcctgagccccccagctgctggaacagctgctggcctgcccacagccctgctgcggcagggcctgaagacagatgctgggggcggggccggcggcggcggggccggggccggccagaggcccagcttcagcattgaccacatcatgggccacggcggcggcggggccgcccctcctggggccggggagggcagccctggccccccatttgctgctgctgctggccctgggggccaggcccaggtgctggccatgctgacagccccagccctggcccctgtggccggccacatccggctgagccaccctggagatgccctgctgagcagcggcagcagatttgccagcaaggtggccggcctgagcggctgccacttctag

SEQ ID NO: 152726 - DNA, 1437 bp, Artificial Sequence
  Description of Artificial Sequence: Synthetic coding sequence
atgaccctgagcggcggcggcagcgccagtgacatgagcggccagacagtgctgacagcagaagatgtggacattgatgtggtgggggagggagatgatggcctggaggagaaggacagtgatgctggctgtgacagccctgctggccccccagagctgcggctggatgaagcagatgaggtgcccccagctgccccccaccacggccagccccagcccccccaccagcagcccctgaccctgcccaaggaggccgccggggccggggccggccctggaggagatgtgggcgcccctgaggctgatggctgcaagggcggcgtgggcggggaggagggcggggccagcggcggcggccctggggccggcagcggcagcgctgggggcctggcccccagcaagcccaagaacagcctggtgaagccaccctacagctacatcgccctgatcaccatggccatcctgcagagcccccagaagaagctgaccctgagcggcatctgtgagttcatcagcaaccgcttcccctactaccgggagaagtttcctgcctggcagaacagcatccgccacaacctgagcctgaatgactgctttgtgaagatcccccgggagcccggcaaccctggaaaaggaaactactggaccctggacccccagagcgaggacatgtttgacaatggcagcttcctgcggcggaggaagcgcttcaagaggcaccagcaggagcacctgcgggagcagacagccctgatgatgcagagctttggagcctacagcctggccgctgctgctggagctgctggcccctacggccggccctacggcctgcaccctgctgctgctgctggggcctacagccaccctgctgctgctgctgctgctgctgctgctgctgccctgcagtacccctatgccctgccccctgtggcccctgtgctgcccccagctgtgcccctgctgcccagcggggagctgggcaggaaggctgctgccttcggcagccagctgggccctggcctgcagctgcagctgaacagcctgggcgctgctgctgctgctgctggaacagctggagctgctggcaccacagccagcctcatcaagtctgagcccagcgcccggcccagcttcagcattgagaacatcatcggcggcggccctgctgcccctgggggcagcgctgtgggcgctggggtggccggcggcaccggcggcagcggcggcggcagcacagcccagagcttcctgcggcccccaggcaccgtgcagagcgctgccctgatggccacccaccagcccctgagcctgagcaggaccacagccaccatcgcccccatcctgtctgtgcccctgagcggccagttcctgcagcctgctgccagcgctgctgctgctgctgctgctgctgcccaggccaagtggccagcccagtag

SEQ ID NO: 152727 - DNA, 1320 bp, Artificial Sequence
  Description of Artificial Sequence: Synthetic coding sequence
atgaacctgcccagggctgagcggctgcggagcaccccccagaggagcctgcgggacagtgatggagaagatggcaagattgatgtgctgggggaggaggaggatgaagatgaggaggaggccgccagccagcagttcctggagcagagcctgcagcccggcctgcaggtggcccgctggggcggcgtggccctgccccgggagcacatcgagggcggcggcggccccagcgaccccagcgagtttggaacagagttccgggccccacccaggtctgctgctgcctctgaagatgcccggcagcctgccaagccacccagcagctacatcgccctgatcaccatggccatcctgcagagcccccacaagaggctgaccctgagcggcatctgtgccttcatcagtgaccgcttcccctactacagaaggaagtttcctgcctggcagaacagcatccgccacaacctgagcctgaatgactgctttgtgaagatcccccgggagcccggccggcctgggaagggcaactactggagcctggaccctgccagccaggacatgtttgacaatggcagcttcctgcggcggaggaagcgcttccagaggcaccagcccacccctggggcccacctgccccaccccttccccctgcctgctgcccacgccgccctgcacaaccccaggcctggccccctgctgggcgccccagccccaccccagcctgtgcctggggcctaccccaacacaggccctggaagaagaccctatgccctgctgcacccccaccccccacgctacctgctgctgagcgccccagcctatgctggggcccccaagaaggccgagggcgctgacctggccaccccagcccccttcccctgctgcagcccccacctggtgctgagcctgggcagaagagcccgggtgtggaggaggcaccgggaggctgatgccagcctgagcgccctgcgggtgtcctgcaagggcagcggggagcgggtgcagggcctgcggcgggtgtgcccccggcccaggggggccacagccccctgcagcagtgaccggcaggcctgcaggaccatcctgcagcagcagcagaggcaccaggaggaggactgtgccaacggctgtgcccccaccaagggagctgtgctgggcggccacctgtctgctgccagcgccctgctgcgctaccaggccgtggccgagggcagcggcctgaccagcctggccgcccccctgggcggggagggcaccagccctgtgttcctggtgagccccacccccagcagcctggccgagagcgctggccccagctag

SEQ ID NO: 152728 - DNA, 1227 bp, Artificial Sequence
  Description of Artificial Sequence: Synthetic coding sequence
atgaacctgcccagggctgagcggcccaggagcaccccccagaggagcctgcgggacagtgatggagaagatggcaagattgatgtgctgggggaggaggaggatgaagatgaggtggaggatgaggaggaggaggccagccagaagttcctggagcagagcctgcagcccggcctgcaggtggcccgctggggcggcgtggccctgccccgggagcacatcgagggcggcggccccagcgaccccagcgagtttggaacagagttccgggccccacccaggtctgctgctgcctctgaagatgcccggcagcctgccaagccaccctacagctacatcgccctgatcaccatggccatcctgcagagcccccacaagaggctgaccctgagcggcatctgtgccttcatcagcggccgcttcccctactacagaaggaagtttcctgcctggcagaacagcatccgccacaacctgagcctgaatgactgctttgtgaagatcccccgggagcccggccaccctgggaagggcacctactggagcctggaccctgccagccaggacatgtttgacaatggcagcttcctgcggcggaggaagcgcttcaagaggcaccagctgacccctggggcccacctgccccaccccttccccctgcctgctgcccatgctgccctgcacaacccccggcccggccccctgctgggcgccccagccctgccccagcctgtgcctggggcctaccccaacacagcccctggccggcggccctatgccctgctgcacccccaccccccacgctacctgctgctgagcgccccagcctatgctggggcccccaagaaggccgagggcgctgacctggccaccccaggcaccctgcctgtgctgcagcccagcctgggcccccagccctgggaggagggcaagggcctggccagccccccaggcggcggctgcatctccttcagcattgagagcatcatgcagggcgtgcggggggccggcaccggggccgcccagagcctgagccccacagcctggagctactgccccctgctgcagaggcccagcagcctgagtgacaactttgctgccacagctgctgccagcggcggcggcctgcggcagaggctgcggagccaccagggccgcggggccggccgggcccctgtgggccgggtgggcgctgctgctgtgtctgggggcggccggggcctgtag

SEQ ID NO: 152729 - DNA, 1251 bp, Artificial Sequence
  Description of Artificial Sequence: Synthetic coding sequence
atgaacctgcccagggctgagcggcccaggagcaccccccagaggagcctgcgggacagtgatggagaagatggcaagattgatgtgctgggggaggaggaggatgaagatgaggtggaggatgaggaggaggaggcccggcagcagttcctggagcagagcctgcagcccggcctgcaggtggcccgctggggcggcgtggccctgccccgggagcacatcgagggcggcggcggccccagcgaccccagcgagtttggcaccaagttccgggccccacccaggtctgctgctgcctctgaagatgcccggcagcctgccaagccaccctacagctacatcgccctgatcaccatggccatcctgcagaacccccacaagaggctgaccctgagcggcatctgtgccttcatcagcggccgcttcccctactacagaaggaagtttcctgcctggcagaacagcatccgccacaacctgagcctgaatgactgctttgtgaagatcccccgggagcccggccaccctgggaagggcaactactggagcctggaccctgccagccaggacatgtttgacaatggcagcttcctgcggcggaggaagcgcttcaagaggcaccagctgacccctggggcccacctgccccaccccttccccctgcctgctgcccacgccgccctgcacaacccccaccctggccccctgctgggcgccccagccccaccccagcctgtgcctggggcctaccccaacacagcccctggaagaagaccctatgccctgctgcacccccaccccctgcgctacctgctgctgagcgcccgggtgtatgctggggcccccaagaaggccgagggcgctgacctggccaccccagcccccttcccctgctgcagcccccacctggtgctgagcctgggcagaagagcccgggtgtggaggaggcaccgggaggctgatgccagcctgagcgccctgcgggtgctgtgcaagggcagcggggagcgggtgcagggcctgcggcgggtgtgcccccggcccaggggggccacagccacctgcagcagtgaccaccaggcctgctgcatccccaagcccctgcccctgtgctgcaagtgccccccacccctgctgctgggccagttctgcagcaacagcagcagcatcagaagaacagcccccacagctgccctgcccccccgggcccgctgctgggccggcacctgccggccccggcggcgctgctag

SEQ ID NO: 152730 - DNA, 1254 bp, Artificial Sequence
  Description of Artificial Sequence: Synthetic coding sequence
atgaacctgcccagggctgagcggctgcggagcaccccccagaggagcctgcgggacagtgatggagaagatggcaagattgatgtgctgggggaggaggaggatgaagatgaggtggaggatgaggaggaggccgccagccagcagttcctggagcagagcctgcagcccggcctgcaggtggcccgctggggcggcgtggccctgccccgggagcacatcgagggcggcggcggccccagcgaccccagcgagtttggcaccaagttccgggccccacccaggtctgctgctgcctctgaagatgcccggcagcctgccaagccaccctacagctacatcgccctgatcaccatggccatcctgcagaacccccacaagaggctgaccctgagcggcatctgtgccttcatcagcggccgcttcccctactacagaaggaagtttcctgcctggcagaacagcatccgccacaacctgagcctgaatgactgctttgtgaagatcccccgggagcccggccaccctgggaagggcaactactggagcctggaccctgccagccaggacatgtttgacaatggcagcttcctgcggcggaggaagcgcttcaagaggcaccagctgacccctggggcccacctgccccaccccttccccctgcctgctgcccacgccgccctgcacaaccccaggcctggccccctgctgggcgccccagccccaccccagcctgtgcctggggcctaccccaacacagcccctggaagaagaccctatgccctgctgcacccccaccccctgcgctacctgctgctgagcgcccctgtgtatgctggggcccccaagaaggccgagggcgccgccctggccaccccagcccccttcccctgctgcagcccccacctggtgctgagcctgggcagaagagcccgggtgtggaggaggcaccgggaggctgatgccagcctgagcgccctgcgggtgctgtgcaagggcagcggggagcgggtgcagggcctgcggcgcatctgcccccggcccaggggggccacagccacctgcagcagtgaccaccaggcctgctgcatcccccggcccctgcccctgtgctgcaagtgccccccaccacccctgctgggccagttctgcagcaacagcagcagcatcagaagaagaacagcccccacagctgccctgcccccccgggcccgctgctgggccggcacctgccggccccggcggccctgctag

SEQ ID NO: 152731 - DNA, 1122 bp, Artificial Sequence
  Description of Artificial Sequence: Synthetic coding sequence
atgacagctgagagcggccccccaccaccccagcctgaggtgctggccaccgtgaaggaggagcggggggagacagctgctggagctggggtgcctggagaggccaccggccgcggggccggcggcagaagaaggaagaggcccctgcagaggggcaagccaccctacagctacatcgccctgattgccatggccatcgcccacgcccctgagcggcggctgaccctgggcggcatctacaagttcatcacagagcgcttccccttctacagagacaaccccaagaagtggcagaacagcatccgccacaacctgaccctgaatgactgcttcctgaagatcccccgggaggccggccggcctggaaaaggaaactactgggccctggaccccaatgctgaggacatgtttgaaagtggcagcttcctgcggcggaggaagcgcttcaagagaagtgacctgagcacctacccagcctacatgcatgatgctgctgctgctgctgctgctgctgctgctgctgctgctgctgctgccatcttccctggagctgtgcctgctgcccggcccccctacccaggagctgtgtatgccggctacgccccacccagcctggccgcccctcctcctgtgtactacccagctgccagccctggcccctgccgggtgtttggcctggtgcctgagcggcccctgagccctgagctgggccctgcccccagcggccctgggggcagctgtgcctttgccagcgctggggccccagccaccaccaccggctaccagcctgctggctgcacaggagcccggcctgccaaccccagcgcctatgctgctgcctatgccggcccagatggagcctacccccagggcgccggcagcgccatctttgctgctgctggccgcctggccggccctgccagccccccagctgggggcagcagtggaggagtggagaccaccgtggacttctacggccgcaccagccctggccagtttggagccctgggcgcctgctacaaccctgggggccagctgggcggggccagcgctggggcctaccacgcccggcatgctgctgcctacccaggcggcatcgacagatttgtgtctgccatgtag

SEQ ID NO: 152732 - DNA, 960 bp, Artificial Sequence
  Description of Artificial Sequence: Synthetic coding sequence
atggccggccgcagtgacatggaccccccagctgccttcagcggcttccctgccctgcctgctgtggcccccagcggccccccacccagccccctggccggggctgagcccggccgggagcctgaggaggccgccgccggccgcggggaggccgcccccaccccagcccctggccctggaagaagaagaagaagacccctgcagaggggcaagccaccctacagctacatcgccctgattgccatggccctggcccacgcccctggccggcggctgaccctggccgccatctaccgcttcatcacagaaagatttgccttctacagagacagccccaggaagtggcagaacagcatccgccacaacctgaccctgaatgactgctttgtgaaggtgccccgggagcccggcaaccctggaaaaggaaactactggaccctggaccctgctgctgctgacatgtttgacaatggcagcttcctgcggcggaggaagcgcttcaagagagctgagctgcctgcccacgccgccgccgcccctggcccccccctgcccttcccctatgccccctatgccccagcccctggccctgccctgctggtgcccccaccttctgctggccctggccccagccccccagcccggctcttctctgtggacagcctggtgaacctgcagcctgagctggccggcctgggcgcccctgagcccccctgctgtgccgccccagatgctgctgctgctgccttccccccctgtgccgccgccgccagcccccccctgtacagccaggtgcctgaccggctggtgctgcctgccacccggcccggccctggccccctgcctgctgagcccctgctggccctggccggccctgctgctgccctgggccccctgagccctggagaggcctacctgcggcagcccggctttgccagcggcctggagcgctacctgtag

SEQ ID NO: 152733 - DNA, 1335 bp, Artificial Sequence
  Description of Artificial Sequence: Synthetic coding sequence
atgaccacagaaggaggccccccaccagcccccctgcggcgggcctgcagccctgtgcctggggccctgcaggccgccctgatgagccccccacctgctgctgctgctgctgctgctgctgcccctgagaccaccagcagcagcagcagcagcagcagcgccagctgtgccagcagcagcagcagcagcaacagcgccagcgcccccagcgctgcctgcaagtctgctgggggcggcggggccggggccggcagcggcggggccaagaaggccagcagcggcctgcggcggcctgagaagccaccctacagctacatcgccctgattgtgatggccatccagagcagccccagcaagaggctgaccctgtctgagatctaccagttcctgcaggcccgcttccccttcttccggggggcctaccagggctggaagaacagcgtgcgccacaacctgagcctgaatgaatgcttcatcaagctgcccaagggcctgggccggcctgggaagggccactactggaccatcgaccctgccagcgagttcatgtttgaggagggcagcttcagaagaagaccccggggcttccggaggaagtgccaggccctgaagcccatgtaccaccgggtggtgtctggcctgggctttggagccagcctgctgccccagggctttgacttccaggccccacccagcgcccccctgggctgccacagccagggcggctatggaggcctggacatgatgcctgctggctatgatgctggagctggggcccccagccacgcccacccccaccaccaccaccaccaccacgtgccccacatgagccccaaccctggcagcacctacatggccagctgccctgtgcctgctggccctgggggcgtgggcgccgccggcggcggcggcggcggggactatggccctgacagcagcagcagccctgtgcccagcagccctgccatggccagcgccatcgagtgccacagcccctacaccagccctgctgcccactggagcagccctggggccagcccctacctgaagcagcccccagccctgacccccagcagcaacccagctgccagcgctggcctgcacagctccatgagcagctacagcctggagcagagctacctgcaccagaatgcccgggaggacctgtctgtgggcctgccccgctaccagcaccacagcacccctgtgtgtgacaggaaggactttgtgctgaacttcaacggcatcagcagcttccaccccagcgccagcggcagctactaccaccaccaccaccagagcgtgtgccaggacatcaagccctgtgtgatgtag

SEQ ID NO: 152734 - DNA, 1470 bp, Artificial Sequence
  Description of Artificial Sequence: Synthetic coding sequence
atgctggacatgggagacaggaaggaggtgaagatgatccccaagagcagcttcagcatcaacagcctggtgcctgaggccgtgcagaatgacaaccaccacgccagccacggccaccacaacagccaccacccccagcaccaccaccaccaccaccaccaccaccaccaccccccacctccagccccccagcccccacctccaccccagcagcagcagcccccacctcctcctcctccagccccccagcccccccagaccaggggggccccagctgctgatgatgacaagggcccccagcagctgctgctgcccccacctcctcctcctcctcctgctgctgccctggatggagccaaggcagatggcctgggcggcaaaggagagcccggcggcggccctggagagctggcccctgtgggcccagatgagaaggagaagggagctggagctggaggagaggagaagaagggagctggggagggcggcaaggatggagagggcggcaaggagggggagaagaagaatggcaagtatgagaagccacccttctcctacaatgccctgatcatgatggccatccggcagagccctgagaagaggctgaccctgaatggcatctatgagttcatcatgaagaacttcccctactaccgggagaacaagcagggctggcagaacagcatccgccacaacctgagcctgaacaagtgctttgtgaaggtgcccaggcactatgatgatcctggaaaaggaaactactggatgctggaccccagcagtgatgatgtgttcatcggcggcaccaccgggaagctgcggcggcgcagcaccaccagccgggccaagctggccttcaagagaggagcccggctgaccagcacaggcctgaccttcatggacagagctggcagcctgtactggcccatgagccccttcctgagcctgcaccacccccgggccagcagcaccctgagctacaacggcaccaccagcgcctaccccagccaccccatgccctacagctctgtgctgacccagaacagcctgggcaacaaccacagcttcagcacagccaacggcctgtctgtggaccggctggtgaatggagagatcccctatgccacccaccacctgacagctgctgccctggccgcctctgtgccctgtggcctgtctgtgccctgcagcggcacctacagcctgaacccctgcagcgtgaacctgctggccggccagaccagctacttcttcccccacgtgccccaccccagcatgaccagccagagcagcacctccatgtctgcccgggccgccagcagcagcaccagcccccaggcccccagcaccctgccctgtgagagcctgcggcccagcctgcccagcttcaccaccggcctgagcggcggcctgagtgactacttcacccaccagaaccagggcagcagcagcaaccccctcatccactag

SEQ ID NO: 152735 - DNA, 1470 bp, Artificial Sequence; identical to SEQ ID NO: 152734
  Description of Artificial Sequence: Synthetic coding sequence

SEQ ID NO: 152736 - DNA, 1137 bp, Artificial Sequence
  Description of Artificial Sequence: Synthetic coding sequence
atgagcagctttgacctgcctgcccccagccccccacgctgcagcccccagttccccagcatcggccaggagcccccagagatgaacctgtactatgagaacttcttccacccccagggcgtgcccagcccccagaggcccagctttgaaggaggaggagaatatggagccacccccaacccctacctgtggttcaacggccccaccatgaccccaccaccctacctgcccggccccaatgccagccccttcctgccccaggcctatggagtgcagaggcccctgctgcccagcgtgtctggcctgggcggcagtgacctgggctggctgcccatccccagccaggaggagctgatgaagctggtgcggcccccctacagctacagcgccctgattgccatggccatccatggagccccagacaagaggctgaccctgagccagatctaccagtatgtggccgacaacttccccttctacaacaagagcaaggccggctggcagaacagcatccgccacaacctgagcctgaatgactgcttcaagaaggtgcccagagatgaagatgatcctggaaaaggaaactactggaccctggaccccaactgtgagaagatgtttgacaatggaaacttccggaggaagaggaagaggaagagtgatgtgagcagcagcacagccagcctggccctggagaagacagagagcagcctgcctgtggacagccccaagaccacagagccccaggacatcctggatggagccagccctgggggcaccaccagcagccctgagaagaggcccagccccccaccttctggggccccctgcctgaacagcttcctgagctccatgacagcctacgtgtctgggggcagccccaccagccaccccctggtgaccccaggcctgagccctgagcccagcgacaagacaggccagaacagcctgaccttcaacagcttcagccccctgaccaacctgagcaaccacagcggcggcggggactgggccaaccccatgcccaccaacatgctgtcctatggaggctctgtgctgagccagttcagcccccacttctacaacagcgtgaacaccagcggcgtgctgtacccccgggagggcacagaggtgtag

SEQ ID NO: 152737 - DNA, 852 bp, Artificial Sequence
  Description of Artificial Sequence: Synthetic coding sequence
atgagcagctttgacctgcctgcccccagccccccacgctgcagcccccagttccccagcatcggccaggagcccccagagatgaacctgtactatgagaacttcttccacccccagggcgtgcccagcccccagaggcccagctttgaaggaggaggagaatatggagccacccccaacccctacctgtggttcaacggccccaccatgaccccaccaccctacctgcccggccccaatgccagccccttcctgccccaggcctatggagtgcagaggcccctgctgcccagcgtgtctggcctgggcggcagtgacctgggctggctgcccatccccagccaggaggagctgatgaagctggtgcggcccccctacagctacagcgccctgattgccatggccatccatggagccccagacaagaggctgaccctgagccagatctaccagtatgtggccgacaacttccccttctacaacaagagcaaggccggctggcagaacagcatccgccacaacctgagcctgaatgactgcttcaagaaggtgcccagagatgaagatgatcctgcctacgtgtctgggggcagccccaccagccaccccctggtgaccccaggcctgagccctgagcccagcgacaagacaggccagaacagcctgaccttcaacagcttcagccccctgaccaacctgagcaaccacagcggcggcggggactgggccaaccccatgcccaccaacatgctgtcctatggaggctctgtgctgagccagttcagcccccacttctacaacagcgtgaacaccagcggcgtgctgtacccccgggagggcacagaggtgtag

SEQ ID NO: 152738 - DNA, 1266 bp, Artificial Sequence
  Description of Artificial Sequence: Synthetic coding sequence
atggccgagagctggctgcggctgtctggagctggccctgctgaggaggccggccctgagggcggcctggaggagccagatgccctggatgacagcctgaccagcctgcagtggctgcaggagttcagcatcctgaatgccaaggccccagccctgcccccaggcggcacagacccccacggctaccaccaggtgcccggcagcgctgcccctggcagccccctggccgctgaccctgcctgcctgggccagccccacacccctgggaagcccaccagcagctgcaccagccgcagcgcccctcctggcctgcaggcccctcctccagatgatgtggactatgccaccaacccccacgtgaagccaccctacagctatgccaccctcatctgcatggccatgcaggccagcaaggccaccaagatcaccctgagcgccatctacaagtggatcacagacaacttctgctacttcagacatgctgaccccacctggcagaacagcatccgccacaacctgagcctgaacaagtgcttcatcaaggtgccccgggagaaggatgagcctggaaaaggaggcttctggagaattgacccccagtatgcagagcggctgctgagcggggccttcaagaagaggcggctgccccctgtgcacatccacccagcctttgcccggcaggccgcccaggagcccagcgctgtgccccgggccggccccctgactgtgaacacagaggcccagcagctgctgcgggagtttgaggaggccaccggggaggccggctggggcgctggggagggccgcctgggccacaagaggaagcagcccctgcccaagagggtggccaaggtgccccggccccccagcaccctgctgcccaccccagaggagcagggcgagctggagcccctgaagggcaactttgactgggaggccatctttgatgctggcaccctgggcggggagctgggcgccctggaggccctggagctgagcccccccctgagccctgccagccacgtggatgtggacctgaccatccacggccgccacatcgactgcccagccacctggggccccagcgtggagcaggccgctgacagcctggactttgatgagaccttcctggccaccagcttcctgcagcacccctgggatgaaagtggcagcggctgcctgcccccagagcccctgtttgaggccggagatgccaccctggccagtgacctgcaggactgggcctctgtgggcgccttcctgtag

SEQ ID NO: 152739 - DNA, 987 bp, Artificial Sequence
  Description of Artificial Sequence: Synthetic coding sequence
atggctgctgctgctgctgccctgtctggagctggcaccccacctgctgggggcggggccggcggcggcggggccggcggcggcggcagccccccaggcggctgggccgtggcccggctggagggccgggagtttgagtacctgatgaagaagaggtctgtgaccatcggcaggaacagcagccagggctctgtggatgtgtccatgggccacagcagcttcatcagcagaagacacctggagatcttcaccccacctgggggcggcggccatggaggagctgcccctgagctgcccccagcccagcccaggccagatgctggaggagacttctacctgcgctgcctgggcaagaatggagtgtttgtggatggagtcttccagaggagaggagccccacccctgcagctgccccgggtgtgcaccttccgcttccccagcaccaacatcaagatcaccttcaccgccctgagcagcgagaagcgggagaagcaggaggccagcgagagccctgtgaaggctgtgcagccccacatcagccccctgaccatcaacatcccagacaccatggcccacctgatcagccccctgcccagccccaccggcaccatctctgctgccaacagctgccccagcagccccagaggagctggcagcagcggctacaaggtgggccgggtgatgcccagcgacctgaacctgatggctgacaacagccagccagaaaatgagaaggaggccagcggcggggacagccccaaggatgacagcaagccaccctacagctatgcccagctgattgtgcaggccatcaccatggccccagacaagcagctgaccctgaatggcatctacacccacatcaccaagaactacccctactacagaacagctgacaagggctggcagagaggagagagctttgcccacgtgggcaacacccgcatccgcatcggcctgcctgcccacaaggccccccagaggtag

SEQ ID NO: 152740 - DNA, 1983 bp, Artificial Sequence
  Description of Artificial Sequence: Synthetic coding sequence
atggctgctgctgctgctgccctgtctggagctggcaccccacctgctgggggcggggccggcggcggcggggccggcggcggcggcagccccccaggcggctgggccgtggcccggctggagggccgggagtttgagtacctgatgaagaagaggtctgtgaccatcggcaggaacagcagccagggctctgtggatgtgtccatgggccacagcagcttcatcagcagaagacacctggagatcttcaccccacctgggggcggcggccatggaggagctgcccctgagctgcccccagcccagcccaggccagatgctggaggagacttctacctgcgctgcctgggcaagaatggagtgtttgtggatggagtcttccagaggagaggagccccacccctgcagctgccccgggtgtgcaccttccgcttccccagcaccaacatcaagatcaccttcaccgccctgagcagcgagaagcgggagaagcaggaggccagcgagagccctgtgaaggctgtgcagccccacatcagccccctgaccatcaacatcccagacaccatggcccacctgatcagccccctgcccagccccaccggcaccatctctgctgccaacagctgccccagcagccccagaggagctggcagcagcggctacaaggtgggccgggtgatgcccagcgacctgaacctgatggctgacaacagccagccagaaaatgagaaggaggccagcggcggggacagccccaaggatgacagcaagccaccctacagctatgcccagctgattgtgcaggccatcaccatggccccagacaagcagctgaccctgaatggcatctacacccacatcaccaagaactacccctactacagaacagctgacaagggctggcagaacagcatccgccacaacctgagcctgaaccgctacttcatcaaggtgcccaggagccaggaggagcccgggaagggcagcttctggagaattgatcctgccagcgagagcaagctgattgagcaggccttcaggaagaggcggccccggggcgtgccctgcttccgcacccccctgggccccctgagcagccgcagcgccccagccagccccaaccacgccggcgtgctgagcgcccacagcagcggggcccagaccccagagagcctgagccgggagggcagccctgcccccctggagcctgagcccggggccgcccagcccaagctggccgtcatccaggaggccaggtttgcccagagcgcccctggcagccccctgagcagccagcctgtgctgatcaccgtgcagaggcagctgccccaggccatcaagcctgtgacctacacagtggccacccctgtgaccaccagcaccagccagccccctgtggtgcagacagtgcacgtggtgcaccagatcccagctgtgtctgtgacctctgtggccggcctggccccagccaacacctacacagtgtctggccaggccgtggtgaccccagctgctgtgctggccccacccaaggccgaggcccaggagaatggagaccaccgggaggtgaaggtgaaggtggagcccatcccagccatcggccacgccaccctgggcacagccagccgcatcatccagacagcccagaccacccctgtgcagacagtgaccatcgtgcagcaggcccccctgggccagcaccagctgcccatcaagacagtgacccagaatggcacccacgtggcctctgtgcccacagctgtgcacggccaggtgaacaatgctgctgccagccccctgcacatgctggccacccacgccagcgccagcgccagcctgcccaccaagaggcacaacggggaccagcctgagcagcctgagctgaagaggatcaagacagaagatggagagggcatcgtcatcgccctgtctgtggacaccccacctgctgctgtgcgggagaagggcgtgcagaactag

SEQ ID NO: 152741 - DNA, 1833 bp, Artificial Sequence
  Description of Artificial Sequence: Synthetic coding sequence
atggctgctgcccggcgggccctgggcgccggcaccccccgggcccggggccggggccgcggggccggcggcggcggcagccggcgggccctgggccgcggggcccctgggggcccccgggtgcgggtgtctgatgaggaggccctgggggaccaccggccccagctggtggccggcctgggcggccgggagcacggccccctggagctgcacctgcctgccccaccccgggacctgcacgcccctggccggcggggccatggaggagctgcccctgagctgcccccagcccagcccaggccagatgctggaggagacttctacctgcgctgcctgggcaagaatggagtgtttgtggatggagtcttccagaggagaggagccccacccctgcagctgccccgggtgtgcaccttccgcttccccagcaccaacatcaagatcaccttcaccgccctgagcagcgagaagcgggagaagcaggaggccagcgagagccctgtgaaggctgtgcagccccacatcagccccctgaccatcaacatcccagacaccatggcccacctgatcagccccctgcccagccccaccggcaccatctctgctgccaacagctgccccagcagccccagaggagctggcagcagcggctacaaggtgggccgggtgatgcccagcgacctgaacctgatggctgacaacagccagccagaaaatgagaaggaggccagcggcggggacagccccaaggatgacagcaagccaccctacagctatgcccagctgattgtgcaggccatcaccatggccccagacaagcagctgaccctgaatggcatctacacccacatcaccaagaactacccctactacagaacagctgacaagggctggcagaacagcatccgccacaacctgagcctgaaccgctacttcatcaaggtgcccaggagccaggaggagcccgggaagggcagcttctggagaattgatcctgccagcgagagcaagctgattgagcaggccttcaggaagaggcggccccggggcgtgccctgcttccgcacccccctgggccccctgagcagccgcagcgccccagccagccccaaccacgccggcgtgctgagcgcccacagcagcggggcccagaccccagagagcctgagccgggagggcagccctgcccccctggagcctgagcccggggccgcccagcccaagctggccgtcatccaggaggccaggtttgcccagagcgcccctggcagccccctgagcagccagcctgtgctgatcaccgtgcagaggcagctgccccaggccatcaagcctgtgacctacacagtggccacccctgtgaccaccagcaccagccagccccctgtggtgcagacagtgcacgtggtgcaccagatcccagctgtgtctgtgacctctgtggccggcctggccccagccaacacctacacagtgtctggccaggccgtggtgaccccagctgctgtgctggccccacccaaggccgaggcccaggagaatggagaccaccgggaggtgaaggtgaaggtggagcccatcccagccatcggccacgccaccctgggcacagccagccgcatcatccagacagcccagaccacccctgtgcagacagtgaccatcgtgcagcaggcccccctgggccagcaccagctgcccatcaagacagtgacccagaatggcacccacgtggcctctgtgcccacagctgtgcacggccaggtgaacaacggccccctgggcctgcggcggcccccctgtgccagcagtgactggagctgcctgtcctag

SEQ ID NO: 152742 - DNA, 1038 bp, Artificial Sequence
  Description of Artificial Sequence: Synthetic coding sequence
atgagccacctgtttgacccccggctgcctgccctggccgccagccccatgctgtacctgtatggccctgagcggcccggcctgcccctggcctttgccccagctgctgccctggccgccagcggccgggcagagaccccccagaagccaccctacagctacatcgccctgattgccatggccatccaggatgcccctgagcagagggtgaccctgaatggcatctaccagttcatcatggaccgcttccccttctaccatgacaaccggcagggctggcagaacagcatccgccacaacctgagcctgaatgactgctttgtgaaggtgccccgggagaagggccggcctgggaagggcagctactggaccctggacccccgctgcctggacatgtttgaaaatggaaactacagaagaaggaagaggaagcccaagccaggccctggggcccctgaggccaagaggcccagggctgagacccaccagaggtctgctgaggcccagcctgaggccggcagcggggccggcggcagcggccctgccatcagccggctgcaggccgccccagctggccccagccccctgctggatggccccagccccccagcccccctgcactggccaggcacagccagccccaatgaagatgctggagatgctgcccagggcgctgctgctgtggccgtgggccaggccgccaggactggagatggccctggcagccccctgcggcctgccagccgcagcagccccaagagcagtgacaagagcaagagcttcagcattgacagcatcctggccggcaagcagggccagaagcccccatctggagatgagctgctgggcggggccaagccaggccctgggggccgcctgggcgccagcctgctggccgccagcagcagcctgcggccccccttcaatgccagcctgatgctggacccccacgtgcagggcggcttctaccagctgggcatccccttcctgagctacttccccctgcaggtgcctgacacagtgctgcacttccagtag

SEQ ID NO: 152743 - DNA, 1131 bp, Artificial Sequence
  Description of Artificial Sequence: Synthetic coding sequence
atgatggccagctacccagagccagaagatgctgctggggccctgctggcccctgagaccggccgcacagtgaaggagcctgagggccccccacccagccctgggaagggcggcggcggcggcggcggcacagcccctgagaagccagaccctgcccagaagccaccctacagctatgtggccctgattgccatggccatccgggagagcgctgagaagaggctgaccctgagcggcatctaccagtacatcatcgccaagttccccttctatgagaagaacaagaagggctggcagaacagcatccgccacaacctgagcctgaatgaatgcttcatcaaggtgccccgggagggcggcggggagaggaagggcaactactggaccctggaccctgcctgtgaggacatgtttgagaagggcaactacagaagaagaagaaggatgaagaggcccttccggcccccaccagcccacttccagcccgggaagggcctgtttggagctggaggagctgctgggggctgcggcgtggccggggccggggctgatggctacggctacctggccccacccaagtacctgcagagcggcttcctgaacaacagctggcccctgccccagccccccagccccatgccctatgccagctgccagatggctgctgctgctgctgctgctgctgctgctgctgctgctgctggccctggcagccctggagctgctgctgtggtgaagggcctggccggccctgctgccagctatggcccctacaccagggtgcagagcatggccctgcccccaggagtggtgaacagctacaacggcctgggcggccccccagctgcccctcctcctccaccccacccccacccccacccccacgcccaccacctgcatgctgctgctgcccctcctccagccccaccccaccacggggctgctgcccctcctcctggccagctgagccctgccagccctgccacagctgcccccccagccccagcccccaccagcgcccctggcctgcagtttgcctgtgcccggcagcctgagctggccatgatgcactgcagctactgggaccatgacagcaagacaggagccctgcacagccggctggacctgtag

SEQ ID NO: 152744 - DNA, 810 bp, Artificial Sequence
  Description of Artificial Sequence: Synthetic coding sequence
atgatggccagctacccagagccagaagatgctgctggggccctgctggcccctgagaccggccgcacagtgaaggagcctgagggccccccacccagccctgggaagggcggcggcggcggcggcggcacagcccctgagaagccagaccctgcccagaagccaccctacagctatgtggccctgattgccatggccatccgggagagcgctgagaagaggctgaccctgagcggcatctaccagtacatcatcgccaagttccccttctatgagaagaacaagaagggctggcagaacagcatccgccacaacctgagcctgaatgaatgcttcatcaaggtgccccgggagggcggcggggagaggaagggcaactactggaccctggaccctgcctgtgaggacatgtttgagaagggcaactacagaagaagaagaaggatgaagaggcccttccggcccccaccagcccacttccagcccgggaagggcctgtttggagctggaggagctgctgggggctgcggcgtggccggggccggggctgatggctacggctacctggccccacccaagtacctgcagagcggcttcctgaacaacagctggcccctgccccagccccccagccccatgccctatgccagctgccagatggctgctgctgctgctgctgctgctgctgctgctgctgctgctggccctggcagcctggcccggcccctgtggagccggggctggagggcccggccccccaggactggaagaactcatgcctgccgggcctggcgctgccccccagcctag

SEQ ID NO: 152745 - DNA, 2406 bp, Artificial Sequence
  Description of Artificial Sequence: Synthetic coding sequence
atgaagaccagcccccggcggcccctcatcctgaagagaagaaggctgcccctgcctgtgcagaatgcccccagcgagaccagcgaggaggagcccaagaggagccctgcccagcaggagagcaaccaggccgaggccagcaaggaggtggccgagagcaacagctgcaagtttcctgctggcatcaagatcatcaaccaccccaccatgcccaacacccaggtggtggccatccccaacaatgccaacatccacagcatcatcacagccctgacagccaagggcaaggagagcggcagcagcggccccaacaagttcatcctgatcagctgtggcggggcccccacccagcccccaggcctgcggccccagacccagaccagctatgatgccaagaggacagaggtgaccctggagaccctgggccccaagccagctgccagagatgtgaacctgcccaggcctcctggggccctgtgtgagcagaagcgggagacctgtgctgatggagaggccgccggctgcaccatcaacaacagcctgagcaacatccagtggctgaggaagatgagcagtgatggcctgggcagccgcagcatcaagcaggagatggaggagaaggagaactgccacctggagcagaggcaggtgaaggtggaggagcccagccggcccagcgcctcctggcagaacagcgtgtctgagaggcctccctacagctacatggccatgatccagtttgccatcaacagcacagagaggaagaggatgaccctgaaggacatctacacctggattgaggaccacttcccctacttcaagcacatcgccaagccaggctggaagaacagcatccgccacaacctgagcctgcatgacatgtttgtgcgggagaccagcgccaacgggaaggtgtccttctggaccatccaccccagcgccaaccgctacctgaccctggaccaggtgttcaagcccctggaccccggcagcccccagctgcctgagcacctggagagccagcagaagaggcccaaccctgagctgcggaggaacatgaccatcaagacagagctgcccctgggcgcccggaggaagatgaagcccctgctgccccgggtgagcagctacctggtgcccatccagtttcctgtgaaccagagcctggtgctgcagcccagcgtgaaggtgcccctgcccctggccgccagcctgatgagcagcgagctggcccggcacagcaagagggtgagaattgcccccaaggtgtttggagagcaggtggtgtttggctacatgagcaagttcttcagcggggacctgcgggactttggcacccccatcaccagcctcttcaacttcatcttcctgtgcctgtctgtgctgctggccgaggagggcatcgcccccctgagcagcgctggccctgggaaggaggagaagctgctgtttggagagggcttcagccccctgctgcctgtgcagaccatcaaggaggaggagatccagcccggggaggagatgccccacctggcccggcccatcaaggtggagagcccccccctggaggagtggcccagccctgcccccagcttcaaggaggagagcagccacagctgggaggacagcagccagagccccaccccccggcccaagaagagctacagcggcctgcggagccccacccgctgtgtgtctgagatgctggtgatccagcaccgggagcggcgggagaggagccgcagcaggaggaagcagcacctgctgcccccctgtgtggatgagcctgagctgctcttcagcgagggccccagcaccagccgctgggccgctgagctgcccttccctgctgacagcagtgaccctgccagccagctgagctacagccaggaggtgggcggccccttcaagacccccatcaaggagaccctgcccatcagcagcacccccagcaagtctgtgctgcccaggaccccagagagctggaggctgaccccaccagccaaggtgggcggcctggacttcagccctgtgcagaccagccagggcgccagtgaccccctgcctgaccccctgggcctgatggacctgagcaccacccccctgcagagcgccccacccctggagagcccccagaggctgctgagcagcgagcccctggacctgatctctgtgccctttggaaacagcagccccagcgacattgatgtgcccaagccaggcagccctgagccccaggtgtctggcctggccgccaacagaagcctgacagagggcctggtgctggacaccatgaatgacagcctgagcaagatcctgctggacatctccttccctggcctggatgaggaccccctgggccctgacaacatcaactggagccagttcatccctgagctgcagtag

SEQ ID NO: 152746 - DNA, 2292 bp, Artificial Sequence
  Description of Artificial Sequence: Synthetic coding sequence
atgaagaccagcccccggcggcccctcatcctgaagagaagaaggctgcccctgcctgtgcagaatgcccccagcgagaccagcgaggaggagcccaagaggagccctgcccagcaggagagcaaccaggccgaggccagcaaggaggtggccgagagcaacagctgcaagtttcctgctggcatcaagatcatcaaccaccccaccatgcccaacacccaggtggtggccatccccaacaatgccaacatccacagcatcatcacagccctgacagccaagggcaaggagagcggcagcagcggccccaacaagttcatcctgatcagctgtggcggggcccccacccagcccccaggcctgcggccccagacccagaccagctatgatgccaagaggacagaggtgaccctggagaccctgggccccaagccagctgccagagatgtgaacctgcccaggcctcctggggccctgtgtgagcagaagcgggagacctgtgctgatggagaggccgccggctgcaccatcaacaacagcctgagcaacatccagtggctgaggaagatgagcagtgatggcctgggcagccgcagcatcaagcaggagatggaggagaaggagaactgccacctggagcagaggcaggtgaaggtggaggagcccagccggcccagcgcctcctggcagaacagcgtgtctgagaggcctccctacagctacatggccatgatccagtttgccatcaacagcacagagaggaagaggatgaccctgaaggacatctacacctggattgaggaccacttcccctacttcaagcacatcgccaagccaggctggaagaacagcatccgccacaacctgagcctgcatgacatgtttgtgcgggagaccagcgccaacgggaaggtgtccttctggaccatccaccccagcgccaaccgctacctgaccctggaccaggtgttcaagcccctggaccccggcagcccccagctgcctgagcacctggagagccagcagaagaggcccaaccctgagctgcggaggaacatgaccatcaagacagagctgcccctgggcgcccggaggaagatgaagcccctgctgccccgggtgagcagctacctggtgcccatccagtttcctgtgaaccagagcctggtgctgcagcccagcgtgaaggtgcccctgcccctggccgccagcctgatgagcagcgagctggcccggcacagcaagagggtgagaattgcccccaaggtgctgctggccgaggagggcatcgcccccctgagcagcgctggccctgggaaggaggagaagctgctgtttggagagggcttcagccccctgctgcctgtgcagaccatcaaggaggaggagatccagcccggggaggagatgccccacctggcccggcccatcaaggtggagagcccccccctggaggagtggcccagccctgcccccagcttcaaggaggagagcagccacagctgggaggacagcagccagagccccaccccccggcccaagaagagctacagcggcctgcggagccccacccgctgtgtgtctgagatgctggtgatccagcaccgggagcggcgggagaggagccgcagcaggaggaagcagcacctgctgcccccctgtgtggatgagcctgagctgctcttcagcgagggccccagcaccagccgctgggccgctgagctgcccttccctgctgacagcagtgaccctgccagccagctgagctacagccaggaggtgggcggccccttcaagacccccatcaaggagaccctgcccatcagcagcacccccagcaagtctgtgctgcccaggaccccagagagctggaggctgaccccaccagccaaggtgggcggcctggacttcagccctgtgcagaccagccagggcgccagtgaccccctgcctgaccccctgggcctgatggacctgagcaccacccccctgcagagcgccccacccctggagagcccccagaggctgctgagcagcgagcccctggacctgatctctgtgccctttggaaacagcagccccagcgacattgatgtgcccaagccaggcagccctgagccccaggtgtctggcctggccgccaacagaagcctgacagagggcctggtgctggacaccatgaatgacagcctgagcaagatcctgctggacatctccttccctggcctggatgaggaccccctgggccctgacaacatcaactggagccagttcatccctgagctgcagtag

SEQ ID NO: 152747 - DNA, 2247 bp, Artificial Sequence
  Description of Artificial Sequence: Synthetic coding sequence
atgaagaccagcccccggcggcccctcatcctgaagagaagaaggctgcccctgcctgtgcagaatgcccccagcgagaccagcgaggaggagcccaagaggagccctgcccagcaggagagcaaccaggccgaggccagcaaggaggtggccgagagcaacagctgcaagtttcctgctggcatcaagatcatcaaccaccccaccatgcccaacacccaggtggtggccatccccaacaatgccaacatccacagcatcatcacagccctgacagccaagggcaaggagagcggcagcagcggccccaacaagttcatcctgatcagctgtggcggggcccccacccagcccccaggcctgcggccccagacccagaccagctatgatgccaagaggacagaggtgaccctggagaccctgggccccaagccagctgccagagatgtgaacctgcccaggcctcctggggccctgtgtgagcagaagcgggagacctgtgctgatggagaggccgccggctgcaccatcaacaacagcctgagcaacatccagtggctgaggaagatgagcagtgatggcctgggcagccgcagcatcaagcaggagatggaggagaaggagaactgccacctggagcagaggcaggtgaaggtggaggagcccagccggcccagcgcctcctggcagaacagcgtgtctgagaggcctccctacagctacatggccatgatccagtttgccatcaacagcacagagaggaagaggatgaccctgaaggacatctacacctggattgaggaccacttcccctacttcaagcacatcgccaagccaggctggaagaacagcatccgccacaacctgagcctgcatgacatgtttgtgcgggagaccagcgccaacgggaaggtgtccttctggaccatccaccccagcgccaaccgctacctgaccctggaccaggtgttcaagcagcagaagaggcccaaccctgagctgcggaggaacatgaccatcaagacagagctgcccctgggcgcccggaggaagatgaagcccctgctgccccgggtgtcctcctacctggtgcccatccagtttcctgtgaaccagagcctggtgctgcagcccagcgtgaaggtgcccctgcccctggccgccagcctgatgagcagcgagctggcccggcacagcaagagggtgcgcatcgcccccaaggtgctgctggccgaggagggcatcgcccccctgagcagcgctggccctgggaaggaggagaagctgctgtttggagagggcttcagccccctgctgcctgtgcagaccatcaaggaggaggagatccagcctggagaggagatgccccacctggcccggcccatcaaggtggagagcccccccctggaggagtggcccagccctgcccccagcttcaaggaggagagcagccacagctgggaggacagcagccagagccccaccccccggcccaagaagagctacagcggcctgcggagccccacccgctgtgtgtctgagatgctggtgatccagcaccgggagcggcgggagaggagccgcagcaggaggaagcagcacctgctgcccccctgtgtggatgagcctgagctgctcttcagcgagggccccagcaccagccgctgggccgctgagctgcccttccctgctgacagcagtgaccctgccagccagctgagctacagccaggaggtgggcggccccttcaagacccccatcaaggagaccctgcccatcagcagcacccccagcaagtctgtgctgcccaggaccccagagagctggaggctgaccccaccagccaaggtgggcggcctggacttcagccctgtgcagaccagccagggcgccagtgaccccctgcctgaccccctgggcctgatggacctgagcaccacccccctgcagagcgccccacccctggagagcccccagaggctgctgagcagcgagcccctggacctgatctctgtgcccttcggcaacagcagccccagcgacattgatgtgcccaagccaggcagccctgagccccaggtgtctggcctggccgccaacagaagcctgacagagggcctggtgctggacaccatgaatgacagcctgagcaagatcctgctggacatctccttccctggcctggatgaggaccccctgggccctgacaacatcaactggagccagttcatccctgagctgcagtag

SEQ ID NO: 152748 - DNA, 531 bp, Artificial Sequence
  Description of Artificial Sequence: Synthetic coding sequence
atgggcgccccagccacccggcgctgtgtggagtggctgctgggcctgtacttcctgagccacatccccatcaccctcttcatggacctgcaggccgtgctgccccgggagctgtaccctgtggagttcaggaacctgctgaagtggtacgccaaggagttcaaggaccccctgctgcaggagcccccagcctggttcaagagcttcctgttctgtgagctggtgttccagctgcccttcttccccatcgccacctacgccttcctgaagggcagctgcaagtggatccgcaccccagccatcatctacagcgtgcacaccatgaccaccctcatccccatcctgagcaccttcctgtttgaggacttcagcaaggccagcggcttcaagggccagaggcctgagaccctgcacgagcggctgaccctggtgtctgtgtatgccccctacctgctgatccccttcatcctgctgatcttcatgctgcggagcccctactacaagtatgaggagaagaggaagaagaagtag

SEQ ID NO: 152749 - DNA, 1473 bp, Artificial Sequence
  Description of Artificial Sequence: Synthetic coding sequence
atgggccctgtgatgccacccagcaagaagccagagagcagcggcatctctgtgagcagcggcctgagccagtgctacggcggcagcggcttcagcaaggccctgcaggaggatgatgacctggacttcagcctgcctgacatccggctggaggagggcgccatggaggatgaggagctgaccaacctgaactggctgcacgagagcaagaacctgctgaagagctttggagagagcgtgctgcggtctgtgtcccctgtgcaggacctggatgatgacaccccacccagccctgcccacagcgacatgccctatgatgcccggcagaaccccaactgcaagccaccctacagcttcagctgcctgatcttcatggccatcgaggacagccccaccaagaggctgcctgtgaaggacatctacaactggatcctggagcacttcccctactttgccaatgcccccaccggctggaagaacagcgtgcgccacaacctgagcctgaacaagtgcttcaagaaggtggacaaggagaggagccagagcatcggcaagggcagcctgtggtgcattgatcctgagtaccggcagaacctgatccaggccctgaagaagaccccctaccacccccacccccacgtgttcaacaccccacccacctgcccccaggcctaccagagcaccagcggcccccccatctggccaggcagcaccttcttcaagagaaatggagccctgctgcaggaccctgacattgatgctgccagcgccatgatgctgctgaacaccccacctgagatccaggccggcttccccccaggagtcatccagaatggagcccgggtgctgagccggggcctcttccctggggtgcggcccctgcccatcacccccatcggcgtgacagctgccatgagaaatggcatcaccagctgcaggatgaggacagagagcgagcccagctgtggcagccctgtggtgtctggggaccccaaggaggaccacaactacagcagcgccaagagcagcaatgcccggagcaccagccccaccagtgacagcatcagcagcagcagcagcagcgcagatgaccactatgaatttgccaccaagggcagccaggagggcagcgagggcagcgagggcagcttccgcagccatgagagccccagcgacacagaagaagatgacaggaagcacagccagaaggagcccaaggacagcctgggggacagcggctacgccagccagcacaagaagaggcagcactttgccaaggccaggaaggtgcccagcgacaccctgcccctgaagaagagaagaacagagaagcccccagagagtgatgatgaggagatgaaggaggccgccggcagcctgctgcacctggccggcatccgcagctgcctgaacaacatcaccaacagaacagccaagggccagaaggagcagaaggagaccaccaagaactag

SEQ ID NO: 152750 - DNA, 1473 bp, Artificial Sequence; identical to SEQ ID NO: 152749
  Description of Artificial Sequence: Synthetic coding sequence

SEQ ID NO: 152751 - DNA, 165 bp, Artificial Sequence
  Description of Artificial Sequence: Synthetic coding sequence
atgggccctgtgatgccacccagcaagaagccagagagcagcggcatctctgtgagcagcggcctgagccagtgctacggcggcagcggcttcagcaaggccctgcaggaggatgatgacctggacttcagcctgcctgacatccggctggaggagggcgcctag

SEQ ID NO: 152752 - DNA, 282 bp, Artificial Sequence
  Description of Artificial Sequence: Synthetic coding sequence
atgggccctgtgatgccacccagcaagaagccagagagcagcggcatctctgtgagcagcggcctgagccagtgctacggcggcagcggcttcagcaaggccctgcaggaggatgatgacctggacttcagcctgcctgacatccggctggaggagggcgccatggaggatgaggagctgaccaacctgaactggctgcacgagagcaagaacctgctgaagagctttggagagagcgtgctgcggtctgtgtcccctgtgcaggacctggatgatgactag

SEQ ID NO: 152753 - DNA, 1407 bp, Artificial Sequence
  Description of Artificial Sequence: Synthetic coding sequence
atgggccctgtgatgccacccagcaagaagccagagagcagcggcatctctgtgagcagcggcctgagccagtgctacggcggcagcggcttcagcaaggccctgcaggaggatgatgacctggacttcagcctgcctgacatccggctggaggagggcgccatggaggatgaggagctgaccaacctgaactggctgcacgagagcaagaacctgctgaagagctttggagagagcgtgctgcggtctgtgtcccctgtgcaggacctggatgatgacaccccacccagccctgcccacagcgacatgccctatgatgcccggcagaaccccaactgcaagccaccctacagcttcagctgcctgatcttcatggccatcgaggacagccccaccaagaggctgcctgtgaaggacatctacaactggatcctggagcacttcccctactttgccaatgcccccaccggctggaagaacagcgtgcgccacaacctgagcctgaacaagtgcttcaagaaggtggacaaggagaggagccagagcatcggcaagggcagcctgtggtgcattgatcctgagtaccggcagaacctgatccaggccctgaagaagaccccctaccacccccacccccacgtgttcaacaccccacccacctgcccccaggcctaccagagcaccagcggcccccccatctggccaggcagcaccttcttcaagagaaatggagccctgctgcaggtgcccccaggagtcatccagaatggagcccgggtgctgagccggggcctcttccctggggtgcggcccctgcccatcacccccatcggcgtgacagctgccatgagaaatggcatcaccagctgcaggatgaggacagagagcgagcccagctgtggcagccctgtggtgtctggggaccccaaggaggaccacaactacagcagcgccaagagcagcaatgcccggagcaccagccccaccagtgacagcatcagcagcagcagcagcagcgcagatgaccactatgaatttgccaccaagggcagccaggagggcagcgagggcagcgagggcagcttccgcagccatgagagccccagcgacacagaagaagatgacaggaagcacagccagaaggagcccaaggacagcctgggggacagcggctacgccagccagcacaagaagaggcagcactttgccaaggccaggaaggtgcccagcgacaccctgcccctgaagaagagaagaacagagaagcccccagagagtgatgatgaggagatgaaggaggccgccggcagcctgctgcacctggccggcatccgcagctgcctgaacaacatcaccaacagaacagccaagggccagaaggagcagaaggagaccaccaagaactag

SEQ ID NO: 152754 - DNA, 627 bp, Artificial Sequence
  Description of Artificial Sequence: Synthetic coding sequence
atgggccctgtgatgccacccagcaagaagccagagagcagcggcatctctgtgagcagcggcctgagccagtgctacggcggcagcggcttcagcaaggccctgcaggaggatgatgacctggacttcagcctgcctgacatccggctggaggagggcgccatggaggatgaggagctgaccaacctgaactggctgcacgagagcaagaacctgctgaagagctttggagagagcgtgctgcggtctgtgtcccctgtgcaggacctggatgatgacaccccacccagccctgcccacagcgacatgccctatgatgcccggcagaaccccaactgcaagccaccctacagcttcagctgcctgatcttcatggccatcgaggacagccccaccaagaggctgcctgtgaaggacatctacaactggatcctggagcacttcccctactttgccaatgcccccaccggctggaagaacagcgtgcgccacaacctgagcctgaacaagtgcttcaagaaggtggacaaggagaggagccagagcatcggcaagggcagcctgtggtgcattgatcctgagtaccggcagaacctgatccaggccctgaagaagaccccctactag

SEQ ID NO: 152755 - DNA, 1407 bp, Artificial Sequence; identical to SEQ ID NO: 152753
  Description of Artificial Sequence: Synthetic coding sequence

SEQ ID NO: 152756 - DNA, 777 bp, Artificial Sequence
  Description of Artificial Sequence: Synthetic coding sequence
atgattgaaagtgacaccagcagcatcatgagcggcatcatcagaaattctggccagaaccaccaccccagcccccaggagtaccgcctgctggccaccaccagtgatgatgacctgcccggggacctgcagagcctgtcctggctgacagctgtggatgtgccccggctgcagcagatggccagcggccgggtggacctgggcggcccctgtgtgccccacccccaccctggggccctggccggcgtggccgacctgcacgtgggcgccacccccagccccctgctgcacggccctgctggcatggccccccggggcatgcctggcctgggccccatcaccggccaccgggacagccagatgagccagtttcctgtgggcggccagcccagcagcggcctgcaggaccccccccacctgtacagccctgccacccagccccagttccccctgcccccaggggcccagcagctgagtgacagacatggccctgaggagcagcaggaccggcagcctgcctgtgagcgggacctgcagctgcatgaaggagccctgcccctgctgcaggacggccccaggagagtggaggagctgggcgccgcccagcctgtgtctgagcaggtgctgcgggagggcggggagcaggatgagcggctgctgccccagggcctgcctgtgggcagcgagcccggcccccaccggcaggacggcggcggagatgcccaggtggaggaggagggccctggctgccaccccccagaatatggccagccctag

SEQ ID NO: 152757 - DNA, 1554 bp, Artificial Sequence
  Description of Artificial Sequence: Synthetic coding sequence
atgattgaaagtgacaccagcagcatcatgagcggcatcatcagaaattctggccagaaccaccaccccagcccccaggagtaccgcctgctggccaccaccagtgatgatgacctgcccggggacctgcagagcctgtcctggctgacagctgtggatgtgccccggctgcagcagatggccagcggccgggtggacctgggcggcccctgtgtgccccacccccaccctggggccctggccggcgtggccgacctgcacgtgggcgccacccccagccccctgctgcacggccctgctggcatggccccccggggcatgcctggcctgggccccatcaccggccaccgggacagcatgagccagtttcctgtgggcggccagcccagcagcggcctgcaggaccccccccacctgtacagccctgccacccagccccagttccccctgcccccaggggcccagcagtgcccccctgtgggcctgtatggccccccatttggagtgcggcccccctacccccagccccacgtggccgtgcacagcagccaggagctgcaccccaagcactaccccaagcccatctacagctacagctgcctgattgccatggccctgaagaacagcaagacaggcagcctgcctgtgtctgagatctacagcttcatgaaggagcacttcccctacttcaagacagccccagatggctggaagaacagcgtgcgccacaacctgagcctgaacaagtgctttgagaaggtggagaacaagatgagcggcagcagcaggaagggctgcctgtgggccctgaacctggccagaattgacaagatggaggaggagatgcacaagtggaagaggaaggacctggccgccatccaccgctccatggccaaccctgaggagctggacaagctgatcagtgacaggcctgagagctgcagaagacctgggaagccaggagagcctgaggcccctgtgctgacccacgccaccaccgtggccgtggcccacggctgcctggccgtgtcccagctgcccccccagcccctgatgaccctgagcctgcagagcgtgcccctgcaccaccaggtgcagccccaggcccacctggccccagacagccctgccccagcccagaccccacccctgcacgccctgcctgacctgagccccagccccctgccccacccagccatgggccgggcccctgtggacttcatcaacatcagcacagacatgaacacagaggtggatgccctggaccccagcatcatggactttgccctgcagggcaacctgtgggaggagatgaaggatgagggcttcagcctggacaccctgggcgcctttgctgacagccccctgggctgtgacctgggcgccagcggcctgaccccagccagcggcggcagtgaccagagcttcccagacctgcaggtgacaggcctgtacacagcctacagcaccccagattctgtggccgccagcggcaccagcagcagcagccagtacctgggcgcccagggcaacaagcccatcgccctgctgtag

SEQ ID NO: 152758 - DNA, 1014 bp, Artificial Sequence
  Description of Artificial Sequence: Synthetic coding sequence
atgcctggcctgccctgcccagccctgccctgcccagcccctcctccagcccccagctgcctgattgccatggccctgaagaacagcaagacaggcagcctgcctgtgtctgagatctacagcttcatgaaggagcacttcccctacttcaagacagccccagatggctggaagaacagcgtgcgccacaacctgagcctgaacaagtgctttgagaaggtggagaacaagatgagcggcagcagcaggaagggctgcctgtgggccctgaacctggccagaattgacaagatggaggaggagatgcacaagtggaagaggaaggacctggccgccatccaccgctccatggccaaccctgaggagctggacaagctgatcagtgacaggcctgagagctgcagaagacctgggaagccaggagagcctgaggcccctgtgctgacccacgccaccaccgtggccgtggcccacggctgcctggccgtgtcccagctgcccccccagcccctgatgaccctgagcctgcagagcgtgcccctgcaccaccaggtgcagccccaggcccacctggccccagacagccctgccccagcccagaccccacccctgcacgccctgcctgacctgagccccagccccctgccccacccagccatgggccgggcccctgtggacttcatcaacatcagcacagacatgaacacagaggtggatgccctggaccccagcatcatggactttgccctgcagggcaacctgtgggaggagatgaaggatgagggcttcagcctggacaccctgggcgcctttgctgacagccccctgggctgtgacctgggcgccagcggcctgaccccagccagcggcggcagtgaccagagcttcccagacctgcaggtgacaggcctgtacacagcctacagcaccccagattctgtggccgccagcggcaccagcagcagcagccagtacctgggcgcccagggcaacaagcccatcgccctgctgtag

SEQ ID NO: 152759 - DNA, 1680 bp, Artificial Sequence
  Description of Artificial Sequence: Synthetic coding sequence
atggccgccaagctgcgggcccaccaggtggatgtggaccctgactttgccccccagagccggcccaggagctgcacctggcccctgccccagcctgacctggccggagatgaagatggagccctgggcgctggggtggccgagggcgctgaggactgtggccctgagcggcgggccacagccccagccatggccccagccccacccctgggcgctgaggtgggccccctgaggaaggccaagagcagcagaagaaatgcctggggcaacctgtcctatgctgacctgatcaccaaggccattgaaagtgccccagacaagaggctgaccctgagccagatctatgactggatggtgcgctacgtgccctacttcaaggacaagggggacagcaacagcagcgctggctggaagaacagcatccgccacaacctgagcctgcacacccgcttcatccgggtgcagaatgaaggaacaggcaagagctcctggtggatgctgaaccctgagggcggcaagacaggcaagaccccaagaagaagagctgtgtccatggacaatggagccaagttcctgcgcatcaagggcaaggccagcaagaagaagcagctgcaggcccctgagaggagcccagatgacagcagccccagcgccccagcccctggccctgtgcctgctgctgccaagtgggccgccagccctgccagccacgccagtgatgattatgaggcctgggccgacttccggggcggcggccggcccctgctgggggaggccgctgagctggaggatgatgaggccctggaggccctggcccccagcagccccctgatgtaccccagccctgccagcgccctgagccctgccctgggcagccgctgccctggagagctgccccggctggccgagctgggcggccccctgggcctgcatggaggcggcggggccggcctgcctgagggcctgctggatggagcccaggatgcctacggcccccgggcccgggcccaggcccggcctggggccggctgtgccggcggggccggggccggcggccgcagccggcggctgccccggcagaggggcggccctgtgcgggccgcccgggccctggcccagtgcctgagccccccccaccagccctatgatgctgcccggcggggcggccggcggggccctggaacagctggcccccggcggcggctgcggggccctgcccggcggcccccagctggccgctctgctggggccctgcgctgcagaagaagaagagctgctggccggcgggcccggcccctgcccggccggcccggccccaggcatgtgcagcgggagccccgggtgagaagaggagtgcaccacccccagaggctgcacggccagaggagaaatggcctgcagctgcgcttcggccctgccagcgctgctgctggccctggccggggccctgccccccagcctgagctgggcgccggcctgcgggccgccagccggctgcgggcccccaggcctgtgccccggggccccctgagcagccacccagacagccgggtgcctgccccagacagcagcagccctgggggcggccccagccctgcccgggaccccagccggcggcctgctgctggggagggggagggcggggccggggccccccactgcagctgcccccacagctag

SEQ ID NO: 152760 - DNA, 2034 bp, Artificial Sequence
  Description of Artificial Sequence: Synthetic coding sequence
atgatgcaggagagcggcacagagaccaagagcaatggcagcgccatccagaatggcagcggcggcagcaaccacctgctggagtgtggcggcctgcgggagggccgcagcaatggagagaccccagctgtggacatcggggctgctgacctggcccacgcccagcagcagcagcagcaggccctgcaggtggcccggcagctgctgctgcagcagcagcagcagcagcaggtgtctggcctgaagagccccaagagaaatgacaagcagcctgccctgcaggtgcctgtgtctgtggccatgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgatccccacagagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgaagcacctgaacagcgagcacgccctggatgacaggagcacagcccagtgccgggtgcagatgcaggtggtgcagcagctggagctgcagctggccaaggacaaggagcggctgcaggccatgatgacccacctgcacgtgaagagcacagagcccaaggccgccccccagcccctgaacctggtgtcctctgtgaccctgagcaagagcgccagcgaggccagcccccagagcctgccccacacccccaccacccccacagcccccctgacccctgtgacccagggccccagcgtcatcaccaccacctccatgcacacagtgggccccatcagaagacgctacagcgacaagtacaacgtgcccatcagcagcgctgacatcgcccagaaccaggagttctacaagaatgctgaggtgcggccccccttcacctacgccagcctcatccggcaggccatcctggagagccctgagaagcagctgaccctgaatgagatctacaactggttcaccaggatgtttgcctacttcagaagaaatgctgccacctggaagaatgctgtgcgccacaacctgagcctgcacaagtgctttgtgcgggtggagaatgtgaagggagctgtgtggacagtggatgaggtggagttccagaagaggcggccccagaagatcagcggcaaccccagcctcatcaagaacatgcagagcagccacgcctactgcacccccctgaatgctgccctgcaggcctccatggctgaaaattccatccccctgtacaccacagcctccatgggcaaccccaccctgggcaacctggccagcgccatccgggaggagctgaatggagccatggagcacaccaacagcaatgaaagtgacagcagccctggccgcagccccatgcaggccgtgcaccctgtgcacgtgaaggaggagcccctggaccctgaggaggccgagggccccctgagcctggtgaccacagccaaccacagcccagactttgaccatgaccgggactatgaagatgagcctgtgaatgaagacatggagtag

SEQ ID NO: 152761 - DNA, 1077 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgatccccacagagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgaagcacctgaacagcgagcacgccctggatgacaggagcacagcccagtgccgggtgcagatgcaggtggtgcagcagctggagctgcagctggccaaggacaaggagcggctgcaggccatgatgacccacctgcacgtgaagagcacagagcccaaggccgccccccagcccctgaacctggtgtcctctgtgaccctgagcaagagcgccagcgaggccagcccccagagcctgccccacacccccaccacccccaccccaccagacagccgccacccccggcccctgtgccaccacaaccaccagcacgcccacggcggcacccacccccaggccgtgctgcggcagatccagagggcccactttgtgagccgctactgtgccgagccccgcatcctgtag

SEQ ID NO: 152762 - DNA, 1509 bp, Artificial Sequence
  Description of Artificial Sequence: Synthetic coding sequence
atgatgcaggagagcggcacagagaccaagagcaatggcagcgccatccagaatggcagcggcggcagcaaccacctgctggagtgtggcggcctgcgggagggccgcagcaatggagagaccccagctgtggacatcggggctgctgacctggcccacgcccagcagcagcagcagcaggccctgcaggtggcccggcagctgctgctgcagcagcagcagcagcagcaggtgtctggcctgaagagccccaagagaaatgacaagcagcctgccctgcaggtgcctgtgtctgtggccatgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgatccccacagagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgaagcacctgaacagcgagcacgccctggatgacaggagcacagcccagtgccgggtgcagatgcaggtggtgcagcagctggagctgcagctggccaaggacaaggagcggctgcaggccatgatgacccacctgcacgtgaagagcacagagcccaaggccgccccccagcccctgaacctggtgtcctctgtgaccctgagcaagagcgccagcgaggccagcccccagagcctgccccacacccccaccacccccacagcccccctgacccctgtgacccagggccccagcgtcatcaccaccacctccatgcacacagtgggccccatcagaagacgctacagcgacaagtacaacgtgcccatcagcagcgctgacatcgcccagaaccaggagttctacaagaatgctgaggtgcggccccccttcacctacgccagcctcatccggcaggccatcctggagagccctgagaagaagaagaaggagcggcagaccctgggcaccatgcccatccacagcacccagcagtag

SEQ ID NO: 152763 - DNA, 1470 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgaagcacctgaacagcgagcacgccctggatgacaggagcacagcccagtgccgggtgcagatgcaggtggtgcagcagctggagctgcagctggccaaggacaaggagcggctgcaggccatgatgacccacctgcacgtgaagagcacagagcccaaggccgccccccagcccctgaacctggtgtcctctgtgaccctgagcaagagcgccagcgaggccagcccccagagcctgccccacacccccaccacccccacagcccccctgacccctgtgacccagggccccagcgtcatcaccaccacctccatgcacacagtgggccccatcagaagacgctacagcgacaagtacaacgtgcccatcagcagcgctgacatcgcccagaaccaggagttctacaagaatgctgaggtgcggccccccttcacctacgccagcctcatccggcaggccatcctggagagccctgagaagcagctgaccctgaatgagatctacaactggttcaccaggatgtttgcctacttcagaagaaatgctgccacctggaagaatgctgtgcgccacaacctgagcctgcacaagtgctttgtgcgggtggagaatgtgaagggagctgtgtggacagtggatgaggtggagttccagaagaggcggccccagaagatcagcggcaaccccagcctcatcaagaacatgcagagcagccacgcctactgcacccccctgaatgctgccctgcaggcctccatggctgaaaattccatccccctgtacaccacagcctccatgggcaaccccaccctgggcaacctggccagcgccatccgggaggagctgaatggagccatggagcacaccaacagcaatgaaagtgacagcagccctggccgcagccccatgcaggccgtgcaccctgtgcacgtgaaggaggagcccctggaccctgaggaggccgagggccccctgagcctggtgaccacagccaaccacagcccagactttgaccatgaccgggactatgaagatgagcctgtgaatgaagacatggagtag

SEQ ID NO: 152764 - DNA, 2034 bp, Artificial Sequence; identical to SEQ ID NO: 152760
  Description of Artificial Sequence: Synthetic coding sequence

SEQ ID NO: 152765 - DNA, 1806 bp, Artificial Sequence
  Description of Artificial Sequence: Synthetic coding sequence
atgatgcaggagagcggcacagagaccaagagcaatggcagcgccatccagaatggcagcggcggcagcaaccacctgctggagtgtggcggcctgcgggagggccgcagcaatggagagaccccagctgtggacatcggggctgctgacctggcccacgcccagcagcagcagcagcaggccctgcaggtggcccggcagctgctgctgcagcagcagcagcagcagcaggtgtctggcctgaagagccccaagagaaatgacaagcagcctgccctgcagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgatccccacagagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgaagcacctgaacagcgagcacgccctggatgacaggagcacagcccagtgccgggtgcagatgcaggtggtgcagcagctggagctgcagctggccaaggacaaggagcggctgcaggccatgatgacccacctgcacgtgaagagcacagagcccaaggccgccccccagcccctgaacctggtgtcctctgtgaccctgagcaagagcgccagcgaggccagcccccagagcctgccccacacccccaccacccccacagcccccctgacccctgtgacccagggccccagcgtcatcaccaccacctccatgcacacagtgggccccatcagaagacgctacagcgacaagtacaacgtgcccatcagcagcgctgacatcgcccagaaccaggagttctacaagaatgctgaggtgcggccccccttcacctacgccagcctcatccggcaggccatcctggagagccctgagaagcagctgaccctgaatgagatctacaactggttcaccaggatgtttgcctacttcagaagaaatgctgccacctggaagaatgctgtgcgccacaacctgagcctgcacaagtgctttgtgcgggtggagaatgtgaagggagctgtgtggacagtggatgaggtggagttccagaagaggcggccccagaagatcagcggcaaccccagcctcatcaagaacatgcagagcagccacgcctactgcacccccctgaatgctgccctgcaggcctccatggctgaaaattccatccccctgtacaccacagcctccatgggcaaccccaccctgggcaacctggccagcgccatccgggaggagctgaatggagccatggagcacaccaacagcaatgaaagtgacagcagccctggccgcagccccatgcaggccgtgcaccctgtgcacgtgaaggaggagcccctggaccctgaggaggccgagggccccctgagcctggtgaccacagccaaccacagcccagactttgaccatgaccgggactatgaagatgagcctgtgaatgaagacatggagtag

SEQ ID NO: 152766 - DNA, 675 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgatccccacagagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgtag

SEQ ID NO: 152767 - DNA, 2040 bp, Artificial Sequence
  Description of Artificial Sequence: Synthetic coding sequence
atgttccagtgtgtgttcagcagctctgtgctgcagccccacagcaccagctgcctcttcaagcacctgttctaccacagcgccaccccagccagccagaagcagcctgagcccatctacagcaagaagacagagatccagaggcagacagtgcgggccccctttgccaagctgttcatcttcagcgccctgcaggtggcccggcagctgctgctgcagcagcagcagcagcagcaggtgtctggcctgaagagccccaagagaaatgacaagcagcctgccctgcaggtgcctgtgtctgtggccatgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgatccccacagagctgcagcagctgtggaaggaggtgaccagcgcccacacagctgaggagaccactggaaacaaccacagcagcctggacctgaccaccacctgtgtgagcagcagcgcccccagcaagaccagcctcatcatgaacccccacgccagcaccaacggccagctgtctgtgcacacccccaagcgggagagcctgagccatgaggagcacccccacagccaccccctgtatggccatggagtgtgcaagtggccaggctgtgaggccgtgtgtgaggacttccagagcttcctgaagcacctgaacagcgagcacgccctggatgacaggagcacagcccagtgccgggtgcagatgcaggtggtgcagcagctggagctgcagctggccaaggacaaggagcggctgcaggccatgatgacccacctgcacgtgaagagcacagagcccaaggccgccccccagcccctgaacctggtgtcctctgtgaccctgagcaagagcgccagcgaggccagcccccagagcctgccccacacccccaccacccccacagcccccctgacccctgtgacccagggccccagcgtcatcaccaccacctccatgcacacagtgggccccatcagaagacgctacagcgacaagtacaacgtgcccatcagcagcgctgacatcgcccagaaccaggagttctacaagaatgctgaggtgcggccccccttcacctacgccagcctcatccggcaggccatcctggagagccctgagaagcagctgaccctgaatgagatctacaactggttcaccaggatgtttgcctacttcagaagaaatgctgccacctggaagaatgctgtgcgccacaacctgagcctgcacaagtgctttgtgcgggtggagaatgtgaagggagctgtgtggacagtggatgaggtggagttccagaagaggcggccccagaagatcagcggcaaccccagcctcatcaagaacatgcagagcagccacgcctactgcacccccctgaatgctgccctgcaggcctccatggctgaaaattccatccccctgtacaccacagcctccatgggcaaccccaccctgggcaacctggccagcgccatccgggaggagctgaatggagccatggagcacaccaacagcaatgaaagtgacagcagccctggccgcagccccatgcaggccgtgcaccctgtgcacgtgaaggaggagcccctggaccctgaggaggccgagggccccctgagcctggtgaccacagccaaccacagcccagactttgaccatgaccgggactatgaagatgagcctgtgaatgaagacatggagtag

SEQ ID NO: 152768 - DNA, 372 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagaggcagggcctgctgaccatccagcccggccagcctgccctgcccctgcagcccctggcccagggcatgtag

SEQ ID NO: 152769 - DNA, 2034 bp, Artificial Sequence; identical to SEQ ID NO: 152760
  Description of Artificial Sequence: Synthetic coding sequence

SEQ ID NO: 152770 - DNA, 345 bp, Artificial Sequence
  Description of Artificial Sequence: Synthetic coding sequence
atgatgcaggagagcggcacagagaccaagagcaatggcagcgccatccagaatggcagcggcggcagcaaccacctgctggagtgtggcggcctgcgggagggccgcagcaatggagagaccccagctgtggacatcggggctgctgacctggcccacgcccagcagcagcagcagcagtggcacctgatcaaccaccagcccagccgcagccccagctcctggctgaagaggctcatcagcagcccctgggagctggaggtgctgcaggtgcccctgtggggcgctgtggccgagaccaagatgagcggccctgtgtgccagcccaaccccagccccttctag

SEQ ID NO: 152771 - DNA, 669 bp, Artificial Sequence
  Description of Artificial Sequence: Synthetic coding sequence
atgatgcaggagagcgccacagagaccatcagcaacagctccatgaaccagaatggcatgagcaccctgagcagccagctggatgctggcagcagagatggccgcagcagcggggacaccagcagcgaggtgtccacagtggagctgctgcacctgcagcagcagcaggccctgcaggccgcccggcagctgctgctgcagcagcagaccagcggcctgaagagccccaagagcagtgacaagcagaggcccctgcaggtgcctgtgtctgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgtag

SEQ ID NO: 152772 - DNA, 2148 bp, Artificial Sequence
  Description of Artificial Sequence: Synthetic coding sequence
atgatgcaggagagcgccacagagaccatcagcaacagctccatgaaccagaatggcatgagcaccctgagcagccagctggatgctggcagcagagatggccgcagcagcggggacaccagcagcgaggtgtccacagtggagctgctgcacctgcagcagcagcaggccctgcaggccgcccggcagctgctgctgcagcagcagaccagcggcctgaagagccccaagagcagtgacaagcagaggcccctgcaggtgcctgtgtctgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcacggcggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagaccggggccagccacaccctgtatggccatggagtgtgcaagtggccaggctgtgagagcatctgtgaggactttggccagttcctgaagcacctgaacaatgaacatgccctggatgacaggagcacagcccagtgccgggtgcagatgcaggtggtgcagcagctggagatccagctgagcaaggagcgggagcggctgcaggccatgatgacccacctgcacatgaggcccagcgagcccaagcccagccccaagcccctgaacctggtgtcctctgtgaccatgagcaagaacatgctggagaccagcccccagagcctgccccagacccccaccacccccacagcccctgtgacccccatcacccagggccccagcgtcatcaccccagcctctgtgcccaacgtgggcgccatcagaagaagacacagcgacaagtacaacatccccatgagcagcgagatcgcccccaactatgagttctacaagaatgctgatgtgcggccccccttcacctacgccaccctcatccggcaggccatcatggagagcagtgaccggcagctgaccctgaatgagatctacagctggttcaccaggacctttgcctacttcagaagaaatgctgccacctggaagaatgctgtgcgccacaacctgagcctgcacaagtgctttgtgcgggtggagaatgtgaagggagctgtgtggacagtggatgaggtggagtaccagaagagaagaagccagaagatcaccggcagccccaccctggtgaagaacatccccaccagcctgggctacggggccgccctgaatgccagcctgcaggccgccctggccgagagcagcctgcccctgctgagcaaccctggcctcatcaacaatgccagcagcggcctgctgcaggccgtgcatgaggacctgaatggcagcctggaccacatcgacagcaatggaaacagcagccctggctgcagcccccagccccacatccacagcatccacgtgaaggaggagcctgtgattgctgaagatgaggactgccccatgagcctggtgaccacagccaaccacagccctgagctggaggatgaccgggagattgaggaggagcccctgtctgaggacctggagtag

SEQ ID NO: 152773 - DNA, 1299 bp, Artificial Sequence
  Description of Artificial Sequence: Synthetic coding sequence
atgatgcaggagagcgccacagagaccatcagcaacagctccatgaaccagaatggcatgagcaccctgagcagccagctggatgctggcagcagagatggccgcagcagcggggacaccagcagcgaggtgtccacagtggagctgctgcacctgcagcagcagcaggccctgcaggccgcccggcagctgctgctgcagcagcagaccagcggcctgaagagccccaagagcagtgacaagcagaggcccctgcaggtgcctgtgtctgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcacggcggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagaccggggccagccacaccctgtatggccatggagtgtgcaagtggccaggctgtgagagcatctgtgaggactttggccagttcctgaagcacctgaacaatgaacatgccctggatgacaggagcacagcccagtgccgggtgcagatgcaggtggtgcagcagctggagatccagctgagcaaggagcgggagcggctgcaggccatgatgacccacctgcacatgaggcccagcgagcccaagcccagccccaagcctgtgtctgcctactgcttcatcaacagcaagtag

SEQ ID NO: 152774 - DNA, 1371 bp, Artificial Sequence
  Description of Artificial Sequence: Synthetic coding sequence
atgcaggagagcgccacagagaccatcagcaacagctccatgaaccagaatggcatgagcaccctgagcagccagctggatgctggcagcagagatggccgcagcagcggggacaccagcagcgaggtgtccacagtggagctgctgcacctgcagcagcagcaggccctgcaggccgcccggcagctgctgctgcagcagcagaccagcggcctgaagagccccaagagcagtgacaagcagaggcccctgcaggagctgctgcctgagaccaagctgtgcatctgtggccacagcagtggagatggccacccccacaacacctttgctgtgcctgtgtctgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcacggcggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagaccggggccagccacaccctgtatggccatggagtgtgcaagtggccaggctgtgagagcatctgtgaggactttggccagttcctgaagcacctgaacaatgaacatgccctggatgacaggagcacagcccagtgccgggtgcagatgcaggtggtgcagcagctggagatccagctgagcaaggagcgggagcggctgcaggccatgatgacccacctgcacatgaggcccagcgagcccaagcccagccccaagcctgtgtctgcctactgcttcatcaacagcaagtag

SEQ ID NO: 152775 - DNA, 1872 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcacggcggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagaccggggccagccacaccctgtatggccatggagtgtgcaagtggccaggctgtgagagcatctgtgaggactttggccagttcctgaagcacctgaacaatgaacatgccctggatgacaggagcacagcccagtgccgggtgcagatgcaggtggtgcagcagctggagatccagctgagcaaggagcgggagcggctgcaggccatgatgacccacctgcacatgaggcccagcgagcccaagcccagccccaagcccctgaacctggtgtcctctgtgaccatgagcaagaacatgctggagaccagcccccagagcctgccccagacccccaccacccccacagcccctgtgacccccatcacccagggccccagcgtcatcaccccagcctctgtgcccaacgtgggcgccatcagaagaagacacagcgacaagtacaacatccccatgagcagcgagatcgcccccaactatgagttctacaagaatgctgatgtgcggccccccttcacctacgccaccctcatccggcaggccatcatggagagcagtgaccggcagctgaccctgaatgagatctacagctggttcaccaggacctttgcctacttcagaagaaatgctgccacctggaagaatgctgtgcgccacaacctgagcctgcacaagtgctttgtgcgggtggagaatgtgaagggagctgtgtggacagtggatgaggtggagtaccagaagagaagaagccagaagatcaccggcagccccaccctggtgaagaacatccccaccagcctgggctacggggccgccctgaatgccagcctgcaggccgccctggccgagagcagcctgcccctgctgagcaaccctggcctcatcaacaatgccagcagcggcctgctgcaggccgtgcatgaggacctgaatggcagcctggaccacatcgacagcaatggaaacagcagccctggctgcagcccccagccccacatccacagcatccacgtgaaggaggagcctgtgattgctgaagatgaggactgccccatgagcctggtgaccacagccaaccacagccctgagctggaggatgaccgggagattgaggaggagcccctgtctgaggacctggagtag

SEQ ID NO: 152776 - DNA, 1593 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcacggcggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagaccggggccagccacaccctgtatggccatggagtgtgcaagtggccaggctgtgagagcatctgtgaggactttggccagttcctgaagcacctgaacaatgaacatgccctggatgacaggagcacagcccagtgccgggtgcagatgcaggtggtgcagcagctggagatccagctgagcaaggagcgggagcggctgcaggccatgatgacccacctgcacatgaggcccagcgagcccaagcccagccccaagccagccatcatggagagcagtgaccggcagctgaccctgaatgagatctacagctggttcaccaggacctttgcctacttcagaagaaatgctgccacctggaagaatgctgtgcgccacaacctgagcctgcacaagtgctttgtgcgggtggagaatgtgaagggagctgtgtggacagtggatgaggtggagtaccagaagaggaggagccagaagatcaccggcagccccaccctggtgaagaacatccccaccagcctgggctatggagctgccctgaatgccagcctgcaggccgccctggccgagagcagcctgcccctgctgagcaaccctggcctcatcaacaatgccagcagcggcctgctgcaggccgtgcatgaggacctgaatggcagcctggaccacatcgacagcaatggaaacagcagccctggctgcagcccccagccccacatccacagcatccacgtgaaggaggagcctgtgattgctgaagatgaggactgccccatgagcctggtgaccacagccaaccacagccctgagctggaggatgaccgggagattgaggaggagcccctgtctgaggacctggagtag

SEQ ID NO: 152777 - DNA, 2148 bp, Artificial Sequence; identical to SEQ ID NO: 152772
  Description of Artificial Sequence: Synthetic coding sequence

SEQ ID NO: 152778 - DNA, 1149 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggccctgctgcagcagcagcaggccgtgatgctgcagcaggacttcctggacagcggcctggagaacttccgggccgccctggagaagaaccagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcatggaggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagactggagccagccacaccctgtatggccacggcgtgtgcaagtggccaggctgtgagagcatctgtgaagattttggccagttcctgaagcacctgaacaatgagcacgccctggatgacaggagcacagcccagtgccgggtgcagatgcaggtggtgcagcagctggagatccagctgagcaaggagcgggagcggctgcaggccatgatgacccacctgcacatgaggccttctgagcccaagcccagccccaagcccaacatctgcaaggtgacctaccgctgcatctggatgttcctgcgcttcagcaactatgcagaggtgctgctgtacatccctgagaagctgacccctgtggccctgtag

SEQ ID NO: 152779 - DNA, 2199 bp, Artificial Sequence
  Description of Artificial Sequence: Synthetic coding sequence
atgatgcaggagagcgccacagagaccatcagcaacagctccatgaaccagaatggcatgagcaccctgagcagccagctggatgctggcagcagagatggccgcagcagcggggacaccagcagcgaggtgtccacagtggagctgctgcacctgcagcagcagcaggccctgcaggccgcccggcagctgctgctgcagcagcagaccagcggcctgaagagccccaagagcagtgacaagcagaggcccctgcaggtgcctgtgtctgtggccatgatgaccccccaggtgatcaccccccagcagatgcagcagatcctgcagcagcaggtgctgagcccccagcagctgcaggccctgctgcagcagcagcaggccgtgatgctgcagcaggacttcctggacagcggcctggagaacttccgggccgccctggagaagaaccagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcatggaggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagactggagccagccacaccctgtatggccacggcgtgtgcaagtggccaggctgtgagagcatctgtgaagattttggccagttcctgaagcacctgaacaatgagcacgccctggatgacaggagcacagcccagtgccgggtgcagatgcaggtggtgcagcagctggagatccagctgagcaaggagcgggagcggctgcaggccatgatgacccacctgcacatgaggccttctgagcccaagcccagccccaagcccctgaacctggtgtcctctgtgaccatgagcaagaacatgctggagaccagcccccagagcctgccccagacccccaccacccccacagcccctgtgacccccatcacccagggccccagcgtcatcaccccagcctctgtgcccaacgtgggcgccatcagaagaagacacagcgacaagtacaacatccccatgagcagcgagatcgcccccaactatgagttctacaagaatgctgatgtgcggccccccttcacctacgccaccctcatccggcaggccatcatggagagcagtgaccggcagctgaccctgaatgagatctacagctggttcaccaggacctttgcctacttcagaagaaatgctgccacctggaagaatgctgtgcgccacaacctgagcctgcacaagtgctttgtgcgggtggagaatgtgaagggagctgtgtggacagtggatgaggtggagtaccagaagaggaggagccagaagatcaccggcagccccaccctggtgaagaacatccccaccagcctgggctatggagctgccctgaatgccagcctgcaggccgccctggccgagagcagcctgcccctgctgagcaaccctggcctcatcaacaatgccagcagcggcctgctgcaggccgtgcatgaggacctgaatggcagcctggaccacatcgacagcaatggaaacagcagccctggctgcagcccccagccccacatccacagcatccacgtgaaggaggagcctgtgattgctgaagatgaggactgccccatgagcctggtgaccacagccaaccacagccctgagctggaggatgaccgggagattgaggaggagcccctgtctgaggacctggagtag

SEQ ID NO: 152780 - DNA, 2223 bp, Artificial Sequence
  Description of Artificial Sequence: Synthetic coding sequence
atgatgcaggagagcgccacagagaccatcagcaacagctccatgaaccagaatggcatgagcaccctgagcagccagctggatgctggcagcagagatggccgcagcagcggggacaccagcagcgaggtgtccacagtggagctgctgcacctgcagcagcagcaggccctgcaggccgcccggcagctgctgctgcagcagcagaccagcggcctgaagagccccaagagcagtgacaagcagaggcccctgcaggagctgctgcctgagaccaagctgtgcatctgtggccacagcagtggagatggccacccccacaacacctttgctgtgcctgtgtctgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccctgggaagcaggccaaggagcagcagcagcagcagcagcagcagcagcagctggccgcccagcagctggtgttccagcagcagctgctgcagatgcagcagctgcagcagcagcagcacctgctgagcctgcagaggcagggcctcatcagcatccccccaggccaggccgccctgcctgtgcagagcctgccccaggccggcctgagccctgctgagatccagcagctgtggaaggaggtgactggagtgcacagcatggaggacaatggcatcaagcatggaggcctggacctgaccaccaacaacagcagcagcaccaccagcagcaacaccagcaaggccagcccccccatcacccaccacagcatcgtgaatggccagagctctgtgctgagcgcccggcgggacagcagcagccatgaggagactggagccagccacaccctgtatggccacggcgtgtgcaagtggccaggctgtgagagcatctgtgaagattttggccagttcctgaagcacctgaacaatgagcacgccctggatgacaggagcacagcccagtgccgggtgcagatgcaggtggtgcagcagctggagatccagctgagcaaggagcgggagcggctgcaggccatgatgacccacctgcacatgaggccttctgagcccaagcccagccccaagcccctgaacctggtgtcctctgtgaccatgagcaagaacatgctggagaccagcccccagagcctgccccagacccccaccacccccacagcccctgtgacccccatcacccagggccccagcgtcatcaccccagcctctgtgcccaacgtgggcgccatcagaagaagacacagcgacaagtacaacatccccatgagcagcgagatcgcccccaactatgagttctacaagaatgctgatgtgcggccccccttcacctacgccaccctcatccggcaggccatcatggagagcagtgaccggcagctgaccctgaatgagatctacagctggttcaccaggacctttgcctacttcagaagaaatgctgccacctggaagaatgctgtgcgccacaacctgagcctgcacaagtgctttgtgcgggtggagaatgtgaagggagctgtgtggacagtggatgaggtggagtaccagaagaggaggagccagaagatcaccggcagccccaccctggtgaagaacatccccaccagcctgggctatggagctgccctgaatgccagcctgcaggccgccctggccgagagcagcctgcccctgctgagcaaccctggcctcatcaacaatgccagcagcggcctgctgcaggccgtgcatgaggacctgaatggcagcctggaccacatcgacagcaatggaaacagcagccctggctgcagcccccagccccacatccacagcatccacgtgaaggaggagcctgtgattgctgaagatgaggactgccccatgagcctggtgaccacagccaaccacagccctgagctggaggatgaccgggagattgaggaggagcccctgtctgaggacctggagtag

SEQ ID NO: 152781 - DNA, 1191 bp, Artificial Sequence
  Description of Artificial Sequence: Synthetic coding sequence
atgcccaaccccaggcctgggaagcccagcgcccccagcctggccctgggccccagccctggggccagccccagctggagggctgcccccaaggccagtgacctgctgggcgcccggggccctgggggcaccttccagggccgggacctgcggggcggggcccacgccagcagcagcagcctgaaccccatgccacccagccagctgcagctgagcacagtggatgcccacgcccggacccctgtgctgcaggtgcaccccctggagagccctgccatgatcagcctgaccccacccaccacagccactggagtcttcagcctgaaggcccggcccggcctgcccccaggcatcaacgtggccagcctggagtgggtgtcccgggagcccgccctgctgtgcaccttccccaaccccagcgcccccaggaaggacagcaccctgtctgctgtgccccagagcagctaccccctgctggccaatggagtgtgcaagtggccaggctgtgagaaggtgtttgaggagcctgaggacttcctgaagcactgccaggccgaccacctgctggatgagaagggccgggcccagtgcctgctgcagcgggagatggtgcagagcctggagcagcagctggtgctggagaaggagaagctgagcgccatgcaggcccacctggccggcaagatggccctgaccaaggccagctctgtggccagcagtgacaagggcagctgctgcatcgtggccgccggcagccagggccctgtggtgcctgcctggagcggcccccgggaggccccagacagcctgtttgctgtgcggcggcacctgtggggcagccacggcaacagcaccttccctgagttcctgcacaacatggactacttcaagttccacaacatgaggcctcccttcacctacgccaccctcatccgctgggccatcctggaggcccctgagaagcagaggaccctgaatgagatctaccactggttcaccaggatgtttgccttcttcaggaaccacccagccacctggaagaatgccatccgccacaacctgagcctgcacaagtgctttgtgcgggtggagagcgagaagggagctgtgtggacagtggatgagctggagttcaggaagaagaggagccagaggcccagccgctgcagcaaccccaccccaggcccctag

SEQ ID NO: 152782 - DNA, 1296 bp, Artificial Sequence
  Description of Artificial Sequence: Synthetic coding sequence
atgcccaaccccaggcctgggaagcccagcgcccccagcctggccctgggccccagccctggggccagccccagctggagggctgcccccaaggccagtgacctgctgggcgcccggggccctgggggcaccttccagggccgggacctgcggggcggggcccacgccagcagcagcagcctgaaccccatgccacccagccagctgcagctgcccaccctgcccctggtgatggtggcccccagcggggcccggctgggccccctgccccacctgcaggccctgctgcaggaccggccccacttcatgcaccagctgagcacagtggatgcccacgcccggacccctgtgctgcaggtgcaccccctggagagccctgccatgatcagcctgaccccacccaccacagccaccggggtcttcagcctgaaggcccggcccggcctgcccccaggcatcaacgtggccagcctggagtgggtgtcccgggagcccgccctgctgtgcaccttccccaaccccagcgcccccaggaaggacagcaccctgtctgctgtgccccagagcagctaccccctgctggccaacggggtgtgcaagtggccaggctgtgagaaggtgtttgaggagcctgaggacttcctgaagcactgccaggccgaccacctgctggatgagaagggccgggcccagtgcctgctgcagcgggagatggtgcagagcctggagcagcagctggtgctggagaaggagaagctgagcgccatgcaggcccacctggccggcaagatggccctgaccaaggccagctctgtggccagcagtgacaagggcagctgctgcatcgtggccgccggcagccagggccctgtggtgcctgcctggagcggcccccgggaggccccagacagcctgtttgctgtgagaagacacctgtggggcagccacggcaacagcaccttccctgagttcctgcacaacatggactacttcaagttccacaacatgaggcctcccttcacctacgccaccctcatccgctgggccatcctggaggcccctgagaagcagaggaccctgaatgagatctaccactggttcaccaggatgtttgccttcttcaggaaccacccagccacctggaagaatgccatccgccacaacctgagcctgcacaagtgctttgtgcgggtggagagcgagaagggagctgtgtggacagtggatgagctggagttcaggaagaagaggagccagaggcccagccgctgcagcaaccccaccccaggcccctag

SEQ ID NO: 152783 - DNA, 1215 bp, Artificial Sequence
  Description of Artificial Sequence: Synthetic coding sequence
atgcccaaccccaggcctgggaagcccagcgcccccagcctggccctgggccccagccctggggccagccccagctggagggctgcccccaaggccagtgacctgctgggcgcccggggccctgggggcaccttccagggccgggacctgcggggcggggcccacgccagcagcagcagcctgaaccccatgccacccagccagctgcagctgcccaccctgcccctggtgatggtggcccccagcggggcccggctgggccccctgccccacctgcaggccctgctgcaggaccggccccacttcatgcaccagctgagcacagtggatgcccacgcccggacccctgtgctgcaggtgcaccccctggagagccctgccatgatcagcctgaccccacccaccacagccaccggggtcttcagcctgaaggcccggcccggcctgcccccaggcatcaacgtggccagcctggagtgggtgtcccgggagcccgccctgctgtgcaccttccccaaccccagcgcccccaggaaggacagcaccctgtctgctgtgccccagagcagctaccccctgctggccaacggggtgtgcaagtggccaggctgtgagaaggtgtttgaggagcctgaggacttcctgaagcactgccaggccgaccacctgctggatgagaagggccgggcccagtgcctgctgcagcgggagatggtgcagagcctggagcagcaggccagcagtgacaagggcagctgctgcatcgtggccgccggcagccagggccctgtggtgcctgcctggagcggcccccgggaggccccagacagcctgtttgctgtgcggcggcacctgtggggcagccacggcaacagcaccttccctgagttcctgcacaacatggactacttcaagttccacaacatgaggcctcccttcacctacgccaccctcatccgctgggccatcctggaggcccctgagaagcagaggaccctgaatgagatctaccactggttcaccaggatgtttgccttcttcaggaaccacccagccacctggaagaatgccatccgccacaacctgagcctgcacaagtgctttgtgcgggtggagagcgagaagggagctgtgtggacagtggatgagctggagttcaggaagaagaggagccagaggcccagccgctgcagcaaccccaccccaggcccctag

SEQ ID NO: 152784 - DNA, 1191 bp, Artificial Sequence; identical to SEQ ID NO: 152781
  Description of Artificial Sequence: Synthetic coding sequence

SEQ ID NO: 152785 - DNA, 2043 bp, Artificial Sequence
  Description of Artificial Sequence: Synthetic coding sequence
atgatggtggagagcgccagcgagaccatccgcagcgcccccagcggccagaatggagtgggcagcctgagcggccaggctgatggcagcagtggaggagccaccggcaccacagccagcggcaccggccgggaggtgaccaccggggctgacagcaatggagagatgagccctgctgagctgctgcacttccagcagcagcaggccctgcaggtggcccggcagttcctgctgcagcaggccagcggcctgagcagccctggcaacaatgacagcaagcagagcgccagcgctgtgcaggtgcctgtgtctgtggccatgatgagcccccagatgctgaccccccagcagatgcagcagatcctgagccccccccagctgcaggccctgctgcagcagcagcaggccctgatgctgcagcagctgcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagaggcagggcctggtgtccctgcagcccaaccaggccagcggccccctgcagaccctgccccaggccgctgtgtgccccacagacctgccccagctgtggaagggggagggcgcccctggccagcctgctgaggacagcgtgaagcaggagggcctggacctgactggaacagctgccacagccaccagctttgctgccccacccaaggtgagcccccccctgagccaccacaccctgcccaacggccagcccaccgtgctgaccagccggcgggacagcagcagccatgaggagaccccaggcagccaccccctgtatggccacggggagtgcaagtggccaggctgtgagaccctgtgtgaggacctgggccagttcatcaagcacctgaacacagagcacgccctggatgacaggagcacagcccagtgccgggtgcagatgcaggtggtgcagcagctggagatccagctggccaaggagagcgagcggctgcaggccatgatggcccacctgcacatgaggccttctgagcccaagcccttcagccagcccctgaaccctgtgcccggcagcagcagcttcagcaaggtgacagtgtctgctgctgacagcttcccagatggcctggtgcacccccccaccagcgctgctgcccctgtgacccccctgcggcccccaggcctgggcagcgccagcctgcatggaggcggccctgcccggcggcgcagcagtgacaagttctgcagccccatcagcagcgagctggcccagaaccacgagttctacaagaatgctgatgtgcggccccccttcacctacgccagcctcatccggcaggccatcctggagaccccagaccggcagctgaccctgaatgagatctacaactggttcaccaggatgtttgcctacttcagaagaaacacagccacctggaagaatgctgtgcgccacaacctgagcctgcacaagtgctttgtgcgggtggagaatgtgaagggagctgtgtggacagtggatgagcgggagtaccagaagaggcggccccccaagatgacaggcagccccaccctggtgaagaacatgatcagcggcctgtcctatggagccctgaatgccagctaccaggccgccctggccgagagcagcttccccctgctgaacagccctggcatgctgaaccctggcagcgccagcagcctgctgcccctgagccatgatgatgtgggcgcccctgtggagcccctgcccagcaatggcagcagcagccccccccggctgagccccccccagtacagccaccaggtgcaggtgaaggaggagcctgctgaggccgaggaggaccggcagcccggcccccccctgggcgcccccaaccccagcgccagcggccccccagaggaccgggacctggaggaggagctgcctggagaggagctgtcctag

SEQ ID NO: 152786 - DNA, 2037 bp, Artificial Sequence
  Description of Artificial Sequence: Synthetic coding sequence
atgatggtggagagcgccagcgagaccatccgcagcgcccccagcggccagaatggagtgggcagcctgagcggccaggctgatggcagcagtggaggagccaccggcaccacagccagcggcaccggccgggaggtgaccaccggggctgacagcaatggagagatgagccctgctgagctgctgcacttccagcagcagcaggccctgcaggtggcccggcagttcctgctgcagcaggccagcggcctgagcagccctggcaacaatgacagcaagcagagcgccagcgctgtgcaggtgcctgtgtctgtggccatgatgagcccccagatgctgaccccccagcagatgcagcagatcctgagccccccccagctgcaggccctgctgcagcagcagcaggccctgatgctgcagcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagaggcagggcctggtgtccctgcagcccaaccaggccagcggccccctgcagaccctgccccaggccgctgtgtgccccacagacctgccccagctgtggaagggggagggcgcccctggccagcctgctgaggacagcgtgaagcaggagggcctggacctgactggaacagctgccacagccaccagctttgctgccccacccaaggtgagcccccccctgagccaccacaccctgcccaacggccagcccaccgtgctgaccagccggcgggacagcagcagccatgaggagaccccaggcagccaccccctgtatggccacggggagtgcaagtggccaggctgtgagaccctgtgtgaggacctgggccagttcatcaagcacctgaacacagagcacgccctggatgacaggagcacagcccagtgccgggtgcagatgcaggtggtgcagcagctggagatccagctggccaaggagagcgagcggctgcaggccatgatggcccacctgcacatgaggccttctgagcccaagcccttcagccagcccctgaaccctgtgcccggcagcagcagcttcagcaaggtgacagtgtctgctgctgacagcttcccagatggcctggtgcacccccccaccagcgctgctgcccctgtgacccccctgcggcccccaggcctgggcagcgccagcctgcatggaggcggccctgcccggcggcgcagcagtgacaagttctgcagccccatcagcagcgagctggcccagaaccacgagttctacaagaatgctgatgtgcggccccccttcacctacgccagcctcatccggcaggccatcctggagaccccagaccggcagctgaccctgaatgagatctacaactggttcaccaggatgtttgcctacttcagaagaaacacagccacctggaagaatgctgtgcgccacaacctgagcctgcacaagtgctttgtgcgggtggagaatgtgaagggagctgtgtggacagtggatgagcgggagtaccagaagaggcggccccccaagatgacaggcagccccaccctggtgaagaacatgatcagcggcctgtcctatggagccctgaatgccagctaccaggccgccctggccgagagcagcttccccctgctgaacagccctggcatgctgaaccctggcagcgccagcagcctgctgcccctgagccatgatgatgtgggcgcccctgtggagcccctgcccagcaatggcagcagcagccccccccggctgagccccccccagtacagccaccaggtgcaggtgaaggaggagcctgctgaggccgaggaggaccggcagcccggcccccccctgggcgcccccaaccccagcgccagcggccccccagaggaccgggacctggaggaggagctgcctggagaggagctgtcctag

SEQ ID NO: 152787 - DNA, 2043 bp, Artificial Sequence; identical to SEQ ID NO: 152785
  Description of Artificial Sequence: Synthetic coding sequence

SEQ ID NO: 152788 - DNA, 2004 bp, Artificial Sequence
  Description of Artificial Sequence: Synthetic coding sequence
atgatggtggagagcgccagcgagaccatccgcagcgcccccagcggccagaatggagtgggcagcctgagcggccaggctgatggcagcagtggaggagccaccggcaccacagccagcggcaccggccgggaggtgaccaccggggctgacagcaatggagagatgagccctgctgagctgctgcacttccagcagcagcaggccctgcaggtggcccggcagttcctgctgcagcaggccagcggcctgagcagccctggcaacaatgacagcaagcagagcgccagcgctgtgcaggtgcctgtgtctgtggccatgatgagcccccagatgctgaccccccagcagatgcagcagatcctgagccccccccagctgcaggccctgctgcagcagcagcaggccctgatgctgcagcagctgcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagaggcagggcctggtgtccctgcagcccaaccaggccagcggccccctgcagaccctgccccaggccgtgtgccccacagacctgccccagctgtggaagggggagggcgcccctggccagcctgcagaagattctgtgaagcaggagggcctggacctgaccggcacagctgccacagccaccagctttgctgccccacccaaggtgtccccacccctgagccaccacaccctgcccaacggccagcccaccgtgctgaccagcagaagagacagcagcagccatgaggagaccccaggcagccaccccctgtatggccatggagagtgcaagtggccaggctgtgagaccctgtgtgaggacctgggccagttcatcaagcacctgaacacagaacatgccctggatgacaggagcacagcccagtgccgggtgcagatgcaggtggtgcagcagctggagatccagctggccaaggagagcgagcggctgcaggccatgatggcccacctgcacatgaggcccagcgagcccaagcccttcagccagcctgtgacagtgtctgctgctgacagcttcccagatggcctggtgcacccccccaccagcgctgctgcccctgtgacccccctgcggcccccaggcctgggcagcgccagcctgcacggcggcggccctgccaggagaagaagcagtgacaagttctgcagccccatcagcagcgagctggcccagaaccacgagttctacaagaatgctgatgtgcggccccccttcacctacgccagcctcatccggcaggccatcctggagaccccagaccggcagctgaccctgaatgagatctacaactggttcaccaggatgtttgcctacttcagaagaaacacagccacctggaagaatgctgtgcgccacaacctgagcctgcacaagtgctttgtgcgggtggagaatgtgaagggagctgtgtggacagtggatgagcgggagtaccagaagagaagaccacccaagatgacaggcagccccaccctggtgaagaacatgatcagcggcctgtcctatggagccctgaatgccagctaccaggccgccctggccgagagcagcttccccctgctgaacagccctggcatgctgaaccctggcagcgccagcagcctgctgcccctgagccatgatgatgtgggcgcccctgtggagcccctgcccagcaatggcagcagcagccccccccggctgagccccccccagtacagccaccaggtgcaggtgaaggaggagcctgctgaggccgaggaggaccggcagcccggcccccccctgggcgcccccaaccccagcgccagcggccccccagaagatcgggacctggaggaggagctgcccggggaggagctgtcctag

SEQ ID NO: 152789 - DNA, 2007 bp, Artificial Sequence
  Description of Artificial Sequence: Synthetic coding sequence
atgatggtggagagcgccagcgagaccatccgcagcgcccccagcggccagaatggagtgggcagcctgagcggccaggctgatggcagcagtggaggagccaccggcaccacagccagcggcaccggccgggaggtgaccaccggggctgacagcaatggagagatgagccctgctgagctgctgcacttccagcagcagcaggccctgcaggtggcccggcagttcctgctgcagcaggccagcggcctgagcagccctggcaacaatgacagcaagcagagcgccagcgctgtgcaggtgcctgtgtctgtggccatgatgagcccccagatgctgaccccccagcagatgcagcagatcctgagccccccccagctgcaggccctgctgcagcagcagcaggccctgatgctgcagcagctgcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagaggcagggcctggtgtccctgcagcccaaccaggccagcggccccctgcagaccctgccccaggccgctgtgtgccccacagacctgccccagctgtggaagggggagggcgcccctggccagcctgctgaggacagcgtgaagcaggagggcctggacctgactggaacagctgccacagccaccagctttgctgccccacccaaggtgagcccccccctgagccaccacaccctgcccaacggccagcccaccgtgctgaccagccggcgggacagcagcagccatgaggagaccccaggcagccaccccctgtatggccacggggagtgcaagtggccaggctgtgagaccctgtgtgaggacctgggccagttcatcaagcacctgaacacagagcacgccctggatgacaggagcacagcccagtgccgggtgcagatgcaggtggtgcagcagctggagatccagctggccaaggagagcgagcggctgcaggccatgatggcccacctgcacatgaggccttctgagcccaagcccttcagccagcctgtgacagtgtctgctgctgacagcttcccagatggcctggtgcacccccccaccagcgctgctgcccctgtgacccccctgcggcccccaggcctgggcagcgccagcctgcatggaggcggccctgcccggcggcgcagcagtgacaagttctgcagccccatcagcagcgagctggcccagaaccacgagttctacaagaatgctgatgtgcggccccccttcacctacgccagcctcatccggcaggccatcctggagaccccagaccggcagctgaccctgaatgagatctacaactggttcaccaggatgtttgcctacttcagaagaaacacagccacctggaagaatgctgtgcgccacaacctgagcctgcacaagtgctttgtgcgggtggagaatgtgaagggagctgtgtggacagtggatgagcgggagtaccagaagaggcggccccccaagatgacaggcagccccaccctggtgaagaacatgatcagcggcctgtcctatggagccctgaatgccagctaccaggccgccctggccgagagcagcttccccctgctgaacagccctggcatgctgaaccctggcagcgccagcagcctgctgcccctgagccatgatgatgtgggcgcccctgtggagcccctgcccagcaatggcagcagcagccccccccggctgagccccccccagtacagccaccaggtgcaggtgaaggaggagcctgctgaggccgaggaggaccggcagcccggcccccccctgggcgcccccaaccccagcgccagcggccccccagaggaccgggacctggaggaggagctgcctggagaggagctgtcctag

SEQ ID NO: 152790 - DNA, 1212 bp, Artificial Sequence
  Description of Artificial Sequence: Synthetic coding sequence
atgaagctggaggtgtttgtgccccgggccgcccacggggacaagcagggcagtgacctggagggcgccggcggcagtgatgcccccagccccctgtctgctgctggagatgacagcctgggcagtgatggagactgtgccgccaacagccctgctgctgggggcggggcccgggacacccagggagatggagagcagagcgctgggggcggccctggagctgaggaggccatcccagctgctgctgctgctgctgtggtggccgagggcgctgaggccggggccgccggccctggggccggcggggccggcagcggggagggcgcccggagcaagccctacacccggcggcccaagccaccctacagctacatcgccctgattgccatggccatccgggacagcgctgggggccgcctgaccctggccgagatcaatgagtacctgatgggcaagttccccttcttccggggcagctacacaggctggaggaacagcgtgcgccacaacctgagcctgaatgactgctttgtgaaggtgctgcgggaccccagccggccctggggcaaggacaactactggatgctgaaccccaacagcgagtacacctttgctgatggagtcttcagaagaagaaggaagaggctgagccaccgggcccctgtgcctgcccctggcctgcggcctgaggaggcccctggcctgcctgctgcccctcctccagccccagctgccccagccagccccaggatgaggagccctgcccggcaggaggagcgggccagccctgctgggaagttcagcagcagctttgccatcgacagcatcctgaggaagcccttccgcagccggcggctgcgggacacagcccctggcaccaccctgcagtggggcgccgccccctgcccccccctgcctgccttccctgccctgctgcctgctgccccctgccgggccctgctgcccctgtgtgcctacggggccggggagcccgcccggctgggcgcccgggaggccgaggtgcccccaacagccccacccctgctgctggcccccctgcctgctgctgccccagccaagcccctgcggggccctgctgctggaggagcccacctgtactgccccctgcggctgcctgctgccctgcaggccgcctctgtgcggcggcccggcccccacctgccctaccctgtggagaccctgctggcctag

SEQ ID NO: 152791 - DNA, 1626 bp, Artificial Sequence
  Description of Artificial Sequence: Synthetic coding sequence
atgagccagctggtggagtgtgtgcccaacttcagcgagggcaagaaccaggaggtgattgatgccatcagcggggccatcacccagaccccaggctgtgtgctgctggatgtggatgctggccccagcaccaacagaacagtgtacacctttgtgggccccccagaatgtgtggtggagggcgccctgaatgctgcccgggtggccagccggctgattgacatgagccgccaccagggcgagcaccccaggatgggcgccctggatgtgtgccccttcatccctgtgcggggcgtgtctgtggatgaatgtgtgctgtgtgcccaggccttcggccagaggctggccgaggagctggatgtgcctgtgtacctgtatggagaggccgccaggatggacagcaggaggaccctgcctgccatccgggccggggagtatgaggccctgcccaagaagctgcagcaggccgactgggccccagactttggccccagcagctttgtgcccagctggggcgccacagccaccggggccaggaagttcctgattgccttcaacatcaacctgctgggcaccaaggagcaggcccacagaattgccctgaacctgcgggagcagggccggggcaaggaccagcccggccgcctgaagaaggtgcagggcatcggctggtacctggatgagaagaacctggcccaggtgtccaccaacctgctggactttgaggtgacagccctgcacacagtgtatgaggagacctgccgggaggcccaggagctgagcctgcctgtggtgggcagccagctggtgggcctggtgcccctgaaggccctgctggatgctgctgccttctactgtgagaaggaaaatctcttcatcctggaggaggagcagaggatccggctggtggtgtcccggctgggcctggacagcctgtgccccttcagccccaaggagcgcatcatcgagtacctggtgcctgagcggggccctgagcggggcctgggcagcaagagcctgcgggcctttgtgggggaggtgggcgcccggtctgctgcccctgggggcggctctgtggccgctgctgctgctgccatgggcgccgccctgggctccatggtgggcctgatgacctatggaagacggcagttccagagcctggacaccaccatgaggaggctcatcccccccttccgggaggccagcgccaagctgaccaccctggtggatgctgatgctgaggccttcaccgcctacctggaggccatgaggctgcccaagaacaccccagaggagaaggacagaagaacagctgccctgcaggagggcctgcggcgggctgtgtctgtgcccctgaccctggccgagaccgtggccagcctgtggccagccctgcaggagctggcccgctgtggcaacctggcctgccgcagtgacctgcaggtggccgccaaggccctggagatgggcgtgtttggagcctacttcaacgtgctgatcaacctgcgggacatcacagatgaggccttcaaggaccagatccaccaccgggtgagcagcctgctgcaggaggccaagacccaggccgccctggtgctggactgcctggagacccggcaggagtag

SEQ ID NO: 152792 - DNA, 1488 bp, Artificial Sequence
  Description of Artificial Sequence: Synthetic coding sequence
atgagccagctggtggagtgtgtgcccaacttcagcgagggcaagaaccaggaggtgattgatgccatcagcggggccatcacccagaccccaggctgtgtgctgctggatgtggatgctggccccagcaccaacagaacagtgtacacctttgtgggccccccagaatgtgtggtggagggcgccctgaatgctgcccgggtggccagccggctgattgacatgagccgccaccagggcgagcaccccaggatgggcgccctggatgtgtgccccttcatccctgtgcggggcgtgtctgtggatgaatgtgtgctgtgtgcccaggccttcggccagaggctggccgaggagctggatgtgcctgtgtacctgtatggagaggccgccaggatggacagcaggaggaccctgcctgccatccgggccggggagtatgaggccctgcccaagaagctgcagcaggccgactgggccccagactttggccccagcagctttgtgcccagctggggcgccacagccaccggggccaggaagttcctgattgccttcaacatcaacctgctgggcaccaaggagcaggcccacagaattgccctgaacctgcgggagcagggccggggcaaggaccagcccggccgcctgaagaaggtgcagggcatcggctggtacctggatgagaagaacctggcccaggtgtccaccaacctgctggactttgaggtgacagccctgcacacagtgtatgaggagacctgccgggaggcccaggagctgagcctgcctgtggtgggcagccagctggtgggcctggtgcccctgaaggccctgctggatgctgctgccttctactgtgagaaggaaaatctcttcatcctggaggaggagcagaggatccggctggtggtgtcccggctgggcctggacagcctgtgccccttcagccccaaggagcgcatcatcgagtacctggtgcctgagcggggccctgagcggggcctgggcagcaagagcctgcgggcctttgtgggggaggtgggcgcccggtctgctgcccctgggggcggctctgtggccgctgctgctgctgccatgggcgccgccctgggctccatggtgggcctgatgacctatggaagacggcagttccagagcctggacaccaccatgaggaggctcatcccccccttccgggaggccagcgccaagctgaccaccctggtggatgctgatgctgaggccttcaccgcctacctggcccacggcggccccaccggcggcagcgaggccggcagcctgtgtgccgcagatgctggaggagatggcggcctggccgtggccggccctgctggcactggacctgtgtgggagcccggcctgcctgtgcggcccccaggcggcggccagagccctggagatggccgggtgtggaggatcttccagagggcccaccagcctgagggccaccaccggcggggcatctag

SEQ ID NO: 152793 - DNA, 1719 bp, Artificial Sequence
  Description of Artificial Sequence: Synthetic coding sequence
atgagccagctggtggagtgtgtgcccaacttcagcgagggcaagaaccaggaggtgattgatgccatcagcggggccatcacccagaccccaggctgtgtgctgctggatgtggatgctggccccagcaccaacagaacagtgtacacctttgtgggccccccagaatgtgtggtggagggcgccctgaatgctgcccgggtggccagccggctgattgacatgagccgccaccagggcgagcaccccaggatgggcgccctggatgtgtgccccttcatccctgtgcggggcgtgtctgtggatgaatgtgtgctgtgtgcccaggccttcggccagaggctggccgaggagctggatgtgcctgtgtacctgtatggagaggccgccaggatggacagcaggaggaccctgcctgccatccgggccggggagtatgaggccctgcccaagaagctgcagcaggccgactgggccccagactttggccccagcagctttgtgcccagctggggcgccacagccaccggggccaggaagttcctgattgccttcaacatcaacctgctgggcaccaaggagcaggcccacagaattgccctgaacctgcgggagcagggccggggcaaggaccagcccggccgcctgaagaaggtgcagggcatcggctggtacctggatgagaagaacctggcccaggtgtccaccaacctgctggactttgaggtgacagccctgcacacagtgtatgaggagacctgccgggaggcccaggagctgagcctgcctgtggtgggcagccagctggtgggcctggtgcccctgaaggccctgctggatgctgctgccttctactgtgagaaggaaaatctcttcatcctggaggaggagcagaggatccggctggtggtgtcccggctgggcctggacagcctgtgccccttcagccccaaggagcgcatcatcgagtacctggtgcctgagcggggccctgagcggggcctgggcagcaagagcctgcgggcctttgtgggggaggtgggcgcccggtctgctgcccctgggggcggctctgtggccgctgctgctgctgccatgggcgccgccctgggctccatggtgggcctgatgacctatggaagacggcagttccagagcctggacaccaccatgaggaggctcatcccccccttccgggaggccagcgccaagctgaccaccctggtggatgctgatgctgaggccttcaccgcctacctggaggccatgaggctgcccaagaacaccccagaggagaaggacagaagaacagctgccctgcaggagggcctgcggcgggctgtgtctgtgcccctgaccctggccgagaccgtggccagcctgtggccagccctgcaggagctggcccgctgtggcaacctggcctgccgcagtgacctgcaggtggccgccaaggccctggagatgggcgtgtttggagcctacttcaacgtgctgatcaacctgcgggacatcacagatgaggccttcaaggaccagcccccagctggcagccaggaccccggctgcaccggggccggcctgctgggggaccctgctggggtgacagtgcgggaggccagccctggctctgtggccccacccagccccatcccccggggccagagctgtgacctggagaccccaggcacagctggccccagcaccctggagggctag

SEQ ID NO: 152794 - DNA, 1488 bp, Artificial Sequence; identical to SEQ ID NO: 152792
  Description of Artificial Sequence: Synthetic coding sequence

SEQ ID NO: 152795 - DNA, 1626 bp, Artificial Sequence; identical to SEQ ID NO: 152791
  Description of Artificial Sequence: Synthetic coding sequence

SEQ ID NO: 152796 - DNA, 1719 bp, Artificial Sequence; identical to SEQ ID NO: 152793
  Description of Artificial Sequence: Synthetic coding sequence

SEQ ID NO: 152797 - DNA, 1779 bp, Artificial Sequence
  Description of Artificial Sequence: Synthetic coding sequence
atgtcctggggcacagagctgtgggaccagtttgacaacctggagaagcacacccagtggggcatcgacatcctggagaagtacatcaagtttgtgaaggagaggacagaaattgagctgtcctatgccaagcagctgaggaacctgagcaagaagtaccagcccaagaagaacagcaaggaggaggaggagtacaagtacaccagctgcaaggccttcatcagcaacctgaatgagatgaatgactatgccggccagcatgaagtcatcagcgagaacatggccagccagatcatcgtggacctggcccgctacgtgcaggagctgaagcaggagaggaagagcaacttccatgatggcaggaaggcccagcagcacatcgagacctgctggaagcagctggagagcagcaagagaagatttgagcgggactgcaaggaggccgaccgggcccagcagtactttgagaagatggatgctgacatcaacgtgaccaaggcagatgtggagaaggcccggcagcaggcccagatccgccaccagatggccgaggacagcaaggctgactacagcagcatcctgcagaagttcaaccacgagcagcacgagtactaccacacccacatccccaacatcttccagaagatccaggagatggaggagcggcgcatcgtgaggatgggagagagcatgaagacctatgcagaggtggaccggcaggtgatccccatcatcggcaagtgcctggatggcatcgtgaaggctgctgagagcattgaccagaagaatgacagccagctggtgattgaggcctacaagagcggctttgagcccccaggggacatcgagtttgaggactacacccagcccatgaagaggacagtgtctgacaacagcctgagcaacagcagaggagagggcaagccagacctgaagtttggaggcaagagcaagggcaagctgtggcccttcatcaagaagaacaagagccccaagcagcagaaggagcccctgagccaccgcttcaatgagttcatgaccagcaagcccaagatccactgcttccgcagcctgaagaggggccacagcctgctgaagggggccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaacccccccaccgtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaagaagataaaggagatggctggacccgcatcagaagaaatgaagatgaggagggctacgtgcccaccagctatgtggaggtgtgcctggacaagaatgccaagggggccaagacctacatctag

SEQ ID NO: 152798 - DNA, 1854 bp, Artificial Sequence
  Description of Artificial Sequence: Synthetic coding sequence
atccgctggacagatgagctgtgggaccagtttgacaacctggagaagcacacccagtggggcatcgacatcctggagaagtacatcaagtttgtgaaggagaggacagaaattgagctgtcctatgccaagcagctgaggaacctgagcaagaagtaccagcccaagaagaacagcaaggaggaggaggagtacaagtacaccagctgcaaggccttcatcagcaacctgaatgagatgaatgactatgccggccagcatgaagtcatcagcgagaacatggccagccagatcatcgtggacctggcccgctacgtgcaggagctgaagcaggagaggaagagcaacttccatgatggcaggaaggcccagcagcacatcgagacctgctggaagcagctggagagcagcaagagaagatttgagcgggactgcaaggaggccgaccgggcccagcagtactttgagaagatggatgctgacatcaacgtgaccaaggcagatgtggagaaggcccggcagcaggcccagatccgccaccagatggccgaggacagcaaggctgactacagcagcatcctgcagaagttcaaccacgagcagcacgagtactaccacacccacatccccaacatcttccagaagatccaggagatggaggagcggcgcatcgtgaggatgggagagagcatgaagacctatgcagaggtggaccggcaggtgatccccatcatcggcaagtgcctggatggcatcgtgaaggctgctgagagcattgaccagaagaatgacagccagctggtgattgaggcctacaagagcggctttgagcccccaggggacatcgagtttgaggactacacccagcccatgaagaggacagtgtctgacaacagcctgagcaacagcagaggagagggcaagccagacctgaagtttggaggcaagagcaagggcaagctgtggcccttcatcaagaagaacaagctgatgagcctgctgaccagcccccaccagcccccacctcctcctccagccagcgccagccccagcgctgtgcccaacggcccccagagccccaagcagcagaaggagcccctgagccaccgcttcaatgagttcatgaccagcaagcccaagatccactgcttccgcagcctgaagaggggccccagcttcaagcagggcgccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaaccccccaacagtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaggaggacaagggagatggctggacccgcatcagaagaaatgaagatgaggagggctacgtgcccaccagctatgtggaggtgtgcctggacaagaatgccaaggacagctag

SEQ ID NO: 152799 - DNA, 1854 bp, Artificial Sequence
  Description of Artificial Sequence: Synthetic coding sequence
atgtcctggggcacagagctgtgggaccagtttgacaacctggagaagcacacccagtggggcatcgacatcctggagaagtacatcaagtttgtgaaggagaggacagaaattgagctgtcctatgccaagcagctgaggaacctgagcaagaagtaccagcccaagaagaacagcaaggaggaggaggagtacaagtacaccagctgcaaggccttcatcagcaacctgaatgagatgaatgactatgccggccagcatgaagtcatcagcgagaacatggccagccagatcatcgtggacctggcccgctacgtgcaggagctgaagcaggagaggaagagcaacttccatgatggcaggaaggcccagcagcacatcgagacctgctggaagcagctggagagcagcaagagaagatttgagcgggactgcaaggaggccgaccgggcccagcagtactttgagaagatggatgctgacatcaacgtgaccaaggcagatgtggagaaggcccggcagcaggcccagatccgccaccagatggccgaggacagcaaggctgactacagcagcatcctgcagaagttcaaccacgagcagcacgagtactaccacacccacatccccaacatcttccagaagatccaggagatggaggagcggcgcatcgtgaggatgggagagagcatgaagacctatgcagaggtggaccggcaggtgatccccatcatcggcaagtgcctggatggcatcgtgaaggctgctgagagcattgaccagaagaatgacagccagctggtgattgaggcctacaagagcggctttgagcccccaggggacatcgagtttgaggactacacccagcccatgaagaggacagtgtctgacaacagcctgagcaacagcagaggagagggcaagccagacctgaagtttggaggcaagagcaagggcaagctgtggcccttcatcaagaagaacaagctgatgagcctgctgaccagcccccaccagcccccacctcctcctccagccagcgccagccccagcgctgtgcccaacggcccccagagccccaagcagcagaaggagcccctgagccaccgcttcaatgagttcatgaccagcaagcccaagatccactgcttccgcagcctgaagaggggccacagcctgctgaagggggccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaaccccccaacagtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaggaggacaagggagatggctggacccgcatcagaagaaatgaagatgaggagggctacgtgcccaccagctatgtggaggtgtgcctggacaagaatgccaaggacagctag

SEQ ID NO: 152800 - DNA, 1827 bp, Artificial Sequence
  Description of Artificial Sequence: Synthetic coding sequence
atgtcctggggcacagagctgtgggaccagtttgacaacctggagaagcacacccagtggggcatcgacatcctggagaagtacatcaagtttgtgaaggagaggacagaaattgagctgtcctatgccaagcagctgaggaacctgagcaagaagtaccagcccaagaagaacagcaaggaggaggaggagtacaagtacaccagctgcaaggccttcatcagcaacctgaatgagatgaatgactatgccggccagcatgaagtcatcagcgagaacatggccagccagatcatcgtggacctggcccgctacgtgcaggagctgaagcaggagaggaagagcaacttccatgatggcaggaaggcccagcagcacatcgagacctgctggaagcagctggagagcagcaagagaagatttgagcgggactgcaaggaggccgaccgggcccagcagtactttgagaagatggatgctgacatcaacgtgaccaaggcagatgtggagaaggcccggcagcaggcccagatccgccaccagatggccgaggacagcaaggctgactacagcagcatcctgcagaagttcaaccacgagcagcacgagtactaccacacccacatccccaacatcttccagaagatccaggagatggaggagcggcgcatcgtgaggatgggagagagcatgaagacctatgcagaggtggaccggcaggtgatccccatcatcggcaagtgcctggatggcatcgtgaaggctgctgagagcattgaccagaagaatgacagccagctggtgattgaggcctacaagagcggctttgagcccccaggggacatcgagtttgaggactacacccagcccatgaagaggacagtgtctgacaacagcctgagcaacagcagaggagagggcaagccagacctgaagtttggaggcaagagcaagggcaagctgtggcccttcatcaagaagaacaagcccccacctcctcctccagccagcgccagccccagcgctgtgcccaacggcccccagagccccaagcagcagaaggagcccctgagccaccgcttcaatgagttcatgaccagcaagcccaagatccactgcttccgcagcctgaagaggggccacagcctgaccctgcagggcgccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaacccccccaccgtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaagaagataaaggagatggctggacccgcatcagaagaaatgaagatgaggagggctacgtgcccaccagctatgtggaggtgtgcctggacaagaatgccaaggacagctag

SEQ ID NO: 152801 - DNA, 738 bp, Artificial Sequence
  Description of Artificial Sequence: Synthetic coding sequence
atgaagaggaccatcggcaagcccacctacgcctttgaggcccgggactatgtgctgagcctgaagctgggcgccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaaccccccaacagtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaggaggacaagggagatggctggacccgcatcagaagaaatgaagatgaggagggctacgtgcccaccagctatgtggaggtgtgcctggacaagaatgccaaggacagctag

SEQ ID NO: 152802 - DNA, 1854 bp, Artificial Sequence
  Description of Artificial Sequence: Synthetic coding sequence
atgtcctggggcacagagctgtgggaccagtttgacaacctggagaagcacacccagtggggcatcgacatcctggagaagtacatcaagtttgtgaaggagaggacagaaattgagctgtcctatgccaagcagctgaggaacctgagcaagaagtaccagcccaagaagaacagcaaggaggaggaggagtacaagtacaccagctgcaaggccttcatcagcaacctgaatgagatgaatgactatgccggccagcatgaagtcatcagcgagaacatggccagccagatcatcgtggacctggcccgctacgtgcaggagctgaagcaggagaggaagagcaacttccatgatggcaggaaggcccagcagcacatcgagacctgctggaagcagctggagagcagcaagagaagatttgagcgggactgcaaggaggccgaccgggcccagcagtactttgagaagatggatgctgacatcaacgtgaccaaggcagatgtggagaaggcccggcagcaggcccagatccgccaccagatggccgaggacagcaaggctgactacagcagcatcctgcagaagttcaaccacgagcagcacgagtactaccacacccacatccccaacatcttccagaagatccaggagatggaggagcggcgcatcgtgaggatgggagagagcatgaagacctatgcagaggtggaccggcaggtgatccccatcatcggcaagtgcctggatggcatcgtgaaggctgctgagagcattgaccagaagaatgacagccagctggtgattgaggcctacaagagcggctttgagcccccaggggacatcgagtttgaggactacacccagcccatgaagaggacagtgtctgacaacagcctgagcaacagcagaggagagggcaagccagacctgaagtttggaggcaagagcaagggcaagctgtggcccttcatcaagaagaacaagctgatgagcctgctgaccagcccccaccagcccccacctcctcctccagccagcgccagccccagcgctgtgcccaacggcccccagagccccaagcagcagaaggagcccctgagccaccgcttcaatgagttcatgaccagcaagcccaagatccactgcttccgcagcctgaagaggggcctgagcctgaagctgggcgccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaaccccccaacagtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaggaggacaagggagatggctggacccgcatcagaagaaatgaagatgaggagggctacgtgcccaccagctatgtggaggtgtgcctggacaagaatgccaaggacagctag

SEQ ID NO: 152803 - DNA, 1722 bp, Artificial Sequence
  Description of Artificial Sequence: Synthetic coding sequence
tgactgtcctatgccaagcagctgaggaacctgagcaagaagtaccagcccaagaagaacagcaaggaggaggaggagtacaagtacaccagctgcaaggccttcatcagcaacctgaatgagatgaatgactatgccggccagcatgaagtcatcagcgagaacatggccagccagatcatcgtggacctggcccgctacgtgcaggagctgaagcaggagaggaagagcaacttccatgatggcaggaaggcccagcagcacatcgagacctgctggaagcagctggagagcagcaagagaagatttgagcgggactgcaaggaggccgaccgggcccagcagtactttgagaagatggatgctgacatcaacgtgaccaaggcagatgtggagaaggcccggcagcaggcccagatccgccaccagatggccgaggacagcaaggctgactacagcagcatcctgcagaagttcaaccacgagcagcacgagtactaccacacccacatccccaacatcttccagaagatccaggagatggaggagcggcgcatcgtgaggatgggagagagcatgaagacctatgcagaggtggaccggcaggtgatccccatcatcggcaagtgcctggatggcatcgtgaaggctgctgagagcattgaccagaagaatgacagccagctggtgattgaggcctacaagagcggctttgagcccccaggggacatcgagtttgaggactacacccagcccatgaagaggacagtgtctgacaacagcctgagcaacagcagaggagagggcaagccagacctgaagtttggaggcaagagcaagggcaagctgtggcccttcatcaagaagaacaagcccccacctcctcctccagccagcgccagccccagcgctgtgcccaacggcccccagagccccaagcagcagaaggagcccctgagccaccgcttcaatgagttcatgaccagcaagcccaagatccactgcttccgcagcctgaagaggggccacagcctgctgaagggggccaccccagaggacttcagcaacctgcccccagagcagaggaggaagaagctgcagcagaaggtggatgagctgaacaaggagatccagaaggagatggaccagagagatgccatcaccaagatgaaggatgtgtacctgaagaacccccagatgggagaccctgccagcctggaccacaagctggccgaggtgtcccagaacatcgagaagctgcgggtggagacccagaagtttgaggcctggctggccgaggtggagggccgcctgcctgcccggtctgagcaggcccggcggcagagcggcctgtatgacagccagaaccccccaacagtgaacaactgtgcccaggaccgggagagcccagatggcagctacacagaggagcagagccaggagagcgagatgaaggtgctggccacagactttgatgatgaatttgatgatgaggagcccctgcctgccatcggcacctgcaaggccctgtacacctttgagggccagaatgaaggcaccatctctgtggtggagggggagaccctgtatgtgattgaggaggacaagggagatggctggacccgcatcagaagaaatgaagatgaggagggctacgtgcccaccagctatgtggaggtgtgcctggacaagaatgccaagggggccaagacctacatctag

SEQ ID NO: 152804 - DNA, 3495 bp, Artificial Sequence
  Description of Artificial Sequence: Synthetic coding sequence
atggctggaggagaagatagaggagatggagagcctgtgtctgtggtgacagtgcgggtgcagtacctggaggacacagacccctttgcctgtgccaacttccctgagccccggcgggcccccacctgcagcctggatggagccctgcccctgggcgcccagatcccagctgtgcaccggctgctgggcgcccccctgaagctggaggactgtgccctgcaggtgagccccagcggctactacctggacacagagctgagcctggaggagcagcgggagatgctggagggcttctatgaggagatcagcaagggcaggaagcccaccctcatcctgcggacccagctgtctgtgcgggtgaatgccatcctggagaagctgtacagcagcagcggccctgagctgcggcgcagcctcttcagcctgaagcagatcttccaggaggacaaggacctggtgcctgagtttgtgcacagcgagggcctgagctgcctgatccgggtgggcgctgctgctgaccacaactaccagagctacatcctgcgggccctgggccagctgatgctgtttgtggatggcatgctgggcgtggtggcccacagcgacaccatccagtggctgtacaccctgtgtgccagcctgagccggctggtggtgaagacagccctgaagctgctgctggtgtttgtggagtacagcgagaacaatgcccccctcttcatccgggctgtgaacagcgtggccagcaccactggagccccaccctgggccaacctggtgtccatcctggaggagaagaatggagctgaccctgagctgctggtgtacacagtgaccctcatcaacaagaccctggccgccctgcctgaccaggacagcttctatgatgtgacagatgccctggagcagcagggcatggaggccctggtgcagaggcacctgggcacagctggaacagatgtggacctgcggacccagctggtgctgtatgaaaatgccctgaagctggaggatggagacatcgaggaggcccctggagctgggggccggcgggagaggaggaagcccagcagcgaggagggcaagaggagcagaagaagcctggagggcggcggctgcccagcccgggcccctgagcccggccccactggacctgccagccctgtgggccccaccagcagcactggacctgccctgctgactggacctgccagcagccctgtgggcccccccagcggcctgcaggcctctgtgaacctcttccccaccatctctgtggcccccagcgctgacaccagcagcgagaggagcatctacaaggcccgcttcctggagaatgtggccgctgctgagacagagaagcaggtggccctggcccagggccgggcagagaccctggccggggccatgcccaatgaggccggcggccacccagatgcccggcagctgtgggacagccctgagacagccccagctgcccggaccccccagagccctgccccctgtgtgctgctgcgggcccagaggagcctggcccctgagcccaaggagcccctcatcccagccagccccaaggccgagcccatctgggagctgcccacccgggccccccggctgagcattggagacctggacttcagtgacctgggagaagatgaggaccaggacatgctgaatgtggagagcgtggaggccggcaaggacatcccagcccccagcccccccctgcccctgctgagcggcgtgcccccacctccacccctgcccccacctccacccatcaagggccccttccccccacctccacccctgcccctggccgcccccctgccccacagcgtgcctgacagcagcgccctgcccaccaagaggaagacagtgaagctgttctggagggagctgaagctggccggcggccacggcgtgtctgccagcagatttggcccctgtgccaccctgtgggccagcctggaccctgtgtctgtggacacagcccggctggagcacctgtttgagagccgggccaaggaggtgctgcccagcaagaaggccggggagggccgccgcaccatgaccaccgtgctggaccccaagaggagcaatgccatcaacatcggcctgaccaccctgccccctgtgcacgtgatcaaggccgccctgctgaactttgatgaatttgctgtgtccaaggatggcatcgagaagctgctgaccatgatgcccacagaggaggagcggcagaagattgaggaggcccagctggccaacccagacatccccctgggccctgctgagaacttcctgatgaccctggccagcatcggcggcctggccgcccggctgcagctgtgggccttcaagctggactatgacagcatggagcgggagattgctgagcccctgtttgacctgaaggtgggcatggagcagctggtgcagaatgccaccttccgctgcatcctggccaccctgctggccgtgggcaacttcctgaatggcagccagagcagcggctttgagctgagctacctggagaaggtgtctgaggtgaaggacacagtgcggcggcagagcctgctgcaccacctgtgcagcctggtgctgcagaccaggcctgagagcagtgacctgtacagcgagatcccagccctgacccgctgtgccaaggtggactttgagcagctgacagagaacctgggccagctggagcggcgcagcagagctgctgaggagagcctgcggagcctggccaagcatgagctggccccagccctgcgggcccggctgacccacttcctggaccagtgtgcccggcgggtggccatgctgagaattgtgcaccggcgggtgtgcaaccgcttccacgccttcctgctgtacctgggctacaccccccaggccgcccgggaggtgcgcatcatgcagttctgccacaccctgcgggagtttgccctggagtaccgcacctgccgggagcgggtgctgcagcagcagcagaagcaggccacctaccgggagaggaacaagacccggggccgcatgatcacagaaacagagaagttcagcggcgtggccggggaggcccccagcaaccccagcgtgcctgtggccgtgagcagcggccctggaagaggagatgctgacagccacgcctccatgaagagcctgctgaccagcaggcctgaggacaccacccacaacagaagaagccggggcatggtgcagagcagcagccccatcatgcccaccgtgggccccagcacagccagccctgaggagcccccaggcagcagcctgcccagcgacaccagtgatgagatcatggacctgctggtgcagagcgtgaccaagagcagcccccgggccctggccgcccgggagaggaagaggagccggggcaacaggaagagcctgcggaggaccctgaagagcggcctgggagatgacctggtgcaggccctgggcctgagcaagggccctggcctggaggtgtag

SEQ ID NO: 152805 - DNA, 4320 bp, Artificial Sequence
  Description of Artificial Sequence: Synthetic coding sequence
atggccaccctggcctgccgggtgcagttcctggatgacacagaccccttcaacagcaccaacttccctgagcccagccggcccccactcttcaccttccgggaggacctggccctgggcacccagctggccggcgtgcaccggctgctgcaggccccccacaagctggatgactgcaccctgcagctgagccacaacggggcctacctggacctggaggccaccctggccgagcagagagatgagctggagggcttccaggatgatgctggccggggcaagaagcacagcatcatcctgcggacccagctgtctgtgcgggtgcacgcctgcatcgagaagctgtacaacagcagcggccgggacctgcggcgggccctcttcagcctgaagcagatcttccaggatgacaaggacctggtgcatgaatttgtggtggccgagggcctgacctgcctgatcaaggtgggcgctgaggccgaccagaactaccagaactacatcctgcgggccctgggccagatcatgctgtatgtggatggcatgaatggagtcatcaacagaaatgagaccatccagtggctgtacaccctgattggcagcaagttccggctggtggtgaagacagccctgaagctgctgctggtgtttgtggagtacagcgagagcaatgcccccctgctgatccaggccgtgacagctgtggacaccaagaggggcgtgaagccctggagcaacatcatggagatcctggaggagaaggatggagtggacacagagctgctggtgtatgccatgaccctggtgaacaagaccctgagcggcctgcctgaccaggacaccttctatgatgtggtggactgcctggaggagctgggcattgctgctgtgtcccagaggcacctgaacaagaagggcacagacctggacctggtggagcagctgaacatctatgaggtggccctgcggcatgaagatggagatgagaccacagagcccccacccagcggctgccgggacagaagaagagcctctgtgtgcagcagcggcggcggggagcaccggggcctggacagaagaagaagcagaagacacagcgtgcagagcatcaagagcaccctgagcgcccccaccagcccctgcagccagagcgcccccagcttcaagcccaaccaggtgcgggacctgcgggagaagtacagcaactttggaaacaacagctaccacagcagccggcccagcagcggcagctctgtgcccaccacccccaccagctctgtgtccccaccccaggaggcccggctggagaggagcagccccagcggcctgctgaccagcagcttccggcagcaccaggagagcctggccgctgagcgggagcggcggcggcaggagcgggaggagcggctgcagagaattgagcgggaggagaggaacaagttcagccgggactacctggacaagcgggaggagcagaggcaggcccgggaggagcgctacaagtacctggagcagctggccgctgaggagcacgagaaggagctgcggagccgctctgtgtcccggggccgggctgacctgagcctggacctgaccagccctgctgccccagcctgcctggcccccctgagccacagccccagcagcagtgacagccaggaggccctgactgtgtctgccagcagccctggcaccccccaccacccccaggccagcgctggggaccctgagcctgagagcgaggccgagcctgaggccgaggccggggccggccaggtggctgatgaagctggccaggacatcgccagcgcccatgaaggagctgagacagaggtggagcaggccctggagcaggagcctgaggagcgggccagcctgtctgagaaggagcggcagaatgaaggagtgaatgaaagagacaactgcagcgccagctctgtgagcagcagcagcagcaccctggagcgggaggagaaggaggacaagctgagccgggacaggaccaccggcctgtggccagctggggtgcaggatgctggggtgaatggccagtgtggggacatcctgaccaacaagcgcttcatgctggacatgctgtatgcccacaacaggaagagcccagatgatgaggagaagggagatggagaggccggccgcacccagcaggaggccgaggccgtggccagcctggccacccgcatcagcaccctgcaggccaacagccagacccaggatgaatctgtgagaagagtggatgtgggctgcctggacaacagaggctctgtgaaggcctttgctgagaagttcaacagcggggacctgggccggggcagcatcagcccagatgctgagcccaatgacaaggtgcctgagacagcccctgtgcagcccaagacagaaagtgactacatctgggaccagctgatggccaacccccgggagctgcgcatccaggacatggacttcacagacctgggggaggaggatgacattgatgtgctggatgtggacctgggccaccgggaggcccctggccccccacctcctcctccacccaccttcctgggcctgcccccacctcctcctccacccctgctggacagcatccccccacctcctgtgcccggcaacctgctggtgcccccacctcctgtgttcaatgccccccagggcctgggctggagccaggtgccccggggccagcccaccttcaccaagaagaagaagaccatccgcctcttctggaatgaggtgcggccctttgactggccctgcaagaacaacagacgctgccgggagttcctgtggagcaagctggagcccatcaaggtggacaccagccggctggagcacctgtttgagagcaagagcaaggagctgtctgtgtccaagaagacagctgctgatggcaagaggcaggagatcatcgtgctggacagcaagaggagcaatgccatcaacatcggcctgactgtgctgcccccacccaggaccatcaagatcgccatcctgaactttgatgaatatgccctgaacaaggagggcatcgagaagatcctgaccatgatccccacagatgaggagaagcagaagatccaggaggcccagctggccaaccctgagatccccctgggcagcgctgagcagttcctgctgaccctgagcagcatcagcgagctgagcgcccggctgcacctgtgggccttcaagatggactatgagaccacagagaaggaggtggccgagcccctgctggacctgaaggagggcatcgaccagctggagaacaacaagaccctgggcttcatcctgagcaccctgctggccatcggcaacttcctgaatggcaccaatgccaaggcctttgagctgagctacctggagaaggtgcctgaggtgaaggacacagtgcacaagcagagcctgctgcaccacgtgtgcaccatggtggtggagaacttcccagacagcagtgacctgtacagcgagatcggggccatcaccaggtctgccaaggtggactttgaccagctgcaggacaacctgtgccagatggagcggcgctgcaaggcctcctgggaccacctgaaggccatcgccaagcatgagatgaagcctgtgctgaagcagaggatgtctgagttcctgaaggactgtgccgagcgcatcatcatcctgaagatcgtgcaccggcgcatcatcaaccgcttccacagcttcctgctcttcatgggccaccccccctatgccatccgggaggtgaacatcaacaagttctgccgcatcatcagcgagtttgccctggagtaccgcaccacccgggagcgggtgctgcagcagaagcagaagagggccaaccaccgggagaggaacaagacccggggcaagatgatcacagattctgggaagttcagcggcagcagccctgccccacccagccagccccagggcctgtcctatgcagaagatgctgctgagcacgagaacatgaaggctgtgctgaagaccagcagccccagcgtggaggatgccaccccagccctgggcgtgaggaccaggagccgggccagccggggcagcaccagctcctggaccatgggcacagatgacagccccaacgtgacagatgatgctgctgatgagatcatggaccgcatcgtgaagagcgccacccaggtgcccagccagagggtggtgccccgggagaggaagaggagccgggccaacaggaagagcctgcggaggaccctgaagagcggcctgaccccagaggaggcccgggccctgggcctggtgggcaccagcgagctgcagctgtag

SEQ ID NO: 152806 - DNA, 4269 bp, Artificial Sequence
  Description of Artificial Sequence: Synthetic coding sequence
atggccaccctggcctgccgggtgcagttcctggatgacacagaccccttcaacagcaccaacttccctgagcccagccggcccccactcttcaccttccgggaggacctggccctgggcacccagctggccggcgtgcaccggctgctgcaggccccccacaagctggatgactgcaccctgcagctgagccacaacggggcctacctggacctggaggccaccctggccgagcagagagatgagctggagggcttccaggatgatgctggccggggcaagaagcacagcatcatcctgcggacccagctgtctgtgcgggtgcacgcctgcatcgagaagctgtacaacagcagcggccgggacctgcggcgggccctcttcagcctgaagcagatcttccaggatgacaaggacctggtgcatgaatttgtggtggccgagggcctgacctgcctgatcaaggtgggcgctgaggccgaccagaactaccagaactacatcctgcgggccctgggccagatcatgctgtatgtggatggcatgaatggagtcatcaacagaaatgagaccatccagtggctgtacaccctgattggcagcaagttccggctggtggtgaagacagccctgaagctgctgctggtgtttgtggagtacagcgagagcaatgcccccctgctgatccaggccgtgacagctgtggacaccaagaggggcgtgaagccctggagcaacatcatggagatcctggaggagaaggatggagtggacacagagctgctggtgtatgccatgaccctggtgaacaagaccctgagcggcctgcctgaccaggacaccttctatgatgtggtggactgcctggaggagctgggcattgctgctgtgtcccagaggcacctgaacaagaagggcacagacctggacctggtggagcagctgaacatctatgaggtggccctgcggcatgaagatggagatgagaccacagagcccccacccagcggctgccgggacagaagaagagcctctgtgtgcagcagcggcggcggggagcaccggggcctggacagaagaagaagcagaagacacagcgtgcagagcatcaagagcaccctgagcgcccccaccagcccctgcagccagagcgcccccagcttcaagcccaaccaggtgcgggacctgcgggagaagtacagcaactttggaaacaacagctaccacagcagccggcccagcagcggcagctctgtgcccaccacccccaccagctctgtgtccccaccccaggaggcccggctggagaggagcagccccagcggcctgctgaccagcagcttccggcagcaccaggagagcctggccgctgagcgggagcggcggcggcaggagcgggaggagcggctgcagagaattgagcgggaggagaggaacaagttccgctacaagtacctggagcagctggccgctgaggagcacgagaaggagctgcggagccgctctgtgtcccggggccgggctgacctgagcctggacctgaccagccctgctgccccagcctgcctggcccccctgagccacagccccagcagcagtgacagccaggaggccctgactgtgtctgccagcagccctggcaccccccaccacccccaggccagcgctggggaccctgagcctgagagcgaggccgagcctgaggccgaggccggggccggccaggtggctgatgaggccggccaggacatcgccagcgcccacgagggcgctgagacagaggtggagcaggccctggagcaggagcctgaggagcgggccagcctgtctgagaaggagcggcagaatgaaggagtgaatgaaagagacaactgcagcgccagctctgtgagcagcagcagcagcaccctggagcgggaggagaaggaggacaagctgagccgggacaggaccaccggcctgtggccagctggggtgcaggatgctggggtgaatggccagtgtggggacatcctgaccaacaagcgcttcatgctggacatgctgtatgcccacaacaggaagagcccagatgatgaggagaagggagatggagaggccggccgcacccagcaggaggccgaggccgtggccagcctggccacccgcatcagcaccctgcaggccaacagccagacccaggatgagagcgtgcggcgggtggatgtgggctgcctggacaacagaggctctgtgaaggcctttgctgagaagttcaacagcggggacctgggccggggcagcatcagcccagatgctgagcccaatgacaaggtgcctgagacagcccctgtgcagcccaagacagaaagtgactacatctgggaccagctgatggccaacccccgggagctgcgcatccaggacatggacttcacagacctgggggaggaggatgacattgatgtgctggatgtggacctgggccaccgggaggcccctggccccccacctcctcctccacccaccttcctgggcctgcccccacctcctcctccacccctgctggacagcatccccccacctcctgtgcccggcaacctgctggtgcccccacctcctgtgttcaatgccccccagggcctgggctggagccaggtgccccggggccagcccaccttcaccaagaagaagaagaccatccgcctcttctggaatgaggtgcggccctttgactggccctgcaagaacaacagacgctgccgggagttcctgtggagcaagctggagcccatcaaggtggacaccagccggctggagcacctgtttgagagcaagagcaaggagctgtctgtgtccaagaagacagctgctgatggcaagaggcaggagatcatcgtgctggacagcaagaggagcaatgccatcaacatcggcctgactgtgctgcccccacccaggaccatcaagatcgccatcctgaactttgatgaatatgccctgaacaaggagggcatcgagaagatcctgaccatgatccccacagatgaggagaagcagaagatccaggaggcccagctggccaaccctgagatccccctgggcagcgctgagcagttcctgctgaccctgagcagcatcagcgagctgagcgcccggctgcacctgtgggccttcaagatggactatgagaccacagagaaggaggtggccgagcccctgctggacctgaaggagggcatcgaccagctggagaacaacaagaccctgggcttcatcctgagcaccctgctggccatcggcaacttcctgaatggcaccaatgccaaggcctttgagctgagctacctggagaaggtgcctgaggtgaaggacacagtgcacaagcagagcctgctgcaccacgtgtgcaccatggtggtggagaacttcccagacagcagtgacctgtacagcgagattggagccatcaccaggtctgccaaggtggactttgaccagctgcaggacaacctgtgccagatggagcggcgctgcaaggcctcctgggaccacctgaaggccatcgccaagcatgagatgaagcctgtgctgaagcagaggatgtctgagttcctgaaggactgtgccgagcgcatcatcatcctgaagatcgtgcaccggcgcatcatcaaccgcttccacagcttcctgctcttcatgggccaccccccctatgccatccgggaggtgaacatcaacaagttctgccgcatcatcagcgagtttgccctggagtaccgcaccacccgggagcgggtgctgcagcagaagcagaagagggccaaccaccgggagaggaacaagacccggggcaagatgatcacagacagcggcaagttcagcggcagcagccctgccccacccagccagccccagggcctgtcctatgcagaagatgctgctgagcacgagaacatgaaggctgtgctgaagaccagcagccccagcgtggaggatgccaccccagccctgggcgtgaggaccaggagccgggccagccggggcagcaccagctcctggaccatgggcacagatgacagccccaacgtgacagatgatgctgctgatgagatcatggacagaattgtgaagagcgccacccaggtgcccagccagagggtggtgccccgggagaggaagaggagccgggccaacaggaagagcctgcggaggaccctgaagagcggcctgaccccagaggaggcccgggccctgggcctggtgggcaccagcgagctgcagctgtag

SEQ ID NO: 152807 - DNA, 4206 bp, Artificial Sequence
  Description of Artificial Sequence: Synthetic coding sequence
atggccaccctggcctgccgggtgcagttcctggatgacacagaccccttcaacagcaccaacttccctgagcccagccggcccccactcttcaccttccgggaggacctggccctgggcacccagctggccggcgtgcaccggctgctgcaggccccccacaagctggatgactgcaccctgcagctgagccacaacggggcctacctggacctggaggccaccctggccgagcagagagatgagctggagggcttccaggatgatgctggccggggcaagaagcacagcatcatcctgcggacccagctgtctgtgcgggtgcacgcctgcatcgagaagctgtacaacagcagcggccgggacctgcggcgggccctcttcagcctgaagcagatcttccaggatgacaaggacctggtgcatgaatttgtggtggccgagggcctgacctgcctgatcaaggtgggcgctgaggccgaccagaactaccagaactacatcctgcgggccctgggccagatcatgctgtatgtggatggcatgaatggagtcatcaacagaaatgagaccatccagtggctgtacaccctgattggcagcaagttccggctggtggtgaagacagccctgaagctgctgctggtgtttgtggagtacagcgagagcaatgcccccctgctgatccaggccgtgacagctgtggacaccaagaggggcgtgaagccctggagcaacatcatggagatcctggaggagaaggatggagtggacacagagctgctggtgtatgccatgaccctggtgaacaagaccctgagcggcctgcctgaccaggacaccttctatgatgtggtggactgcctggaggagctgggcattgctgctgtgtcccagaggcacctgaacaagaagggcacagacctggacctggtggagcagctgaacatctatgaggtggccctgcggcatgaagatggagatgagaccacagagcccccacccagcggctgccgggacagaagaagagcctctgtgtgcagcagcggcggcggggagcaccggggcctggacagaagaagaagcagaagacacagcgtgcagagcatcaagagcaccctgagcgcccccaccagcccctgcagccagagcgcccccagcttcaagcccaaccaggtgcgggacctgcgggagaagagcagccccagcggcctgctgaccagcagcttccggcagcaccaggagagcctggccgctgagcgggagcggcggcggcaggagcgggaggagcggctgcagagaattgagcgggaggagaggaacaagttcagccgggactacctggacaagcgggaggagcagaggcaggcccgggaggagcgctacaagtacctggagcagctggccgctgaggagcacgagaaggagctgcggagccgctctgtgtcccggggccgggctgacctgagcctggacctgaccagccctgctgccccagcctgcctggcccccctgagccacagccccagcagcagtgacagccaggaggccctgactgtgtctgccagcagccctggcaccccccaccacccccaggccagcgctggggaccctgagcctgagagcgaggccgagcctgaggccgaggccggggccggccaggtggctgatgaagctggccaggacatcgccagcgcccatgaaggagctgagacagaggtggagcaggccctggagcaggagcctgaggagcgggccagcctgtctgagaaggagcggcagaatgaaggagtgaatgaaagagacaactgcagcgccagctctgtgagcagcagcagcagcaccctggagcgggaggagaaggaggacaagctgagccgggacaggaccaccggcctgtggccagctggggtgcaggatgctggggtgaatggccagtgtggggacatcctgaccaacaagcgcttcatgctggacatgctgtatgcccacaacaggaagagcccagatgatgaggagaagggagatggagaggccggccgcacccagcaggaggccgaggccgtggccagcctggccacccgcatcagcaccctgcaggccaacagccagacccaggatgaatctgtgagaagagtggatgtgggctgcctggacaacagaggctctgtgaaggcctttgctgagaagttcaacagcggggacctgggccggggcagcatcagcccagatgctgagcccaatgacaaggtgcctgagacagcccctgtgcagcccaagacagaaagtgactacatctgggaccagctgatggccaacccccgggagctgcgcatccaggacatggacttcacagacctgggggaggaggatgacattgatgtgctggatgtggacctgggccaccgggaggcccctggccccccacctcctcctccacccaccttcctgggcctgcccccacctcctcctccacccctgctggacagcatccccccacctcctgtgcccggcaacctgctggtgcccccacctcctgtgttcaatgccccccagggcctgggctggagccaggtgccccggggccagcccaccttcaccaagaagaagaagaccatccgcctcttctggaatgaggtgcggccctttgactggccctgcaagaacaacagacgctgccgggagttcctgtggagcaagctggagcccatcaaggtggacaccagccggctggagcacctgtttgagagcaagagcaaggagctgtctgtgtccaagaagacagctgctgatggcaagaggcaggagatcatcgtgctggacagcaagaggagcaatgccatcaacatcggcctgactgtgctgcccccacccaggaccatcaagatcgccatcctgaactttgatgaatatgccctgaacaaggagggcatcgagaagatcctgaccatgatccccacagatgaggagaagcagaagatccaggaggcccagctggccaaccctgagatccccctgggcagcgctgagcagttcctgctgaccctgagcagcatcagcgagctgagcgcccggctgcacctgtgggccttcaagatggactatgagaccacagagaaggaggtggccgagcccctgctggacctgaaggagggcatcgaccagctggagaacaacaagaccctgggcttcatcctgagcaccctgctggccatcggcaacttcctgaatggcaccaatgccaaggcctttgagctgagctacctggagaaggtgcctgaggtgaaggacacagtgcacaagcagagcctgctgcaccacgtgtgcaccatggtggtggagaacttcccagacagcagtgacctgtacagcgagatcggggccatcaccaggtctgccaaggtggactttgaccagctgcaggacaacctgtgccagatggagcggcgctgcaaggcctcctgggaccacctgaaggccatcgccaagcatgagatgaagcctgtgctgaagcagaggatgtctgagttcctgaaggactgtgccgagcgcatcatcatcctgaagatcgtgcaccggcgcatcatcaaccgcttccacagcttcctgctcttcatgggccaccccccctatgccatccgggaggtgaacatcaacaagttctgccgcatcatcagcgagtttgccctggagtaccgcaccacccgggagcgggtgctgcagcagaagcagaagagggccaaccaccgggagaggaacaagacccggggcaagatgatcacagattctgggaagttcagcggcagcagccctgccccacccagccagccccagggcctgtcctatgcagaagatgctgctgagcacgagaacatgaaggctgtgctgaagaccagcagccccagcgtggaggatgccaccccagccctgggcgtgaggaccaggagccgggccagccggggcagcaccagctcctggaccatgggcacagatgacagccccaacgtgacagatgatgctgctgatgagatcatggaccgcatcgtgaagagcgccacccaggtgcccagccagagggtggtgccccgggagaggaagaggagccgggccaacaggaagagcctgcggaggaccctgaagagcggcctgaccccagaggaggcccgggccctgggcctggtgggcaccagcgagctgcagctgtag

SEQ ID NO: 152808 - DNA, 1053 bp, Artificial Sequence
  Description of Artificial Sequence: Synthetic coding sequence
atggagaccaacagcagcctgcccaccaacatcagcggcggcaccccagctgtgtctgctggctacctgttcctggacatcatcacctacctggtgtttgctgtgacctttgtgctgggcgtgctgggcaatggcctggtgatctgggtggccggcttcaggatgacccacacagtgaccaccatctcctacctgaacctggccgtggccgacttctgcttcaccagcaccctgcccttcttcatggtgaggaaggccatgggcggccactggcccttcggctggttcctgtgcaagtttgtgttcaccatcgtggacatcaacctgtttggcagcgtcttcctgattgccctgattgccctggacagatgtgtgtgtgtgctgcaccctgtgtggacccagaaccacaggacagtgtccctggccaagaaggtgatcatcggcccctgggtgatggccctgctgctgaccctgcctgtgatcatccgggtgaccaccgtgcctgggaagacaggaacagtggcctgcaccttcaacttcagcccctggaccaatgaccccaaggagcgcatcaacgtggccgtggccatgctgactgtgcggggcatcatccgcttcatcatcggcttcagcgcccccatgagcatcgtggccgtgtcctatggcctcatcgccaccaagatccacaagcagggcctcatcaagagcagccggcccctgcgggtgctgagctttgtggccgccgccttcttcctgtgctggagcccctaccaggtggtggccctgattgccaccgtgcgcatccgggagctgctgcagggcatgtacaaggagattggaattgctgtggatgtgaccagcgccctggccttcttcaacagctgcctgaaccccatgctgtatgtgttcatgggccaggacttccgggagcggctcatccacgccctgcctgccagcctggagcgggccctgacagaggacagcacccagaccagtgacacagccaccaacagcaccctgcccagcgctgaggtggagctgcaggccaagtag

SEQ ID NO: 152809 - DNA, 1053 bp, Artificial Sequence; identical to SEQ ID NO: 152808
  Description of Artificial Sequence: Synthetic coding sequence

SEQ ID NO: 152810 - DNA, 1056 bp, Artificial Sequence
  Description of Artificial Sequence: Synthetic coding sequence
atggagaccaacttcagcacccccctgaatgaatatgaggaggtgtcctatgaatctgctggctacacagtgctgcgcatcctgcccctggtggtgctgggcgtgacctttgtgctgggcgtgctgggcaatggcctggtgatctgggtggccggcttcaggatgaccaggacagtgaccaccatctgctacctgaacctggccctggccgacttctccttcaccgccaccctgcccttcctgattgtgtccatggccatgggagagaagtggcccttcggctggttcctgtgcaagctgatccacatcgtggtggacatcaacctgtttggcagcgtcttcctgattggcttcatcgccctggaccgctgcatctgtgtgctgcaccctgtgtgggcccagaaccacaggacagtgtccctggccatgaaggtgattgtgggcccctggatcctggccctggtgctgaccctgcctgtgttcctgttcctgaccaccgtgaccatccccaatggagacacctactgcaccttcaactttgcctcctggggcggcaccccagaggagcggctgaaggtggccatcaccatgctgacagcccggggcatcatccgcttcgtcatcggcttcagcctgcccatgagcatcgtggccatctgctacggcctgattgctgccaagatccacaagaagggcatgatcaagagcagccggcccctgcgggtgctgacagctgtggtggccagcttcttcatctgctggttccccttccagctggtggccctgctgggcaccgtgtggctgaaggagatgctgttctacggcaagtacaagatcatcgacatcctggtgaaccccaccagcagcctggccttcttcaacagctgcctgaaccccatgctgtatgtgtttgtgggccaggacttccgggagcggctcatccacagcctgcccaccagcctggagcgggccctgtctgaagattctgcccccaccaatgacacagctgccaacagcgccagccccccagctgagacagagctgcaggccatgtag

SEQ ID NO: 152811 - DNA, 1056 bp, Artificial Sequence; identical to SEQ ID NO: 152810
  Description of Artificial Sequence: Synthetic coding sequence

SEQ ID NO: 152812 - DNA, 1062 bp, Artificial Sequence
  Description of Artificial Sequence: Synthetic coding sequence
atggagaccaacttcagcatccccctgaatgaaacagaggaggtgctgcctgagcccgccggccacacagtgctgtggatcttcagcctgctggtgcatggagtgacctttgtgtttggagtgctgggcaatggcctggtgatctgggtggccggcttcaggatgaccaggacagtgaacaccatctgctacctgaacctggccctggccgacttctccttcagcgccatcctgcccttcaggatggtgtctgtggccatgagggagaagtggcccttcggcagcttcctgtgcaagctggtgcacgtgatgattgacatcaacctgtttgtgtctgtgtacctgatcaccatcatcgccctggaccgctgcatctgtgtgctgcacccagcctgggcccagaaccacaggaccatgagcctggccaagagggtgatgacaggcctgtggatcttcaccatcgtgctgaccctgcccaacttcatcttctggaccaccatcagcaccaccaatggagacacctactgcatcttcaactttgccttctggggagacacagctgtggagcggctgaatgtgttcatcaccatggccaaggtgttcctgatcctgcacttcatcatcggcttctctgtgcccatgagcatcatcaccgtgtgctacggcatcatcgccgccaagatccacaggaaccacatgatcaagagcagccggcccctgcgggtgtttgctgctgtggtggccagcttcttcatctgctggttcccctatgagctgattggcatcctgatggctgtgtggctgaaggagatgctgctgaatggcaagtacaagatcatcctggtgctgatcaaccccaccagcagcctggccttcttcaacagctgcctgaaccccatcctgtatgtgttcatgggcaggaacttccaggagcggctcatccgcagcctgcccaccagcctggagcgggccctgacagaggtgcctgattctgcccagaccagcaacacagacaccaccagcgccagccccccagaggagacagagctgcaggccatgtag

SEQ ID NO: 152813 - DNA, 816 bp, Artificial Sequence
  Description of Artificial Sequence: Synthetic coding sequence
atgttccgggactttggagagcccggccccagcagtggaaatggaggcggctacggcggccctgcccagcccccagctgctgcccaggccgcccagcagaagttccacctggtgcccagcatcaacaccatgagcggcagccaggagctgcagtggatggtgcagccccacttcctgggccccagcagctacccccggcccctgacctacccccagtacagccccccccagcccaggcctggggtcatccgggccctgggccccccacctggggtgagaagaagaccctgtgagcagatcagccctgaggaggaggagcggcggcgggtgagaagagagaggaacaagctggccgccgccaagtgcaggaacagaaggaaggagctgacagacttcctgcaggccgagacagacaagctggaggatgagaagagcggcctgcagcgggagattgaggagctgcagaagcagaaggagcggctggagctggtgctggaggcccaccggcccatctgcaagatccctgagggcgccaaggagggggacaccggcagcaccagcggcaccagcagccccccagccccctgcaggcctgtgccctgcatcagcctgagccctggccctgtgctggagcctgaggccctgcacacccccaccctgatgaccacccccagcctgacccccttcacccccagcctggtgttcacctaccccagcaccccagagccctgtgccagcgcccacaggaagagcagcagcagcagcggggaccccagcagtgaccccctgggcagccccaccctgctggccctgtag

SEQ ID NO: 152814 - DNA, 510 bp, Artificial Sequence
  Description of Artificial Sequence: Synthetic coding sequence
atgttccgggactttggagagcccggccccagcagtggaaatggaggcggctacggcggccctgcccagcccccagctgctgcccaggccgcccagcaggagacagacaagctggaggatgagaagagcggcctgcagcgggagattgaggagctgcagaagcagaaggagcggctggagctggtgctggaggcccaccggcccatctgcaagatccctgagggcgccaaggagggggacaccggcagcaccagcggcaccagcagccccccagccccctgcaggcctgtgccctgcatcagcctgagccctggccctgtgctggagcctgaggccctgcacacccccaccctgatgaccacccccagcctgacccccttcacccccagcctggtgttcacctaccccagcaccccagagccctgtgccagcgcccacaggaagagcagcagcagcagcggggaccccagcagtgaccccctgggcagccccaccctgctggccctgtag

SEQ ID NO: 152815 - DNA, 351 bp, Artificial Sequence
  Description of Artificial Sequence: Synthetic coding sequence
atgttccgggactttggagagcccggccccagcagtggaaatggaggcggctacggcggccctgcccagcccccagctgctgcccaggccgcccagcagaagttccacctggtgcccagcatcaacaccatgagcggcagccaggagctgcagtggatggtgcagccccacttcctgggccccagcagctacccccggcccctgacctacccccagtacagccccccccagcccaggcctggggtcatccgggccctgggccccccacctggggtgagaagaagaccctgtgagcagatcagccctgaggaggaggagagctggcagccccgggactttgtggacccctag

SEQ ID NO: 152816 - DNA, 981 bp, Artificial Sequence
  Description of Artificial Sequence: Synthetic coding sequence
atgtaccaggactacccaggcaactttgacaccagcagccggggcagcagcggcagccctgcccatgctgagagctacagcagcggcggcggcggccagcagaagttccgggtggacatgcctggcagcggcagcgccttcatccccaccatcaatgccatcaccaccagccaggacctgcagtggatggtgcagcccaccgtcatcacctccatgagcaacccctaccccaggagccacccctacagccccctgcccggcctggcctctgtgcccggccacatggccctgcccaggcctggggtcatcaagaccatcggcaccaccgtgggcagaagaagaagagatgagcagctgagccctgaggaggaggagaagaggcgcatccggcgggagaggaacaagctggccgccgccaagtgcaggaacagaagaagagagctgacagagaagctgcaggccgagacagaggagctggaggaggagaagagcggcctgcagaaggagattgctgagctgcagaaggagaaggagaagctggagttcatgctggtggcccacggccctgtgtgcaagatcagccctgaggagcggcgcagccccccagcccctggcctgcagcccatgaggtctgggggcggctctgtgggcgctgtggtggtgaagcaggagcccctggaggaggacagccccagcagcagcagcgctggcctggacaaggcccagaggagcgtcatcaagcccatcagcattgctgggggcttctacggggaggagcccctgcacacccccatcgtggtgaccagcaccccagctgtgaccccaggcaccagcaacctggtgttcacctaccccagcgtgctggagcaggagagccctgccagccccagcgagagctgcagcaaggcccacagaagaagcagcagcagcggggaccagagcagtgacagcctgaacagccccaccctgctggccctgtag

SEQ ID NO: 152817 - DNA, 864 bp, Artificial Sequence
  Description of Artificial Sequence: Synthetic coding sequence
atgcctggcagcggcagcgccttcatccccaccatcaatgccatcaccaccagccaggacctgcagtggatggtgcagcccaccgtcatcacctccatgagcaacccctaccccaggagccacccctacagccccctgcccggcctggcctctgtgcccggccacatggccctgcccaggcctggggtcatcaagaccatcggcaccaccgtgggcagaagaagaagagatgagcagctgagccctgaggaggaggagaagaggcgcatcagaagagagaggaacaagctggccgccgccaagtgcaggaacagaagaagagagctgacagagaagctgcaggccgagacagaggagctggaggaggagaagagcggcctgcagaaggagattgctgagctgcagaaggagaaggagaagctggagttcatgctggtggcccacggccctgtgtgcaagatcagccctgaggagaggaggagccccccagcccctggcctgcagcccatgaggtctgggggcggctctgtgggcgctgtggtggtgaagcaggagcccctggaggaggacagccccagcagcagcagcgctggcctggacaaggcccagaggagcgtcatcaagcccatcagcattgctgggggcttctatggagaggagcccctgcacacccccatcgtggtgaccagcaccccagctgtgaccccaggcaccagcaacctggtgttcacctaccccagcgtgctggagcaggagagccctgccagccccagcgagagctgcagcaaggcccaccggcgcagcagcagcagcggggaccagagcagtgacagcctgaacagccccaccctgctggccctgtag

SEQ ID NO: 152818 - DNA, 972 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactactgtgtggactgctacaagaactttgtggccaagaagtgtgccggctgcaagaaccccatcaccgggaagaggacagtgtcccgggtgagccaccctgtgtccaaggccaggaagccccctgtgtgccacggcaagaggctgcccctgaccctcttccccagcgccaacctgcggggccgccaccctggaggagagaggacctgccccagctgggtggtggtgctgtacaggaagaacagaagcctggccgccccccggggccctggcctggtgaaggcccctgtgtggtggcccatgaaggacaaccctggcaccaccacagccagcacagccaagaatgccccctag

SEQ ID NO: 152819 - DNA, 774 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactactgtgtggactgctacaagaactttgtggccaagaagtgtgccggctgcaagaaccccatcactggatttgggaagggcagctctgtggtggcctatgagggccagagctggcatgactactgcttccactgcaagaagtgcagcgtgtag

SEQ ID NO: 152820 - DNA, 633 bp, Artificial Sequence
  Description of Artificial Sequence: Synthetic coding sequence
atggccagccaccgccacagcggccccagcagctacaaggtgggcaccatggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaagggcctggtgaaggcccctgtgtggtggcccatgaaggacaaccctggcaccaccacagccagcacagccaagaatgccccctag

SEQ ID NO: 152821 - DNA, 891 bp, Artificial Sequence
  Description of Artificial Sequence: Synthetic coding sequence
atggccagccaccgccacagcggccccagcagctacaaggtgggcaccatggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactactgtgtggactgctacaagaactttgtggccaagaagtgtgccggctgcaagaaccccatcactggatttgggaagggcagctctgtggtggcctatgagggccagagctggcatgactactgcttccactgcaagaagtgcagcgtgaacctggccaacaagagatttgtgttccaccaggagcaggtgtactgcccagactgtgccaagaagctgtag

SEQ ID NO: 152822 - DNA, 843 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactactgtgtggactgctacaagaactttgtggccaagaagtgtgccggctgcaagaaccccatcactggatttgggaagggcagctctgtggtggcctatgagggccagagctggcatgactactgcttccactgcaagaagtgcagcgtgaacctggccaacaagagatttgtgttccaccaggagcaggtgtactgcccagactgtgccaagaagctgtag

SEQ ID NO: 152823 - DNA, 843 bp, Artificial Sequence; identical to SEQ ID NO: 152822
  Description of Artificial Sequence: Synthetic coding sequence

SEQ ID NO: 152824 - DNA, 972 bp, Artificial Sequence; identical to SEQ ID NO: 152818
  Description of Artificial Sequence: Synthetic coding sequence

SEQ ID NO: 152825 - DNA, 615 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggagtag

SEQ ID NO: 152826 - DNA, 624 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactag

SEQ ID NO: 152827 - DNA, 426 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttctag

SEQ ID NO: 152828 - DNA, 624 bp, Artificial Sequence; identical to SEQ ID NO: 152826
  Description of Artificial Sequence: Synthetic coding sequence

SEQ ID NO: 152829 - DNA, 963 bp, Artificial Sequence
  Description of Artificial Sequence: Synthetic coding sequence
atgagccacttcatcctgcggcacctgggcagctgcttccagccctacccagcctttgctgagtacatcctgagcgccacccacccagccagcggccccagcagctacaaggtgggcaccatggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactactgtgtggactgctacaagaactttgtggccaagaagtgtgccggctgcaagaaccccatcactggatttgggaagggcagctctgtggtggcctatgagggccagagctggcatgactactgcttccactgcaagaagtgcagcgtgaacctggccaacaagagatttgtgttccaccaggagcaggtgtactgcccagactgtgccaagaagctgtag

SEQ ID NO: 152830 - DNA, 618 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggactag

SEQ ID NO: 152831 - DNA, 468 bp, Artificial Sequence
  Description of Artificial Sequence: Synthetic coding sequence
atggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagtag

SEQ ID NO: 152832 - DNA, 843 bp, Artificial Sequence; identical to SEQ ID NO: 152822
  Description of Artificial Sequence: Synthetic coding sequence

SEQ ID NO: 152833 - DNA, 783 bp, Artificial Sequence
  Description of Artificial Sequence: Synthetic coding sequence
atggccgagaagtttgactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggcaccggcagcttcttccccaagggggaggacttctactgtgtgacctgccacgagaccaagtttgccaagcactgtgtgaagtgcaacaaggccatcaccagcggcggcatcacctaccaggaccagccctggcatgctgactgctttgtgtgtgtgacctgcagcaagaagctggccggccagcgcttcaccgctgtggaggaccagtactactgtgtggactgctacaagaactttgtggccaagaagtgtgccggctgcaagaaccccatcactggatttgggaagggcagctctgtggtggcctatgagggccagagctggcatgactactgcttccactgcaagaagtgcagcgtgaacctggccaacaagagatttgtgttccaccaggagcaggtgtactgcccagactgtgccaagaagctgtag

SEQ ID NO: 152834 - DNA, 930 bp, Artificial Sequence
  Description of Artificial Sequence: Synthetic coding sequence
atgaccttctacgtggccagcctggccctggagctgatctggatgctgagcagccctgctggccccagcagctacaaggtgggcaccatggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcctgcaccccctggccaatgagacctttgtggccaaggacaacaagatcctgtgcaacaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggaacaggcagcttcttccccaagggggaggacttctactgtgtgacctgccacgagaccaagtttgccaagcactgtgtgaagtgcaacaaggccatcaccagcggcggcatcacctaccaggaccagccctggcacgccgactgctttgtgtgtgtgacctgcagcaagaagctggccggccagcgcttcaccgctgtggaggaccagtactactgtgtggactgctacaagaactttgtggccaagaagtgtgccggctgcaagaaccccatcaccggctttgggaagggcagctctgtggtggcctatgagggccagagctggcatgactactgcttccactgcaagaagtgcagcgtgaacctggccaacaagagatttgtgttccaccaggagcaggtgtactgcccagactgtgccaagaagctgtag

SEQ ID NO: 152835 - DNA, 828 bp, Artificial Sequence
  Description of Artificial Sequence: Synthetic coding sequence
atggccagccaccgccacagcggccccagcagctacaaggtgggcaccatggccgagaagtttgactgccactactgccgggaccccctgcagggcaagaagtatgtgcagaaggatggccaccactgctgcctgaagtgctttgacaagttctgtgccaacacctgtgtggagtgcaggaagcccatcggggctgacagcaaggaggtgcactacaagaaccgcttctggcatgacacctgcttccgctgtgccaagtgcaccacccgggaggacagccccaagtgcaagggctgcttcaaggccatcgtggccggggaccagaatgtggagtacaagggcaccgtgtggcacaaggactgcttcacctgcagcaactgcaagcaggtgattggaacaggcagcttcttccccaagggggaggacttctactgtgtgacctgccacgagaccaagtttgccaagcactgtgtgaagtgcaacaaggccatcaccagcggcggcatcacctaccaggaccagccctggcacgccgactgctttgtgtgtgtgacctgcagcaagaagctggccggccagcgcttcaccgctgtggaggaccagtactactgtgtggactgctacaagaactttgtggccaagaagtgtgccggctgcaagaaccccatcaccggctttgggaagggcagctctgtggtggcctatgagggccagagctggcatgactactgcttccactgcaagaagtgcagcgtgaacctggccaacaagagatttgtgttccaccaggagcaggtgtactgcccagactgtgccaagaagctgtag

SEQ ID NO: 152836 - DNA, 843 bp, Artificial Sequence; identical to SEQ ID NO: 152822
  Description of Artificial Sequence: Synthetic coding sequence

SEQ ID NO: 152837 - DNA, 840 bp, Artificial Sequence
  Description of Artificial Sequence: Synthetic coding sequence
atgacagaaagatttgactgccaccactgcaatgaaagcctgtttgggaagaagtacatcctgcgggaggagagcccctactgtgtggtgtgctttgagaccctgtttgccaacacctgtgaggagtgtgggaagcccatcggctgtgactgcaaggacctgagctacaaggacagacactggcatgaggcctgcttccactgcagccagtgcaggaacagcctggtggacaagccctttgctgccaaggaggaccagctgctgtgcacagactgctacagcaatgagtacagcagcaagtgccaggagtgcaagaagaccatcatgcctggcaccaggaagatggagtacaagggcagctcctggcatgagacctgcttcatctgccaccgctgccagcagcccatcggcaccaagagcttcatccccaaggacaaccagaacttctgtgtgccctgctatgagaagcagcacgccatgcagtgtgtgcagtgcaagaagcccatcaccactggaggagtgacctaccgggagcagccctggcacaaggagtgctttgtgtgcacagcctgcaggaagcagctgagcggccagcgcttcaccgccagagatgactttgcctactgcctgaactgcttctgtgacctgtatgccaagaagtgtgccggctgcaccaaccccatcagcggcctgggcggcaccaagtacatcagctttgaggagcggcagtggcacaatgactgcttcaactgcaagaagtgcagcctgagcctggtgggccggggcttcctgacagaaagagatgacatcctgtgcccagactgtgggaaggacatctag

SEQ ID NO: 152838 - DNA, 456 bp, Artificial Sequence
  Description of Artificial Sequence: Synthetic coding sequence
atgacagaaagatttgactgccaccactgcaatgaaagcctgtttgggaagaagtacatcctgcgggaggagagcccctactgtgtggtgtgctttgagaccctgtttgccaacacctgtgaggagtgtgggaagcccatcggctgtgactgcaaggtgcctgcccgctggagcaccagggctgctgctggcatgaggcctgccagcagcgccacagctgccagcagccagctggagccccgggtgagcagccccaagaccatccgcatctctgtgtgcccagccatgaggaacaacatgccctgcagcgccttcagcgccaagagccccagcccccgggagggcagcctgaccggcagcagccctggcaccaggtctgccagctgtgcccctcctgctggcagcagctgcctgggcagcgccagccagctggccatgaccctgcccacagcctag

SEQ ID NO: 152839 - DNA, 1170 bp, Artificial Sequence
  Description of Artificial Sequence: Synthetic coding sequence
atgacccggcggggcttcagcagagctggagctgcccagaggagcaccaggcctgctgctgagccccagcccccagctgcccgggccctgcagcccaggcctggggtgcccggccccctgcgctgccgggagtacctgcagcccccagccccccggcgggaggccgagggcctgagccaccagggcagcgaggtgggcgctgagagcggggcccggcccaaggagagaggagctgagcctgagctgggccgcctgtggctgaggacagtgtcctcctggaggctgggctggcactttgattttggagtggccgagaagccaggagtgaagatgacagaaagatttgactgccaccactgcaatgaaagcctgtttgggaagaagtacatcctgcgggaggagagcccctactgtgtggtgtgctttgagaccctgtttgccaacacctgtgaggagtgtgggaagcccatcggctgtgactgcaaggacctgagctacaaggacagacactggcatgaggcctgcttccactgcagccagtgcaggaacagcctggtggacaagccctttgctgccaaggaggaccagctgctgtgcacagactgctacagcaatgagtacagcagcaagtgccaggagtgcaagaagaccatcatgcctggcaccaggaagatggagtacaagggcagctcctggcatgagacctgcttcatctgccaccgctgccagcagcccatcggcaccaagagcttcatccccaaggacaaccagaacttctgtgtgccctgctatgagaagcagcacgccatgcagtgtgtgcagtgcaagaagcccatcaccactggaggagtgacctaccgggagcagccctggcacaaggagtgctttgtgtgcacagcctgcaggaagcagctgagcggccagcgcttcaccgccagagatgactttgcctactgcctgaactgcttctgtgacctgtatgccaagaagtgtgccggctgcaccaaccccatcagcggcctgggcggcaccaagtacatcagctttgaggagcggcagtggcacaatgactgcttcaactgcaagaagtgcagcctgagcctggtgggccggggcttcctgacagaaagagatgacatcctgtgcccagactgtgggaaggacatctag

SEQ ID NO: 152840 - DNA, 840 bp, Artificial Sequence; identical to SEQ ID NO: 152837
  Description of Artificial Sequence: Synthetic coding sequence

SEQ ID NO: 152841 - DNA, 840 bp, Artificial Sequence; identical to SEQ ID NO: 152837
  Description of Artificial Sequence: Synthetic coding sequence

SEQ ID NO: 152842 - DNA, 840 bp, Artificial Sequence; identical to SEQ ID NO: 152837
  Description of Artificial Sequence: Synthetic coding sequence

SEQ ID NO: 152843 - DNA, 840 bp, Artificial Sequence; identical to SEQ ID NO: 152837
  Description of Artificial Sequence: Synthetic coding sequence

SEQ ID NO: 152844 - DNA, 840 bp, Artificial Sequence; identical to SEQ ID NO: 152837
  Description of Artificial Sequence: Synthetic coding sequence

SEQ ID NO: 152845 - DNA, 840 bp, Artificial Sequence; identical to SEQ ID NO: 152837
  Description of Artificial Sequence: Synthetic coding sequence

SEQ ID NO: 152846 - DNA, 60 bp, Artificial Sequence
  Description of Artificial Sequence: Synthetic coding sequence
atgacagaaagatttgactgccaccactgcaatgaaagcctgtttgggaagaagtactag

SEQ ID NO: 152847 - DNA, 435 bp, Artificial Sequence
  Description of Artificial Sequence: Synthetic coding sequence
atgacccggcggggcttcagcagagctggagctgcccagaggagcaccaggcctgctgctgagccccagcccccagctgcccgggccctgcagcccaggcctggggtgcccggccccctgcgctgccgggagtacctgcagcccccagccccccggcgggaggccgagggcctgagccaccagggcagcgaggtgggcgctgagagcggggcccggcccaaggagagaggagctgagcctgagctgggccgcctgtggctgaggacagtgtcctcctggaggctgggctggcactttgattttggaacagagagcagatttgtggcccaggccggcgtgcagtggcatgacctgagcagcctgcaggccctgcccctgggcagccgccacagccctgccccagccagccaggtggccggcaccaccggctgctag

SEQ ID NO: 152848 - DNA, 843 bp, Artificial Sequence
  Description of Artificial Sequence: Synthetic coding sequence
atgtctgagagctttgactgtgccaagtgcaatgaaagcctgtatggcaggaagtacatccagacagacagcggcccctactgtgtgccctgctatgacaacacctttgccaacacctgtgccgagtgccagcagctgattggacatgacagccgggagctgttctatgaagatagacacttccacgagggctgcttccgctgctgccgctgccagaggagcctggctgatgagcccttcacctgccaggacagcgagctgctgtgcaatgactgctactgcagcgccttcagcagccagtgcagcgcctgtggggagaccgtgatgcctggcagcaggaagctggagtatggaggccagacctggcatgagcactgcttcctgtgcagcggctgtgagcagcccctgggcagccgcagctttgtgcctgacaagggggcccactactgtgtgccctgctatgagaacaagtttgccccccgctgtgcccgctgcagcaagaccctgacccagggcggcgtgacctacagagaccagccctggcaccgggagtgcctggtgtgcaccggctgccagacccccctggccggccagcagttcaccagcagagatgaggacccctactgtgtggcctgctttggagagctgtttgcccccaagtgcagcagctgcaagaggcccatcgtgggcctgggcggcggcaagtatgtgtcctttgaggacagacactggcaccacaactgcttcagctgtgcccgctgcagcaccagcctggtgggccagggctttgtgcctgatggagaccaggtgctgtgccagggctgcagccaggccggcccctag

SEQ ID NO: 152849 - DNA, 855 bp, Artificial Sequence
  Description of Artificial Sequence: Synthetic coding sequence
atgaccacagcccacttctactgccagtactgcacagccagcctgctgggcaagaagtatgtgctgaaggatgacagcccctactgtgtgacctgctatgacagagtcttcagcaactactgtgaggagtgcaagaagcccatcgagagtgacagcaaggacctgtgctacaaggacagacactggcatgagggctgcttcaagtgcaccaagtgcaaccacagcctggtggagaagccctttgctgccaaggatgagcggctgctgtgcacagagtgctacagcaatgaatgtagcagcaagtgcttccactgcaagaggaccatcatgcctggcagcaggaagatggagttcaagggcaactactggcatgagacctgctttgtgtgtgagaactgccggcagcccatcggcaccaagcccctcatcagcaaggagagcggcaactactgtgtgccctgctttgagaaggagtttgcccactactgcaacttctgcaagaaggtgatcaccagcggcggcatcaccttctgtgaccagctgtggcacaaggagtgcttcctgtgcagcggctgcaggaaggacctgtgtgaggagcagttcatgagcagagatgactaccccttctgtgtggactgctacaaccacctgtatgccaacaagtgtgtggcctgcagcaagcccatcagcggcctgactggagccaagttcatctgcttccaggacagccagtggcacagcgagtgcttcaactgtgggaagtgcagcgtgtccctggtgggcaagggcttcctgacccagaacaaggagatcttctgccagaagtgtggcagcggcatggacacagacatctag

SEQ ID NO: 152850 - DNA, 633 bp, Artificial Sequence
  Description of Artificial Sequence: Synthetic coding sequence
atgaccacagcccacttctactgccagtactgcacagccagcctgctgggcaagaagtatgtgctgaaggatgacagcccctactgtgtgacctgctatgacagagtcttcagcaactactgtgaggagtgcaagaagcccatcgagagtgacagcaaggacctgtgctacaaggacagacactggcatgagggctgcttcaagtgcaccaagtgcaaccacagcctggtggagaagccctttgctgccaaggatgagcggctgctgtgcacagagtgctacagcaatgaatgtagcagcaagtgcttccactgcaagaggaccatcatgcctggcagcaggaagatggagttcaagggcaactactggcatgagacctgctttgtgtgtgagaactgccggcagcccatcggcaccaagcccctcatcagcaaggagagcggcaactactgtgtgccctgctttgagaaggagtttgcccactactgcaacttctgcaagaaggtgatcaccagcggcggcatcaccttctgtgaccagctgtggcacaaggagtgcttcctgtgcagcggctgcaggaaggacctgtgtgaggagcagttcatgagcagagatgactaccccttctgctag

SEQ ID NO: 152851 - DNA, 855 bp, Artificial Sequence; identical to SEQ ID NO: 152849
  Description of Artificial Sequence: Synthetic coding sequence

SEQ ID NO: 152852 - DNA, 1314 bp, Artificial Sequence
  Description of Artificial Sequence: Synthetic coding sequence
atgggccgcaggatgagaggagctgctgccacagctggcctgtggctgctggccctgggcagcctgctggccctgtggggcggcctgctgccccccaggacagagctgcctgccagccggcccccagaagatcggctgccccggcggcctgcccggagcggcggccctgccccagccccccgcttccccctgcccccacccctggcctgggatgcccggggcggcagcctgaagaccttccgggccctgctgaccctggccgccggggctgatggccccccccggcagagccgctctgagccccgctggcacgtgtctgcccggcagcccaggcctgaggagagcgctgctgtgcatggaggagtcttctggagccggggcctggaggagcaggtgcccccaggcttcagcgaggcccaggccgccgcctggctggaggccgcccggggggccaggatggtggccctggagcggggcggctgcggccgcagcagcaaccggctggccaggtttgctgatggcacccgggcctgtgtgcgctatggcatcaaccctgagcagatccagggcgaggccctgagctactacctggcccggctgctgggcctgcagagacatgtgccccccctggccctggcccgggtggaggcccggggggcccagtgggcccaggtgcaggaggagctgcgggccgcccactggacagagggctctgtggtgtccctgacccgctggctgcccaacctgacagatgtggtggtgcctgccccctggaggagtgaagatggccgcctgcggcccctgagagatgctggaggagagctggccaacctgagccaggccgagctggtggacctggtgcagtggacagacctgatcctgtttgactacctgacagccaactttgaccggctggtgagcaacctcttcagcctgcagtgggacccccgggtgatgcagagggccaccagcaacctgcaccggggccctgggggcgccctggtgttcctggacaatgaagctggcctggtgcacggctacagagtggccggcatgtgggacaagtacaatgagcccctgctgcagagcgtgtgtgtgttccgggagaggacagccaggagagtgctggagctgcaccggggccaggatgctgctgcccggctgctgcggctgtacagaagacatgagccccgcttccctgagctggccgccctggccgacccccacgcccagctgctgcagaggcggctggacttcctggccaagcacatcctgcactgcaaggccaagtatggaagaagaagtggcacctag

SEQ ID NO: 152853 - DNA, 312 bp, Artificial Sequence
  Description of Artificial Sequence: Synthetic coding sequence
atggagcggcagcagcagcagcagcagcagctgaggaacctgcgggacttcctgctggtgtacaacaggatgacagagctgtgcttccagagatgtgtgcccagcctgcaccaccgggccctggatgctgaggaggaggcctgcctgcacagctgtgccggcaagctgatccacagcaaccaccggctgatggccgcctacgtgcagctgatgcctgccctggtgcagaggagaattgctgactatgaggccgccagcgctgtgcctggggtggccgctgagcagcccggggtgagccccagcggcagctag

SEQ ID NO: 152854 - DNA, 312 bp, Artificial Sequence; identical to SEQ ID NO: 152853
  Description of Artificial Sequence: Synthetic coding sequence

SEQ ID NO: 152855 - DNA, 312 bp, Artificial Sequence; identical to SEQ ID NO: 152853
  Description of Artificial Sequence: Synthetic coding sequence

SEQ ID NO: 152856 - DNA, 948 bp, Artificial Sequence
  Description of Artificial Sequence: Synthetic coding sequence
atgcacggccacggcggctatgacagcgacttcagtgatgatgagcgctgtggggagagcagcaagaggaagaagaggacagtggaggatgacctgctgctgcagaagcccttccagaaggagaagcacggcaaggtggcccacaagcaggtggccgctgagctgctggaccgggaggaggccaggaacagacgcttccacctgattgccatggatgcctaccagaggcacaccaagtttgtgaatgactacatcctgtactacggcggcaagaaggaggacttcaagaggctgggggagaatgacaagacagacctggatgtgatccgggagaaccaccgcttcctgtggaatgaggaggatgagatggacatgacctgggagaagaggctggccaagaagtactatgacaagctgttcaaggagtactgcatcgctgacctgagcaagtacaaggagaacaagtttggcttccgctggagggtggagaaggaggtgatcagcggcaagggccagttcttctgtggcaacaagtactgtgacaagaaggagggcctgaagtcctgggaggtgaactttggctacatcgagcacggggagaagagaaatgccctggtgaagctgcggctgtgccaggagtgcagcatcaagctgaacttccaccacaggaggaaggagatcaagagcaagaagaggaaggacaagaccaagaaggactgtgaggagagcagccacaagaagagccggctgagcagcgctgaggaggccagcaagaagaaggacaagggccacagcagcagcaagaagtctgaggacagcctgctgaggaacagtgatgaggaggagagcgccagcgagagcgagctgtggaagggccccctgcctgagacagatgagaagagccaggaggaggagtttgatgagtacttccaggacctcttcctgtag

SEQ ID NO: 152857 - DNA, 948 bp, Artificial Sequence
  Description of Artificial Sequence: Synthetic coding sequence
atgcacggccacggcggctatgacagcgacttcagtgatgatgagcgctgtggggagagcagcaagaggaagaagaggacagtggaggatgacctgctgctgcagaagcccttccagaaggagaagcacggcaaggtggcccacaagcaggtggccgctgagctgctggaccgggaggaggccaggaacagacgcttccacctgattgccatggatgcctaccagaggcacaccaagtttgtgaatgactacatcctgtactacggcggcaagaaggaggacttcaagaggctgggggagaatgacaagacagacctggatgtgatccgggagaaccaccgcttcctgtggaatgaggaggatgagatggacatgacctgggagaagaggctggccaagaagtactatgacaagctgttcaaggagtactgcatcgctgacctgagcaagtacaaggagaacaagtttggcttccgctggagggtggagaaggaggtgatcagcggcaagggccagttcttctgtggcaacaagtactgtgacaagaaggagggcctgaagtcctgggaggtgaactttggctacatcgagcacggggagaagagaaatgccctggtgaagctgcggctgtgccaggagtgcagcatcaagctgaacttccaccacaggaggaaggagatcaagagcaagaagaggaaggacaagaccaagaaggactgtgaggagagcagccacaagaagagccggctgagcagcgctgaggaggccagcaagaagaaggacaagggccacagcagcagcaagaagtctgaggacagcctgctgcggaggatgctggaggagctgcagatgttcacctgggagaagtctgagaggatgggcggcaagaggctcatcatcatcatcggggaggagctgagcgccaacgtgaccaccttcaagatgtag

SEQ ID NO: 152858 - DNA, 942 bp, Artificial Sequence
  Description of Artificial Sequence: Synthetic coding sequence
atgcacggccacggcggctatgacagcgacttcagtgatgatgagcgctgtggggagagcagcaagaggaagaagaggacagtggaggatgacctgctgctgcagaagcccttccagaaggagaagcacggcaaggtggcccacaagcaggtggccgctgagctgctggaccgggaggaggccaggaacagacgcttccacctgattgccatggatgcctaccagaggcacaccaagtttgtgaatgactacatcctgtactacggcggcaagaaggaggacttcaagaggctgggggagaatgacaagacagacctggatgtgatccgggagaaccaccgcttcctgtggaatgaggaggatgagatggacatgacctgggagaagaggctggccaagaagtactatgacaagctgttcaaggagtactgcatcgctgacctgagcaagtacaaggagaacaagtttggcttccgctggagggtggagaaggaggtgatcagcggcaagggccagttcttctgtggcaacaagtactgtgacaagaaggagggcctgaagtcctgggaggtgaactttggctacatcgagcacggggagaagagaaatgccctggtgaagctgcggctgtgccaggagtgcagcatcaagctgaacttccaccacaggaggaaggagatcaagagcaagaagaggaaggacaagaccaagaaggactgtgaggagagcagccacaagaagagccggctgagcagcgctgaggaggccagcaagaagaaggacaagggccacagcagcagcaagaagtctgaggacagcctgctgaatggagtgatgctgttccaccctggctggagcgctgtggcccggagccagctgacagctgccccagccagccaggtgcagaccaacaaccactactggaggggcgtggtgtgctag

SEQ ID NO: 152859 - DNA, 879 bp, Artificial Sequence
  Description of Artificial Sequence: Synthetic coding sequence
atgcacggccacggcggctatgacagcgacttcagtgatgatgagcgctgtggggagagcagcaagaggaagaagaggacagtggaggatgacctgctgctgcagaagcccttccagaaggagaagcacggcaaggtggcccacaagcaggtggccgctgagctgctggaccgggaggaggccaggaacagacgcttccacctgattgccatggatgcctaccagaggcacaccaagtttgtgaatgactacatcctgtactacggcggcaagaaggaggacttcaagaggctgggggagaatgacaagacagacctggatgtgatccgggagaaccaccgcttcctgtggaatgaggaggatgagatggacatgacctgggagaagaggctggccaagaagtactatgacaagctgttcaaggagtactgcatcgctgacctgagcaagtacaaggagaacaagtttggcttccgctggagggtggagaaggaggtgatcagcggcaagggccagttcttctgtggcaacaagtactgtgacaagaaggagggcctgaagtcctgggaggtgaactttggctacatcgagcacggggagaagagaaatgccctggtgaagctgcggctgtgccaggagtgcagcatcaagctgaacttccaccacaggaggaaggagatcaagagcaagaagaggaaggacaagaccaagaaggactgtgaggagagcagccacaagaagagccggctgagcagcgctgaggaggccagcaagaagaaggacaagggccacagcagcagcaagaagtctgaggacagcctgctgaagacctactttgtgggcctgctgtctgagagcaatgagaagacctacatgtag

SEQ ID NO: 152860 - DNA, 831 bp, Artificial Sequence
  Description of Artificial Sequence: Synthetic coding sequence
atgcacggccacggcggctatgacagcgacttcagtgatgatgagcgctgtggggagagcagcaagaggaagaagaggacagtggaggatgacctgctgctgcagaagcccttccagaaggagaagcacggcaaggtggcccacaagcaggtggccgctgagctgctggaccgggaggaggccaggaacagacgcttccacctgattgccatggatgcctaccagaggcacaccaagtttgtgaatgactacatcctgtactacggcggcaagaaggaggacttcaagaggctgggggagaatgacaagacagacctggatgtgatccgggagaaccaccgcttcctgtggaatgaggaggatgagatggacatgacctgggagaagaggctggccaagaagtactatgacaagctgttcaaggagtactgcatcgctgacctgagcaagtacaaggagaacaagtttggcttccgctggagggtggagaaggaggtgatcagcggcaagggccagttcttctgtggcaacaagtactgtgacaagaaggagggcctgaagtcctgggaggtgaactttggctacatcgagcacggggagaagagaaatgccctggtgaagctgcggctgtgccaggagtgcagcatcaagctgaacttccaccacaggaggaaggagatcaagagcaagaagaggaaggacaagaccaagaaggactgtgaggagagcagccacaagaagagccggctgagcagcgctgaggaggccagcaagaagaaggacaagggccacagcagcagcaagaagtctgaggacagcctgctgaactag

SEQ ID NO: 152861 - DNA, 978 bp, Artificial Sequence
  Description of Artificial Sequence: Synthetic coding sequence
atgggcatcttccctggcatcatcctgatcttcctgcgggtgaagtttgccacagctgctgtgattgtgtctggccaccagaagagcaccaccgtgtcccatgagatgagcggcctgaactggaagccctttgtgtatggaggcctggccagcatcgtggccgagtttggcaccttccctgtggacctgaccaagacccggctgcaggtgcagggccagagcattgatgcccgcttcaaggagatcaagtaccggggcatgtttcatgccctcttccgcatctgcaaggaggagggcgtgctggccctgtacagcggcatcgccccagccctgctgcggcaggccagctatggcaccatcaagattggcatctaccagagcctgaagaggctgtttgtggagcggctggaggatgagaccctgctgatcaacatgatctgtggggtggtgtctggagtcatcagcagcaccatcgccaaccccacagatgtgctgaagatccgcatgcaggcccagggcagcctcttccagggctccatgattggcagcttcatcgacatctaccagcaggagggcacccggggcctgtggaggggcgtggtgcccacagcccagagagctgccatcgtggtgggcgtggagctgcctgtgtatgacatcaccaagaagcacctgatcctgagcggcatgatgggagacaccatcctgacccactttgtgagcagcttcacctgtggcctggccggggccctggccagcaaccctgtggatgtggtgaggaccaggatgatgaaccagagggccatcgtgggccacgtggacctgtacaagggcaccgtggatggcatcctgaagatgtggaagcatgagggcttctttgccctgtacaagggcttctggcccaactggctgcggctgggcccctggaacatcatcttcttcatcacctatgagcagctgaagaggctgcagatctag

SEQ ID NO: 152862 - DNA, 894 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtgggcctgaagatctag

SEQ ID NO: 152863 - DNA, 1773 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtgggcaaggtgattggcaagaatggcaagctgatccaggagatcgtggacaagtctggagtggtgcgggtgcgcatcgaggctgaaaatgagaagaatgtgccccaggaggaggagatcatgccacccaacagcctgcccagcaacaacagccgggtgggccccaatgcccctgaggagaagaagcacctggacatcaaggagaacagcacccacttcagccagcccaacagcaccaaggtgcagagggtgctggtggccagctctgtggtggccggggagagccagaagccagagctgaaggcctggcagggcatggtgccctttgtgtttgtgggcaccaaggacagcatcgccaatgccaccgtgctgctggactaccacctgaactacctgaaggaggtggaccagctgcggctggagcggctgcagattgatgagcagctgcggcagatcggggccagcagccggcccccacccaacagaacagacaaggagaagagctatgtgacagatgatggccagggcatgggccggggcagccggccctacagaaacagaggacatggaagaagaggccctggctacaccagcgcccccacagaggaggagcgggagagcttcctgcggagaggagatggaagaagaagaggaggcggcggccggggccagggcggccggggccggggcggcggcttcaagggaaatgatgaccacagcaggacagacaaccggcccaggaacccccgggaggccaagggccgcaccacagatggcagcctgcagaacaccagcagcgagggcagccggctgaggacaggcaaggacaggaaccagaagaaggagaagccagacagcgtggatggccagcagcccctggtgaatggagtgccctag

SEQ ID NO: 152864 - DNA, 1614 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtgggcaaggtgattggcaagaatggcaagctgatccaggagatcgtggacaagtctggagtggtgcgggtgcgcatcgaggctgaaaatgagaagaatgtgccccaggaggaggagatcatgccacccaacagcctgcccagcaacaacagccgggtgggccccaatgcccctgaggagaagaagcacctggacatcaaggagaacagcacccacttcagccagcccaacagcaccaaggtgcagagggtgctggtggccagctctgtggtggccggggagagccagaagccagagctgaaggcctggcagggcatggtgccctttgtgtttgtgggcaccaaggacagcatcgccaatgccaccgtgctgctggactaccacctgaactacctgaagctgcagcagaggaagaggggccgggccagctgtgccgaggagacagatggaggagtggagggggaggaggaggacaaggaggaggaggatgtggaggaggccagcaaggagaccaccatcaccccagagcagatcatcgtgcacgtgatccaggagcggctgaaggaggagcagcagatggaccccttccgctctgagctgacagccatcatgaagggcgtgtccaccctgaagcactaccgcatcccccctgtgaaggtggtgggctgtgcccgggtgaagatcgtgaccaggaggaagaggagccagacagcctggatggtgagcaaccacagctag

SEQ ID NO: 152865 - DNA, 1899 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtgggcaaggtgattggcaagaatggcaagctgatccaggagatcgtggacaagtctggagtggtgcgggtgcgcatcgaggctgaaaatgagaagaatgtgccccaggaggaggagatcatgccacccaacagcctgcccagcaacaacagccgggtgggccccaatgcccctgaggagaagaagcacctggacatcaaggagaacagcacccacttcagccagcccaacagcaccaaggtgcagagggtgctggtggccagctctgtggtggccggggagagccagaagccagagctgaaggcctggcagggcatggtgccctttgtgtttgtgggcaccaaggacagcatcgccaatgccaccgtgctgctggactaccacctgaactacctgaaggaggtggaccagctgcggctggagcggctgcagattgatgagcagctgcggcagatcggggccagcagccggcccccacccaacagaacagacaaggagaagagctatgtgacagatgatggccagggcatgggccggggcagccggccctacagaaacagaggacatggaagaagaggccctggctacaccagcggcaccaacagcgaggccagcaatgccagcgagacagaaagtgaccacagagatgagctgagtgactggagcctggcccccacagaggaggagcgggagagcttcctgcggagaggagatggaagaagaagaggaggcggcggccggggccagggcggccggggccggggcggcggcttcaagggaaatgatgaccacagcaggacagacaaccggcccaggaacccccgggaggccaagggccgcaccacagatggcagcctgcagatccgggtggactgcaacaatgaaagatctgtgcacaccaagaccctgcagaacaccagcagcgagggcagccggctgaggacaggcaaggacaggaaccagaagaaggagaagccagacagcgtggatggccagcagcccctggtgaatggagtgccctag

SEQ ID NO: 152866 - DNA, 1749 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtgggcaaggtgattggcaagaatggcaagctgatccaggagatcgtggacaagtctggagtggtgcgggtgcgcatcgaggctgaaaatgagaagaatgtgccccaggaggaggagatcatgccacccaacagcctgcccagcaacaacagccgggtgggccccaatgcccctgaggagaagaagcacctggacatcaaggagaacagcacccacttcagccagcccaacagcaccaaggtgcagaggggcatggtgccctttgtgtttgtgggcaccaaggacagcatcgccaatgccaccgtgctgctggactaccacctgaactacctgaaggaggtggaccagctgcggctggagcggctgcagattgatgagcagctgcggcagattggagccagcagccggcccccacccaacagaacagacaaggagaagagctatgtgacagatgatggccagggcatgggccggggcagccggccctacagaaacagaggccacggccggcggggccctggctacaccagcgagagtgaccacagagatgagctgagtgactggagcctggcccccacagaggaggagcgggagagcttcctgcggagaggagatggaagaagaagaggaggcggcggccggggccagggcggccggggccggggcggcggcttcaagggaaatgatgaccacagcaggacagacaaccggcccaggaacccccgggaggccaagggccgcaccacagatggcagcctgcagaacaccagcagcgagggcagccggctgaggacaggcaaggacaggaaccagaagaaggagaagccagacagcgtggatggccagcagcccctggtgaatggagtgccctag

SEQ ID NO: 152867 - DNA, 1779 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtggtgattggcaagaatggcaagctgatccaggagatcgtggacaagtctggagtggtgcgggtgcgcatcgaggctgaaaatgagaagaatgtgccccaggaggaggagatcatgccacccaacagcctgcccagcaacaacagccgggtgggccccaatgcccctgaggagaagaagcacctggacatcaaggagaacagcacccacttcagccagcccaacagcaccaaggtgcagaggggcatggtgccctttgtgtttgtgggcaccaaggacagcatcgccaatgccaccgtgctgctggactaccacctgaactacctgaaggaggtggaccagctgcggctggagcggctgcagattgatgagcagctgcggcagattggagccagcagccggcccccacccaacagaacagacaaggagaagagctatgtgacagatgatggccagggcatgggccggggcagccggccctacagaaacagaggccacggccggcggggccctggctacaccagcggcaccaacagcgaggccagcaatgccagcgagacagaaagtgaccacagagatgagctgagtgactggagcctggcccccacagaggaggagcgggagagcttcctgcggagaggagatggaagaagaagaggaggcggcggccggggccagggcggccggggccggggcggcggcttcaagggaaatgatgaccacagcaggacagacaaccggcccaggaacccccgggaggccaagggccgcaccacagatggcagcctgcagaacaccagcagcgagggcagccggctgaggacaggcaaggacaggaaccagaagaaggagaagccagacagcgtggatggccagcagcccctggtgaatggagtgccctag

SEQ ID NO: 152868 - DNA, 789 bp, Artificial Sequence
  Description of Artificial Sequence: Synthetic coding sequence
atgccacccaacagcctgcccagcaacaacagccgggtgggccccaatgcccctgaggagaagaagcacctggacatcaaggagaacagcacccacttcagccagcccaacagcaccaaggtgcagaggggcatggtgccctttgtgtttgtgggcaccaaggacagcatcgccaatgccaccgtgctgctggactaccacctgaactacctgaaggaggtggaccagctgcggctggagcggctgcagattgatgagcagctgcggcagattggagccagcagccggcccccacccaacagaacagacaaggagaagagctatgtgacagatgatggccagggcatgggccggggcagccggccctacagaaacagaggccacggccggcggggccctggctacaccagcggcaccaacagcgaggccagcaatgccagcgagacagaaagtgaccacagagatgagctgagtgactggagcctggcccccacagaggaggagcgggagagcttcctgcggagaggagatggaagaagaagaggaggcggcggccggggccagggcggccggggccggggcggcggcttcaagggaaatgatgaccacagcaggacagacaaccggcccaggaacccccgggaggccaagggccgcaccacagatggcagcctgcagaacaccagcagcgagggcagccggctgaggacaggcaaggacaggaaccagaagaaggagaagccagacagcgtggatggccagcagcccctggtgaatggagtgccctag

SEQ ID NO: 152869 - DNA, 1611 bp, Artificial Sequence
  Description of Artificial Sequence: Synthetic coding sequence
atgatgaagggggagttctacgtgattgaatatgctgcctgtgatgccacctacaatgaaattgtgacctttgagcggctgcggcctgtgaaccagaacaagacagtgaagaagaacaccttcttcaagtgcaccgtggatgtgcctgaggacctgcgggaggcctgtgccaatgaaaatgcccacaaggacttcaagaaggctgtgggcgcctgccgcatcttctaccaccctgagaccacccagctgatgatcctgagcgccagcgaggccaccgtgaagagggtgaacatcctgagtgacatgcacctgcggagcatccgcaccaagctgatgctgatgagcagaaatgaggaggccaccaagcacctggagtgcaccaagcagctggccgccgccttccacgaggagtttgtggtgcgggaggacctgatgggcctggccatcggcacccacggcagcaacatccagcaggccaggaaggtgcctggggtgacagccatcgagctggatgaggacaccggcaccttccgcatctacggggagagcgcagatgctgtgaagaaggcccggggcttcctggagtttgtggaggacttcatccaggtgcccaggaacctggtgggcaaggtgattggcaagaatggcaaggtgatccaggagatcgtggacaagagcggcgtggtgcgggtgagaattgaaggagacaatgaaaacaagctgccccgggaggatggcatggtgccctttgtgtttgtgggcaccaaggagagcattggaaatgtgcaggtgctgctggagtaccacatcgcctacctgaaggaggtggagcagctgaggatggagcggctgcagattgatgagcagctgcggcagatcggcagccgcagctacagcggccggggccggggcagaagaggccccaactacaccagcggctacggcaccaacagcgagctgagcaaccccagcgagacagagagcgagaggaaggatgagctgagtgactggagcctggccggggaggatgaccgggacagccgccaccagagggacagcagaagaagacctgggggccggggccgctctgtgtctgggggccggggccggggcggcccccggggcggcaagagcagcatcagctctgtgctgaaggaccctgacagcaacccctacagcctgctggacaacacagaaagtgaccagacagctgacacagatgccagcgagagccaccacagcaccaacagaagaagaagaagcagaagaagaagaacagatgaagatgctgtgctgatggatggcatgacagaaagtgacacagcctctgtgaatgaaaatggcctggtgacagtggccgactacatcagcagagctgagagccagagccggcagaggaacctgccccgggagaccctggccaagaacaagaaggagatggccaaggatgtgattgaggagcacggccccagcgagaaggccatcaatggccccaccagcgccagcggagatgacatcagcaagctgcagaggaccccaggagaggagaagatcaacaccctgaaggaggagaacacccaggaggccgctgtgctgaatggagtgtcctag

SEQ ID NO: 152870 - DNA, 1866 bp, Artificial Sequence
  Description of Artificial Sequence: Synthetic coding sequence
atggccgagctgactgtggaggtgcggggcagcaatggagccttctacaagggcttcatcaaggatgtgcatgaggacagcctgactgtggtgtttgagaacaactggcagcctgagcggcaggtgcccttcaatgaggtgcggctgcccccacctccagacatcaagaaggagatcagtgaaggagatgaggtggaggtgtacagccgggccaatgaccaggagccctgtggctggtggctggccaaggtgaggatgatgaagggggagttctacgtgattgaatatgctgcctgtgatgccacctacaatgagatcgtgacctttgagcggctgcggcctgtgaaccagaacaagacagtgaagaagaacaccttcttcaagtgcaccgtggatgtgcctgaggacctgcgggaggcctgtgccaatgaaaatgcccacaaggacttcaagaaggctgtgggcgcctgccgcatcttctaccaccctgagaccacccagctgatgatcctgagcgccagcgaggccaccgtgaagagggtgaacatcctgagtgacatgcacctgcggagcatccgcaccaagctgatgctgatgagcagaaatgaggaggccaccaagcacctggagtgcaccaagcagctggccgccgccttccacgaggagtttgtggtgcgggaggacctgatgggcctggccatcggcacccacggcagcaacatccagcaggccaggaaggtgcctggggtgacagccatcgagctggatgaggacaccggcaccttccgcatctatggagagagcgcagatgctgtgaagaaggcccggggcttcctggagtttgtggaggacttcatccaggtgcccaggaacctggtgggcaaggtgattggcaagaatggcaaggtgatccaggagatcgtggacaagtctggagtggtgcgggtgcgcatcgagggggacaatgaaaacaagctgcccagagaagatggcatggtgccctttgtgtttgtgggcaccaaggagagcattggaaatgtgcaggtgctgctggagtaccacatcgcctacctgaaggaggtggagcagctgaggatggagcggctgcagattgatgagcagctgcggcagatcggcagccgcagctacagcggccggggccggggccggcggggccccaactacaccagcggctacggcaccaacagcgagctgagcaaccccagcgagacagaaagtgagaggaaggatgagctgagtgactggagcctggccggagaagatgaccgggacagccgccaccagagggacagcagaagaagacctgggggccggggccgctctgtgtctgggggccggggccggggcggcccccggggcggcaagagcagcatcagctctgtgctgaaggaccctgacagcaacccctacagcctgctggacaacacagaaagtgaccagacagctgacacagatgccagcgagagccaccacagcaccaacagaagaagaagaagcagaagaagaagaacagatgaagatgctgtgctgatggatggcatgacagaaagtgacacagcctctgtgaatgaaaatggcctggtgacagtggccgactacatcagcagagctgagagccagagccggcagaggaacctgccccgggagaccctggccaagaacaagaaggagatggccaaggatgtgattgaggagcacggccccagcgagaaggccatcaatggccccaccagcgccagcggagatgacatcagcaagctgcagaggaccccaggagaggagaagatcaacaccctgaaggaggagaacacccaggaggccgctgtgctgaatggagtgtcctag

SEQ ID NO: 152871 - DNA, 1620 bp, Artificial Sequence
  Description of Artificial Sequence: Synthetic coding sequence
atggccgagctgactgtggaggtgcggggcagcaatggagccttctacaagggcttcatcaaggatgtgcatgaggacagcctgactgtggtgtttgagaacaactggcagcctgagcggcaggtgcccttcaatgaggtgcggctgcccccacctccagacatcaagaaggagatcagtgaaggagatgaggtggaggtgtacagccgggccaatgaccaggagccctgtggctggtggctggccaaggtgaggatgatgaagggggagttctacgtgattgaatatgctgcctgtgatgccacctacaatgagatcgtgacctttgagcggctgcggcctgtgaaccagaacaagacagtgaagaagaacaccttcttcaagtgcaccgtggatgtgcctgaggacctgcgggaggcctgtgccaatgaaaatgcccacaaggacttcaagaaggctgtgggcgcctgccgcatcttctaccaccctgagaccacccagctgatgatcctgagcgccagcgaggccaccgtgaagagggtgaacatcctgagtgacatgcacctgcggagcatccgcaccaagctgatgctgatgagcagaaatgaggaggccaccaagcacctggagtgcaccaagcagctggccgccgccttccacgaggagtttgtggtgcgggaggacctgatgggcctggccatcggcacccacggcagcaacatccagcaggccaggaaggtgcctggggtgacagccatcgagctggatgaggacaccggcaccttccgcatctatggagagagcgcagatgctgtgaagaaggcccggggcttcctggagtttgtggaggacttcatccaggtgcccaggaacctggtgggcaaggtgattggcaagaatggcaaggtgatccaggagatcgtggacaagtctggagtggtgcgggtgcgcatcgagggggacaatgaaaacaagctgcccagagaagatggcatggtgccctttgtgtttgtgggcaccaaggagagcattggaaatgtgcaggtgctgctggagtaccacatcgcctacctgaaggaggtggagcagctgaggatggagcggctgcagattgatgagcagctgcggcagatcggcagccgcagctacagcggccggggccggggccggcggggccccaactacaccagcggctacggcaccaacagcgagctgagcaaccccagcgagacagaaagtgagaggaaggatgagctgagtgactggagcctggccggagaagatgaccgggacagccgccaccagagggacagcagaagaagacctgggggccggggccgctctgtgtctgggggccggggccggggcggcccccggggcggcaagagcagcatcagctctgtgctgaaggaccctgacagcaacccctacagcctgctggacaacacagaaagtgaccagacagctgacacagatgccagcgagagccaccacagcaccaacagaagaagaagaagcagaagaagaagaacagatgaagatgctgtgctgatggatggcatgacagaaagtgacacagcctctgtgaatgaaaatggcctgggcaagagatgtgactag

SEQ ID NO: 152872 - DNA, 1827 bp, Artificial Sequence
  Description of Artificial Sequence: Synthetic coding sequence
atggtgacagagggcttcatcaaggatgtgcatgaggacagcctgactgtggtgtttgagaacaactggcagcctgagcggcaggtgcccttcaatgaggtgcggctgcccccacctccagacatcaagaaggagatcagtgaaggagatgaggtggaggtgtacagccgggccaatgaccaggagccctgtggctggtggctggccaaggtgaggatgatgaagggggagttctacgtgattgaatatgctgcctgtgatgccacctacaatgaaattgtgacctttgagcggctgcggcctgtgaaccagaacaagacagtgaagaagaacaccttcttcaagtgcaccgtggatgtgcctgaggacctgcgggaggcctgtgccaatgaaaatgcccacaaggacttcaagaaggctgtgggcgcctgccgcatcttctaccaccctgagaccacccagctgatgatcctgagcgccagcgaggccaccgtgaagagggtgaacatcctgagtgacatgcacctgcggagcatccgcaccaagctgatgctgatgagcagaaatgaggaggccaccaagcacctggagtgcaccaagcagctggccgccgccttccacgaggagtttgtggtgcgggaggacctgatgggcctggccatcggcacccacggcagcaacatccagcaggccaggaaggtgcctggggtgacagccatcgagctggatgaggacaccggcaccttccgcatctacggggagagcgcagatgctgtgaagaaggcccggggcttcctggagtttgtggaggacttcatccaggtgcccaggaacctggtgggcaaggtgattggcaagaatggcaaggtgatccaggagatcgtggacaagagcggcgtggtgcgggtgagaattgaaggagacaatgaaaacaagctgccccgggaggatggcatggtgccctttgtgtttgtgggcaccaaggagagcattggaaatgtgcaggtgctgctggagtaccacatcgcctacctgaaggaggtggagcagctgaggatggagcggctgcagattgatgagcagctgcggcagatcggcagccgcagctacagcggccggggccggggcagaagaggccccaactacaccagcggctacggcaccaacagcgagctgagcaaccccagcgagacagagagcgagaggaaggatgagctgagtgactggagcctggccggggaggatgaccgggacagccgccaccagagggacagcagaagaagacctgggggccggggccgctctgtgtctgggggccggggccggggcggcccccggggcggcaagagcagcatcagctctgtgctgaaggaccctgacagcaacccctacagcctgctggacaacacagaaagtgaccagacagctgacacagatgccagcgagagccaccacagcaccaacagaagaagaagaagcagaagaagaagaacagatgaagatgctgtgctgatggatggcatgacagaaagtgacacagcctctgtgaatgaaaatggcctggtgacagtggccgactacatcagcagagctgagagccagagccggcagaggaacctgccccgggagaccctggccaagaacaagaaggagatggccaaggatgtgattgaggagcacggccccagcgagaaggccatcaatggccccaccagcgccagcggagatgacatcagcaagctgcagaggaccccaggagaggagaagatcaacaccctgaaggaggagaacacccaggaggccgctgtgctgaatggagtgtcctag

SEQ ID NO: 152873 - DNA, 2022 bp, Artificial Sequence
  Description of Artificial Sequence: Synthetic coding sequence
atgggcggcctggccagcggaggagatgtggagcccggcctgcctgtggaggtgcggggcagcaatggagccttctacaagggctttgtgaaggatgtgcatgaagattctgtgaccatcttctttgagaacaactggcagagcgagcggcagatcccctttggagatgtgcggctgcccccacctgctgactacaacaaggagatcacagaaggagatgaggtggaggtgtacagccgggccaatgagcaggagccctgtggctggtggctggcccgggtgaggatgatgaagggggacttctacgtgattgaatatgctgcctgtgatgccacctacaatgagatcgtgaccctggagcggctgcggcctgtgaaccccaaccccctggccaccaagggcagcttcttcaaggtgaccatggctgtgcctgaggacctgcgggaggcctgcagcaatgaaaatgtgcacaaggagttcaagaaggccctgggcgccaactgcatcttcctgaacatcaccaacagcgagctgttcatcctgagcaccacagaggcccctgtgaagagggccagcctgctgggggacatgcacttccgcagcctgcggaccaagctgctgctgatgagcagaaatgaggaggccaccaagcacctggagaccagcaagcagctggccgccgccttccaggaggagttcaccgtgcgggaggacctgatgggcctggccatcggcacccatggagccaacatccagcaggccaggaaggtgcctggggtgacagccatcgagctgggggaggagacctgcaccttccgcatctatggagagaccccagaggcctgccggcaggcccggagctacctggagttctctgaagattctgtgcaggtgcccaggaacctggtgggcaaggtgattggcaagaatggcaaggtgatccaggagatcgtggacaagtctggagtggtgcgggtgcgggtggagggggacaatgacaagaagaacccccgggaggagggcatggtgcccttcatctttgtgggcacccgggagaacatcagcaatgcccaggccctgctggagtaccacctgagctacctgcaggaggtggagcagctgcggctggagcggctgcagattgatgagcagctgcggcagatcggcctgggcttccggcccccaggcagcggccggggcagcggcggcagtgacaaggccggctacagcacagatgagagcagcagcagcagcctgcacgccaccaggacctatggaggcagctatggaggccggggccggggccgcaggactggaggccctgcctacggccccagcagtgatgtgtccacagccagcgagacagaaagtgagaagcgggaggagcccaacagagctggccctggggaccgggacccccccaccagaggagaggagagcagaagaagacccactggaggccggggccggggccccccaccagccccccggcccaccagccgctacaacagcagcagcatcagctctgtgctgaaggaccctgacagcaacccctacagcctgctggacaccagcgagcctgagccccctgtggacagcgagcctggagagcccccaccagccagcgccaggagaagaagaagcagaagaagaagaacagatgaggacagaacagtgatggatggcggcctggagagtgatggccccaacatgacagaaaatggcctggaggatgagagccggccccagaggaggaacagaagcagaagaagaagaaacagaggcaacagaacagatggcagcatcagcggggaccggcagcctgtgacagtggccgactacatcagcagagctgagagccagagccggcagaggcctcccctggagaggaccaagcccagcgaggacagcctgagcggccagaagggggacagcgtgtccaagctgcccaagggccccagtgaaaatggagagctgagcgcccccctggagctgggctccatggtgaatggagtgtcctag

SEQ ID NO: 152874 - DNA, 6540 bp, Artificial Sequence
  Description of Artificial Sequence: Synthetic coding sequence
atgaacagcctgtcctggggcgccgccaatgctgtgctgctgctgctgctgctggcctgggccagccccaccttcatcagcatcaacagaggagtgcgggtgatgaagggccacagcgccttcctgtctggagatgacctgaagtttgccatccccaaggagaaggatgcctgcaaggtggaggtggtgatgaatgagcccatcacccagagggtgggcaagctgaccccccaggtgtttgactgccacttcctgcccaatgaggtgaagtatgtgcacaacggctgccccatcctggatgaagatactgtgaagctgcggctgtaccgcttcacagagcgggacaccttcatcgagaccttcatcctgtgggtgtacctgctggagccagactgcaacatcatccacatgagcaacaacgtgctggaggtgcctgagttcaacggcctgagccaggccatcgacaagaacctgctgcgctttgattatgacaggatggccagcctggagtgcaccgtgtccctggacacagcccggacccggctgcctgcccacggccagatggtgctgggggagcccaggcctgaggagcccaggggggaccagccccacagcttcttccctgagagccagctgcgggccaagctgaagtgccctgggggcagctgcaccccaggcctgaagaagattggcagcctgaaggtgtcctgtgaggagttcctgctgatgggcctgcgctaccagcacctggacccccccagccccaacatcgactacatcagcatccagctggacctgacagacaccaggagcaagatcgtgtacaagtctgagagcgcctggctgcctgtgtacatccgggccggcatccccaaccagatccccaaggccgccttcatggctgtgttcatcctggaggtggaccagttcatcctgaccagcctgaccacctctgtgctggactgtgaggaggatgagacccccaagcccctgctggtgttcaacatcaccaaggcccccctgcagggctacgtgacccacctgctggaccacacccggcccatcagcagcttcacctggaaggacctgagtgacatgcagatcgcctaccagccccccaacagcagccacagcgagaggagacatgatgaggtggagctggaggtgtatgacttcttctttgagaggtctgcccccatgacagtgcacatcagcatcagaacagctgacaccaatgccccccgggtgtcctggaacacaggcctgagcctgctggagggccagagccgggccatcacctgggagcagttccaggtggtggacaatgatgacattggagctgtgcggctggtgacagtgggcggcctgcagcacggctggctgaccctgcggggcggcaagggcttcctgttcaccgtggccgacctgcaggccggcgtggtgcgctaccaccatgatgacagcgacagcaccaaggactttgtggtgttccgcatctttgatggccaccacagcatccgccacaagttccccatcaacgtgctgcccaaggatgacagcccccccttcctgatcaccaacgtggtgattgagctggaggagggccagaccatcctgatccagggctccatgctgcgggccagtgatgtggatgccagtgatgactacatcttcttcaacatcaccaagccaccccaggccggggagatcatgaagaagccaggccctggcctgattggctaccctgtgcacggcttcctgcagagggacctcttcaacggcatcatctactaccgccactttggaggagagatctttgaagattccttccagtttgtgctgtgggacagccatgagccccccaacctgtctgtgccccaggtggccaccatccacatcacccctgtggatgaccagctgcccaaggaggcccctggggtgagccgccacctggtggtgaaggagacagaggtggcctacatcaccaagaagcagctgcacttcattgattctgagagctatgaccgggagctggtgtacaccatcaccaccccacccttcttctccttcagccaccgccacctggatgctgggaagctgttcatggtggacagcatccccaaggtggtgaagaaccccacagccctggagctgcggagcttcacccagcacgctgtgaactacatgaaggtggcctacatgccacccatgcaggacatcggcccccactgcagagatgtgcagttcaccttctctgtgagcaaccagcacggcggcaccctgcacggcatctgcttcaacatcaccatcctgcctgtggacaaccaggtgcctgaggccttcaccaaccccctgaaggtgacagagggcggccagagcatcatcagcacagagcacatcctgatcagtgatgctgacaccaagctggacaacatcgacctgagcctgcgggagctgcccctgcacggccgggtggagctgaatggcttccccctgaacagcggcggcaccttctcctggggagacctgcacaccctgaaggtgcgctaccagcatgatggaacagaggtgctgcaggatgacctgctgctggaggtgacagatggcaccaacagcgctgagtttgtgctgcacgtggaggtgtttcctgtgaatgatgagccccctgtgctgaaggctgacctgatgcctgtgatgaactgcagcgagggcggggaggtggtgatcaccagcgagtacatctttgccacagatgtggacagcgacaacctgaagctgatgtttgtgattgcccgggagccccagcacggcgtggtgcggcgggccggcgtgacagtggaccagttcagccagagagatgtgatcagcgaggccgtgacctacaagcacactggaggagagatcggcctgatgccctgctttgacaccatcaccctggtggtgtctgatggagaggccggcccctttgtgaatggctgctgctacaacggccccaaccccagcgtgcccctgcacgccagcttccctgtgtatgacctgaacatcaccgtgtaccctgtggacaaccagccccccagcatcgccatcggccctgtgtttgtggtggatgagggctgcagcacagccctgactgtgaaccacctgagcgccacagatcctgacacagctgctgatgacctggagtttgtgctggtgtccccaccccagtttggctacctggagaacatcctgcccagcgtgggctttgagaagagcaacatcggcatcagcattgacagcttccagtggaaggacatgaatgccttccacatcaactacgtgcagagccgccacctgcgcatcgagcccacagctgaccagttcaccgtgtatgtgacagatggcaagcaccacagcctggagatccccttcagcatcatcatcaaccccaccaatgatgaggccccagactttgtggtgcagaacatcaccgtgtgtgagggccagatgaaggagctggacagcagcatcatctctgctgtggacctggacatcccccaggatgccctgctcttcagcatcacccagaagcccaggcatggcctgctgattgaccggggcttcagcaaggacttcagcgagaacaagcagcctgccaacccccaccagaagcacgcccctgtgcacagcttctccatggagctgctgaagacaggcatgaggctgacctacatgcatgatgacagcgagagcctggctgatgacttcaccatccagctgagtgatggcaagcacaagatcctgaagaccatctctgtggaggtgattcctgtgaatgatgagaagcccatgctgagcaagaaggccgagatcgccatgaacatgggagagacccgcatcatcagcagcgccatcctgagcgccattgatgaggacagcccccgggagaagatctactacgtgtttgagcggctgccccagaatggccagctgcagctgaagattggccgggactgggtgcccctgagccctggcatgaagtgcacccaggaggaggtggacctgaacctgctgcgctacacccacactggagccatggacagccagaaccaggacagcttcaccttctacctgtgggatggcaacaacagaagccctgccctggactgccagatcaccatcaaggacatggagaagggggacatcgtcatcctgaccaagcccctggtggtgtccaagggggaccggggcttcctgaccaccaccaccctgctggccgtggatggaacagacaagccagaggagctgctgtatgtgatcaccagcccccccaggtatggccagatcgagtatgtgcactacccaggagtgcccatcaccaacttcagccagatggatgtggtgggccagacagtgtgctacgtgcacaagagcaaggtgacagtgtccagtgaccgcttccgcttcatcatcagcaatggcctgaggacagagcacggcgtgtttgagatcaccctggagaccgtggaccgggccctgcctgtggtgaccagaaataaaggcctgcggctggcccagggcgctgtgggcctgctgagcccagacctgctgcagctgacagatcctgacaccccagctgagaacctgaccttcctgctggtgcagctgccccagcacggccagctgtacctgtggggcaccggcctgctgcagcacaacttcacccagcaggatgtggacagcaagaatgtggcctaccgccacagcggcggggacagccagacagactgcttcaccttcatggccacagatggcaccaaccagggcttcatcgtgaatggccgggtgtgggaggagcctgtgctcttcaccatccaggtggaccagctggacaagacagccccccgcatcaccctgctgcacagccccagccaggtgggcctgctgaagaatggctgctacggcatctacatcaccagccgggtgctgaaggccagtgaccctgacacagaagatgaccagatcatcttcaagatcctgcagggccccaagcacggccacctggagaacaccaccaccggggagttcatccacgagaagttcagccagaaggacctgaacagcaagaccatcctgtacatcatcaaccccagcctggaggtgaacagcgacacagtggagttccagatcatggaccccactggaaacagcgccaccccccagatcctggagctgaagtggagccacatcgagtggagccagacagaatatgaggtgtgtgaaaatgtgggcctgctgcccctggagatcatcagaagaggctacagcatggacagcgcctttgtgggcatcaaggtgaaccaggtgtctgctgctgtgggcaaggacttcaccgtcatccccagcaagctgatccagtttgaccccggcatgagcaccaagatgtggaacatcgccatcacctatgatggcctggaggaggatgatgaggtgtttgaagtcatcctgaacagccctgtgaatgctgtgctgggcaccaagaccaaggctgctgtgaagatcctggacagcaaaggaggccagtgccaccccagctacagcagcaaccagagcaagcacagcacctgggagaagggcatctggcacctgctgcccccaggcagcagcagcagcaccaccagcggcagcttccacctggagcggcggcccctgcccagctccatgcagctggccgtcatccggggggacaccctgcggggctttgacagcacagacctgagccagaggaagctgcggaccagaggaaatggcaagacagtgcggcccagctctgtgtacagaaatggaacagacatcatctacaactaccacggcatcgtgtccctgaagctggaggatgacagcttccccacccacaagaggaaggccaaggtgtccatcatcagccagccccagaagaccatcaaggtggccgagctgccccaggccgacaaggtggagagcaccacagacagccacttcccccggcaggaccagctgcccagcttccccaagaactgcaccctggagctgaagggcctcttccactttgaggagggcatccagaagctgtaccagtgcaatggcatcgcctggaaggcctggagcccccagaccaaggatgtggaggacaagagctgcccagctggctggcaccagcacagcggctactgccacatcctgatcacagagcagaagggcacctggaatgctgctgcccaggcctgccgggagcagtacctgggcaacctggtgaccgtcttcagccggcagcacatgcgctggctgtgggacattggaggcaggaagagcttctggattggcctgaatgaccaggtgcatgctggccactgggagtggattggaggagagcctgtggccttcaccaacggccggcggggccccagccagaggagcaagctgggcaagagctgtgtgctggtgcagaggcagggcaagtggcagaccaaggactgccggcgggccaagccccacaactacgtgtgcagcaggaagctgtag

SEQ ID NO: 152875 - DNA, 6543 bp, Artificial Sequence
  Description of Artificial Sequence: Synthetic coding sequence
atgaacagcctgtcctggggcgccgccaatgctgtgctgctgctgctgctgctggcctgggccagccccaccttcatcagcatcaacagaggagtgcgggtgatgaagggccacagcgccttcctgtctggagatgacctgaagtttgccatccccaaggagaaggatgcctgcaaggtggaggtggtgatgaatgagcccatcacccagagggtgggcaagctgaccccccaggtgtttgactgccacttcctgcccaatgaggtgaagtatgtgcacaacggctgccccatcctggatgaagatactgtgaagctgcggctgtaccgcttcacagagcgggacaccttcatcgagaccttcatcctgtgggtgtacctgctggagccagactgcaacatcatccacatgagcaacaacgtgctggaggtgcctgagttcaacggcctgagccaggccatcgacaagaacctgctgcgctttgattatgacaggatggccagcctggagtgcaccgtgtccctggacacagcccggacccggctgcctgcccacggccagatggtgctgggggagcccaggcctgaggagcccaggggggaccagccccacagcttcttccctgagagccagctgcgggccaagctgaagtgccctgggggcagctgcaccccaggcctgaagaagattggcagcctgaaggtgtcctgtgaggagttcctgctgatgggcctgcgctaccagcacctggacccccccagccccaacatcgactacatcagcatccagctggacctgacagacaccaggagcaagatcgtgtacaagaagtctgagagcgcctggctgcctgtgtacatccgggccggcatccccaaccagatccccaaggccgccttcatggctgtgttcatcctggaggtggaccagttcatcctgaccagcctgaccacctctgtgctggactgtgaagaagatgagacccccaagcccctgctggtgttcaacatcaccaaggcccccctgcagggctacgtgacccacctgctggaccacacccggcccatcagcagcttcacctggaaggacctgagtgacatgcagatcgcctaccagccccccaacagcagccacagcgagaggagacatgatgaggtggagctggaggtgtatgacttcttctttgagaggtctgcccccatgacagtgcacatcagcatcagaacagctgacaccaatgccccccgggtgtcctggaacacaggcctgagcctgctggagggccagagccgggccatcacctgggagcagttccaggtggtggacaatgatgacatcggggctgtgcggctggtgacagtgggcggcctgcagcacggctggctgaccctgcggggcggcaagggcttcctgttcaccgtggccgacctgcaggccggcgtggtgcgctaccaccatgatgacagcgacagcaccaaggactttgtggtgttccgcatctttgatggccaccacagcatccgccacaagttccccatcaacgtgctgcccaaggatgacagcccccccttcctgatcaccaacgtggtgattgagctggaggagggccagaccatcctgatccagggctccatgctgcgggccagtgatgtggatgccagtgatgactacatcttcttcaacatcaccaagccaccccaggccggggagatcatgaagaagccaggccctggcctcatcggctaccctgtgcacggcttcctgcagagggacctcttcaacggcatcatctactaccgccactttggaggagagatctttgaggacagcttccagtttgtgctgtgggacagccatgagccccccaacctgtctgtgccccaggtggccaccatccacatcacccctgtggatgaccagctgcccaaggaggcccctggggtgagccgccacctggtggtgaaggagacagaggtggcctacatcaccaagaagcagctgcacttcatcgacagcgagagctatgaccgggagctggtgtacaccatcaccaccccacccttcttctccttcagccaccgccacctggatgctgggaagctgttcatggtggacagcatccccaaggtggtgaagaaccccacagccctggagctgcgctccttcacccagcacgctgtgaactacatgaaggtggcctacatgccacccatgcaggacatcggcccccactgcagagatgtgcagttcaccttctctgtgagcaaccagcacggcggcaccctgcacggcatctgcttcaacatcaccatcctgcctgtggacaaccaggtgcctgaggccttcaccaaccccctgaaggtgacagaaggaggccagagcatcatcagcacagagcacatcctgatcagtgatgctgacaccaagctggacaacatcgacctgagcctgcgggagctgcccctgcacggccgggtggagctgaatggcttccccctgaacagcggcggcaccttctcctggggagacctgcacaccctgaaggtgcgctaccagcatgatggaacagaggtgctgcaggatgacctgctgctggaggtgacagatggcaccaacagcgctgagtttgtgctgcacgtggaggtgtttcctgtgaatgatgagccccctgtgctgaaggctgacctgatgcctgtgatgaactgcagcgagggcggggaggtggtgatcaccagcgagtacatctttgccacagatgtggacagcgacaacctgaagctgatgtttgtgattgcccgggagccccagcacggcgtggtgagaagagctggggtgacagtggaccagttcagccagagagatgtgatcagcgaggccgtgacctacaagcacactggaggagaaattggcctgatgccctgctttgacaccatcaccctggtggtgtctgatggagaggccggcccctttgtgaatggctgctgctacaacggccccaaccccagcgtgcccctgcacgccagcttccctgtgtatgacctgaacatcaccgtgtaccctgtggacaaccagcccccatccatcgccatcggccctgtgtttgtggtggatgagggctgcagcacagccctgactgtgaaccacctgagcgccacagatcctgacacagctgctgatgacctggagtttgtgctggtgagccccccccagtttggctacctggagaacatcctgcccagcgtgggctttgagaagagcaacatcggcatcagcattgacagcttccagtggaaggacatgaatgccttccacatcaactacgtgcagagccgccacctgagaattgagcccacagctgaccagttcaccgtgtatgtgacagatggcaagcaccacagcctggagatccccttcagcatcatcatcaaccccaccaatgatgaggccccagactttgtggtgcagaacatcaccgtgtgtgagggccagatgaaggagctggacagcagcatcatctctgctgtggacctggacatcccccaggatgccctgctcttcagcatcacccagaagcccaggcatggcctgctgattgaccggggcttcagcaaggacttcagcgagaacaagcagcctgccaacccccaccagaagcacgcccctgtgcacagcttctccatggagctgctgaagacaggcatgaggctgacctacatgcatgatgattctgagagcctggctgatgacttcaccatccagctgagtgatggcaagcacaagatcctgaagaccatctctgtggaggtgattcctgtgaatgatgagaagcccatgctgagcaagaaggccgagatcgccatgaacatgggagagacccgcatcatcagcagcgccatcctgagcgccattgatgaggacagcccccgggagaagatctactacgtgtttgagcggctgccccagaatggccagctgcagctgaagattggccgggactgggtgcccctgagccctggcatgaagtgcacccaggaggaggtggacctgaacctgctgcgctacacccacactggagccatggacagccagaaccaggacagcttcaccttctacctgtgggatggcaacaacagaagccctgccctggactgccagatcaccatcaaggacatggagaagggggacatcgtcatcctgaccaagcccctggtggtgtccaaaggagaccggggcttcctgaccaccaccaccctgctggccgtggatggaacagacaagccagaggagctgctgtatgtgatcaccagccccccaagatatggccagattgaatatgtgcactacccaggagtgcccatcaccaacttcagccagatggatgtggtgggccagacagtgtgctacgtgcacaagagcaaggtgacagtgtccagtgaccgcttccgcttcatcatcagcaatggcctgaggacagaacatggagtgtttgagatcaccctggagaccgtggaccgggccctgcctgtggtgaccaggaacaagggcctgcggctggcccagggcgctgtgggcctgctgagcccagacctgctgcagctgacagatcctgacaccccagctgagaacctgaccttcctgctggtgcagctgccccagcacggccagctgtacctgtggggcaccggcctgctgcagcacaacttcacccagcaggatgtggacagcaagaatgtggcctaccgccacagcggcggggacagccagacagactgcttcaccttcatggccacagatggcaccaaccagggcttcatcgtgaatggccgggtgtgggaggagcctgtgctcttcaccatccaggtggaccagctggacaagacagccccccgcatcaccctgctgcacagccccagccaggtgggcctgctgaagaatggctgctacggcatctacatcaccagccgggtgctgaaggccagtgaccctgacacagaagatgaccagatcatcttcaagatcctgcagggccccaagcacggccacctggagaacaccaccactggagagttcatccacgagaagttcagccagaaggacctgaacagcaagaccatcctgtacatcatcaaccccagcctggaggtgaacagcgacacagtggagttccagatcatggaccccaccggcaacagcgccaccccccagatcctggagctgaagtggagccacatcgagtggagccagacagaatatgaggtgtgtgaaaatgtgggcctgctgcccctggagatcatccggcggggctacagcatggattctgcctttgtgggcatcaaggtgaaccaggtgtctgctgctgtgggcaaggacttcaccgtcatccccagcaagctgatccagtttgatcctggcatgagcaccaagatgtggaacatcgccatcacctatgatggcctggaggaggatgatgaggtgtttgaggtgatcctgaacagccctgtgaatgctgtgctgggcaccaagaccaaggctgctgtgaagatcctggacagcaagggcggccagtgccaccccagctacagcagcaaccagagcaagcacagcacctgggagaagggcatctggcacctgctgcccccaggcagcagcagcagcaccaccagcggcagcttccacctggagcggcggcccctgcccagctccatgcagctggccgtcatccggggggacaccctgcggggctttgacagcacagacctgagccagaggaagctgcggaccagaggaaatggcaagacagtgcggcccagctctgtgtacagaaatggaacagacatcatctacaactaccatggaattgtgtccctgaagctggaggatgacagcttccccacccacaagaggaaggccaaggtgtccatcatcagccagccccagaagaccatcaaggtggccgagctgccccaggccgacaaggtggagagcaccacagacagccacttcccccggcaggaccagctgcccagcttccccaagaactgcaccctggagctgaagggcctcttccactttgaggagggcatccagaagctgtaccagtgcaatggaattgcctggaaggcctggagcccccagaccaaggatgtggaggacaagagctgcccagctggctggcaccagcacagcggctactgccacatcctgatcacagagcagaagggcacctggaatgctgctgcccaggcctgccgggagcagtacctgggcaacctggtgacagtgttcagccggcagcacatgcgctggctgtgggacatcggcggcaggaagagcttctggattggcctgaatgaccaggtgcacgccggccactgggagtggattggaggagagcctgtggccttcaccaatggaagaagaggccccagccagaggagcaagctgggcaagagctgtgtgctggtgcagaggcagggcaagtggcagaccaaggactgcagaagagccaagccccacaactacgtgtgcagcaggaagctgtag

SEQ ID NO: 152876 - DNA, 648 bp, Artificial Sequence
  Description of Artificial Sequence: Synthetic coding sequence
atgctggatgagagcctggccgtgagaagaagcaagaagtgcaaggagatgatcatgcactgggagaagaaggaggacattgatattgtgaacacagtggaccagctggacaagacagccccccgcatcaccctgctgcacagccccagccaggtgggcctgctgaagaatggctgctacggcatctacatcaccagccgggtgctgaaggccagtgaccctgacacagaagatgaccagatcatcttcaagatcctgcagggccccaagcacggccacctggagaacaccaccactggagagttcatccacgagaagttcagccagaaggacctgaacagcaagaccatcctgtacatcatcaaccccagcctggaggtgaacagcgacacagtggagttccagatcatggaccccaccggcaacagcgccaccccccagatcctggagctgaagtggagccacatcgagtggagccagacagaatatgaggtgtgtgaaaatgtgggcctgctgcccctggagatcatccggcggggctacagcatggattctgcctttgtgggcatcaaggtgaaccaggtgtctgctgctgtgggcaaggacttcaccgtcatccccagcaagctgatccagtttgacccctag

SEQ ID NO: 152877 - DNA, 2148 bp, Artificial Sequence
  Description of Artificial Sequence: Synthetic coding sequence
atggtgacccaggagagcatgctgaaggccgccctgcccctcttcacccgcttcatcatcagcaatggcctgaggacagagcacggcgtgtttgagatcaccctggagaccgtggaccgggccctgcctgtggtgaccagaaataaaggcctgcggctggcccagggcgctgtgggcctgctgagcccagacctgctgcagctgacagatcctgacaccccagctgagaacctgaccttcctgctggtgcagctgccccagcacggccagctgtacctgtggggcaccggcctgctgcagcacaacttcacccagcaggatgtggacagcaagaatgtggcctaccgccacagcggcggggacagccagacagactgcttcaccttcatggccacagatggcaccaaccagggcttcatcgtgaatggccgggtgtgggaggagcctgtgctcttcaccatccaggtggaccagctggacaagacagccccccgcatcaccctgctgcacagccccagccaggtgggcctgctgaagaatggctgctacggcatctacatcaccagccgggtgctgaaggccagtgaccctgacacagaagatgaccagatcatcttcaagatcctgcagggccccaagcacggccacctggagaacaccaccaccggggagttcatccacgagaagttcagccagaaggacctgaacagcaagaccatcctgtacatcatcaaccccagcctggaggtgaacagcgacacagtggagttccagatcatggaccccactggaaacagcgccaccccccagatcctggagctgaagtggagccacatcgagtggagccagacagaatatgaggtgtgtgaaaatgtgggcctgctgcccctggagatcatcagaagaggctacagcatggacagcgcctttgtgggcatcaaggtgaaccaggtgtctgctgctgtgggcaaggacttcaccgtcatccccagcaagctgatccagtttgaccccggcatgagcaccaagatgtggaacatcgccatcacctatgatggcctggaggaggatgatgaggtgtttgaagtcatcctgaacagccctgtgaatgctgtgctgggcaccaagaccaaggctgctgtgaagatcctggacagcaaaggaggccagtgccaccccagctacagcagcaaccagagcaagcacagcacctgggagaagggcatctggcacctgctgcccccaggcagcagcagcagcaccaccagcggcagcttccacctggagcggcggcccctgcccagctccatgcagctggccgtcatccggggggacaccctgcggggctttgacagcacagacctgagccagaggaagctgcggaccagaggaaatggcaagacagtgcggcccagctctgtgtacagaaatggaacagacatcatctacaactaccacggcatcgtgtccctgaagctggaggatgacagcttccccacccacaagaggaaggccaaggtgtccatcatcagccagccccagaagaccatcaaggtggccgagctgccccaggccgacaaggtggagagcaccacagacagccacttcccccggcaggaccagctgcccagcttccccaagaactgcaccctggagctgaagggcctcttccactttgaggagggcatccagaagctgtaccagtgcaatggcatcgcctggaaggcctggagcccccagaccaaggatgtggaggacaagagctgcccagctggctggcaccagcacagcggctactgccacatcctgatcacagagcagaagggcacctggaatgctgctgcccaggcctgccgggagcagtacctgggcaacctggtgaccgtcttcagccggcagcacatgcgctggctgtgggacattggaggcaggaagagcttctggattggcctgaatgaccaggtgcatgctggccactgggagtggattggaggagagcctgtggccttcaccaacggccggcggggccccagccagaggagcaagctgggcaagagctgtgtgctggtgcagaggcagggcaagtggcagaccaaggactgccggcgggccaagccccacaactacgtgtgcagcaggaagctgtag

SEQ ID NO: 152878 - DNA, 6540 bp, Artificial Sequence; identical to SEQ ID NO: 152874
  Description of Artificial Sequence: Synthetic coding sequence

SEQ ID NO: 152879 - DNA, 9510 bp, Artificial Sequence
  Description of Artificial Sequence: Synthetic coding sequence
atgcacagcgctggcaccccaggcctgagcagcagaagaacaggcaacagcaccagcttccagcccggccccccacctccaccccggctgctgctgctgctgctgctgctgctgagcctggtgtcccgggtgcctgcccagcctgctgccttcggccgggccctgctgagccctggcctggccggggccgccggcgtgcctgctgaggaggccatcgtgctggccaacagaggcctgcgggtgcccttcggccgggaggtgtggctggaccccctgcatgacctggtgctgcaggtgcagcccggggacagatgtgctgtgtctgtgctggacaatgatgccctggcccagaggcctggccgcctgagccccaagcgcttcccctgtgactttggacctggagaggtgcgctacagccacctgggcgcccggagccccagccgggacagagtgcggctgcagctgcgctatgatgcccctgggggcgctgtggtgctgcccctggtgctggaggtggaggtggtgttcacccagctggaggtggtgaccaggaacctgcccctggtggtggaggagctgctgggcaccagcaatgccctggatgcccggagcctggagtttgccttccagcctgagacagaagaatgtcgggtgggcatcctgagcggcctgggcgccctgccccgctacggggagctgctgcactacccccaggtgcctgggggcgcccgggagggcggggcccctgagaccctgctgatggactgcaaggccttccaggagctgggcgtgcgctaccgccacacagctgccagccgcagccccaacagagactggatccccatggtggtggagctgcggagcagaggagcccctgtgggcagccctgccctgaagcgggagcacttccaggtgctggtgcgcatccggggcggcgctgagaacacagcccccaagcccagctttgtggccatgatgatgatggaggtggaccagtttgtgctgacagccctgaccccagacatgctggccgcagaagatgctgagagccccagcgacctgctgatcttcaacctgaccagccccttccagcccggccagggctacctggtgtccacagatgacaggagcctgcccctgagcagcttcacccagagggacctgcggctgctgaagatcgcctaccagcccccatctgaggacagcgaccaggagcggctgtttgagctggagctggaggtggtggacctggagggcgccgccagtgacccctttgccttcatggtggtggtgaagcccatgaacaccatggcccctgtggtgaccaggaacacaggcctcatcctgtatgagggccagagccggcccctgaccggccctgctggcagcggcccccagaacctggtgatcagtgatgaagatgacctggaggccgtgcggctggaggtggtggccggcctgcggcacggccacctggtgatcctgggcgccagcagcggcagcagcgcccccaagagcttcaccgtggccgagctggccgccggccaggtggtgtaccagcatgatgacagagatggcagcctgagtgacaacctggtgctgaggatggtggatggcggcggccgccaccaggtgcagttcctgttccccatcaccctggtgcctgtggatgaccagccccctgtgctgaatgccaacacaggcctgaccctggccgagggggagaccgtgcccatcctgcccctgagcctgagcgccacagacatggacagtgatgacagcctgctgctgtttgtgctggagagccccttcctgaccaccggccacctgctgctgcggcagacccacccccctcatgagaagcaggagctgctgcggggcctgtggaggaaggagggcgccttctatgaaagaacagtgacagagtggcagcagcaggacatcacagagggccgcctcttctaccgccacagcggcccccacagccctggccctgtgacagaccagttcaccttccgggtgcaggacaaccacgacccccccaaccagagcggcctgcagagatttgtgatccgcatccaccctgtggaccggctgcccccagagctgggcagcggctgccccctgaggatggtggtgcaggagagccagctgacccccctgaggaagaagtggctgcgctacacagacctggacacagatgaccgggagctgcgctacacagtgacccagagccccacagacacagatgagaaccacctgcctgcccccctgggcaccctggtgctgacagacaaccccagcgtggtggtgacccacttcacccaggcccagatcaaccaccacaagatcgcctaccggcccccaggccaggagctgggcgtggccaccagggtggcccagttccagttccaggtggaggacagagctggaaatgtggcccctggcaccttcaccctgtacctgcaccctgtggacaaccagcccccagagatcctgaacacaggcttcaccatccaggagaagggccaccacatcctgtctgaaacagagctgcacgtgaatgatgtggacacagatgtggcccacatctccttcaccctgacccaggcccccaagcacggccacatgagggtgtctggccagatcctgcacgtgggcggcctcttccacctggaggacatcaagcagggccgggtgtcctatgcccacaatggagacaagagcctgacagacagctgcagcctggaggtgtctgacagacaccacgtggtgcccatcaccctgcgggtgaatgtgcggcctgtggatgatgaggtgcccatcctgagccaccccaccggcaccctggagagctacctggatgtgctggagaatggagccacagagatcacagccaacgtcatcaagggcaccaatgaggagacagatgacctgatgctgaccttcctgctggaggacccccccctgtatggagagatcctggtgaatggcatcccagctgagcagttcacccagagggacatcctggagggctctgtggtgtacacccacaccagcggggagatcggcctgctgcccaaggctgacagcttcaacctgagcctgagtgacatgagccaggagtggagaattggaggcaacaccatccagggcgtgaccatctgggtgaccatcctgcctgtggacagccaggcccctgagatctttgtgggggagcagctgattgtgatggagggggacaagagcgtcatcacctctgtgcacatctctgcagaagatgtggacagcctgaatgatgacatcctgtgcaccatcgtcatccagcccaccagcggctacgtggagaacatcagccctgcccctggcagcgagaagagcagagctggcatcgccatcagcgccttcaacctgaaggacctgcggcagggccacatcaactacgtgcagagcgtgcacaagggcgtggagcctgtggaggacagatttgtgttccgctgcagtgatggcatcaacttcagcgagcggcagttcttccccatcgtcatcatccccaccaatgatgagcagcctgagatgttcatgagggagttcatggtgatggagggcatgagcctggtgattgacacccccatcctgaatgctgctgatgctgatgtgcccctggatgacctgaccttcaccatcacccagttccccacccacggccacatcatgaaccagctgatcaatggcaccgtgctggtggagagcttcaccctggaccagatcatcgagagcagcagcatcatctatgaacatgatgacagcgagacccaggaggacagctttgtgatcaagctgacagatggcaagcacagcgtggagaagacagtgctgatcatcgtcatccctgtggatgatgagacccccaggatgaccatcaacaacggcctggagattgagatcggggacaccaagatcatcaacaacaagatcctgatggccacagacctggacagcgaggacaagagcctggtgtacatcatccgctatggccctggccacggcctgctgcagaggaggaagcccaccggggcctttgagaacatcaccctgggcatgaacttcacccaggatgaggtggacaggaacctgatccagtatgtgcacctgggccaggagggcatccgggacctgatcaagtttgatgtgacagatggcatcaaccccctgattgaccgctacttctacgtgtccatcggcagcattgatattgtgtttcctgatgtgatcagcaaaggagtgtccctgaaggagggcggcaaggtgaccctgaccacagacctgctgagcaccagtgacctgaacagcccagatgagaacctggtgttcaccatcacccgggcccccatgaggggccacctggagtgcacagaccagcccggggtgtccatcaccagcttcacccagctgcagctggccggcaacaagatctactacatccacacagcagatgatgaggtgaagatggacagctttgagttccaggtgacagatggaagaaatcctgtgttccgcaccttccgcatcagcatcagtgatgtggacaacaagaagcctgtggtgaccatccacaagctggtggtgtctgagagcgagaacaagctgatcaccccatttgagctgactgtggaggaccgggacaccccagacaagctgctgaagttcaccatcacccaggtgcccatccacggccacctgctcttcaacaacaccaggcctgtgatggtgttcaccaagcaggacctgaatgaaaatctcatctcctacaagcatgatggaacagagagcagtgaagattccttctccttcaccgtgacagatggcacccacacagacttctacgtgtttcctgacacagtgtttgagacccggcggccccaggtgatgaagatccaggtgctggccgtggacaacagcgtgccccagattgctgtgaacaagggggccagcaccctgcggaccctggccaccggccacctgggcttcatgatcaccagcaagatcctgaaggtggaggaccgggacagcctgcacatcagcctgcgcttcatcgtgacagaggccccccagcacggctacctgctgaacctggacaagggcaaccacagcatcacccagttcacccaggccgacattgatgacatgaagatctgctacgtgctgcgggagggcgccaatgccaccagtgacatgttctactttgctgtggaggatggcggcggcaacaagctgacctaccagaacttccggctgaactgggcctggatcagctttgagaaggagtactacctggtgaatgaagacagcaagttcctggatgtggtgctgaagagaagaggctacctgggggagaccagcttcatcagcatcggcacccgggacagaacagctgagaaggacaaggacttcaagggcaaggcccagaagcaggtgcagttcaaccctggccagacccgggccacctggagggtgcgcatcctgagtgatggagaacatgagcagagcgagaccttccaggtggtgctgtctgagcctgtgctggccgccctggagttccccaccgtggccaccgtggagatcgtggaccctggagatgagcccaccgtcttcatcccccagagcaagtacagcgtggaggaggatgtgggggagctgttcatccccatcagaagaagtggagatgtgtcccaggagctgatggtggtgtgctacacccagcagggcacagccaccggcaccgtgcccacctctgtgctgagctacagcgactacatcagcaggcctgaggaccacacctctgtggtgcgctttgacaaggatgagcgggagaagctgtgcagaattgtcatcattgatgacagcctgtatgaggaggaggagaccttccacgtgctgctgtccatgcccatgggcggcagaattggcagcgagttccctggggcccaggtgaccatcgtgcctgacaaggatgatgagcccatcttctactttggagatgtggagtacagcgtggatgagagcgctggctacgtggaggtgcaggtgtggaggactggaacagacctgagcaagagcagctctgtgacagtgcgcagcaggaagacagacccccccagcgcagatgctggaacagattatgtgggcatcagcaggaacctggactttgcccctggggtgaacatgcagcctgtgcgggtggtgatcctggatgacctgggccagcctgccctggagggcatcgagaagtttgagctggtgctgaggatgcccatgaatgctgccctgggggagcccagcaaggccaccgtgtccatcaatgattctgtgtctgacctgcccaagatgcagttcaaggagcgcatctacacaggcagcgagagtgatggccagatcgtgaccatgatccacaggactggagatgtgcagtaccgcagctctgtgcgctgctacacccggcagggcagcgcccaggtgatgatggactttgaggagcggcccaacacagacaccagcatcatcaccttcctgcccggggagacagagaagccctgcatcctggagctgatggatgatgtgctgtatgaggaggtggaggagctgcggctggtgctgggcaccccccagagcaacagcccctttggagctgctgtgggggagcagaatgagaccctcatccgcatcagagatgatgctgacaagacagtcatcaagtttggagagaccaagttctctgtgacagagcccaaggagcccggggagagcgtggtgatccgcatccctgtgatccggcagggcgacaccagcaaggtgtccatcgtgcgggtgcacaccaaggatggcagcgccaccagcggggaggactaccaccctgtgtctgaggagattgagttcaaggagggggagacccagcacgtggtggagattgaggtgacctttgatggagtgcgggagatgagggaggccttcaccgtgcacctgaagccagatgagaacatgattgctgagatgcagctgaccaaggccatcgtgtacatcgaggagatgagctccatggctgatgtgaccttccccagcgtgccccagatcgtgtccctgctgatgtatgatgacaccagcaaggccaaggagagcgctgagcccatgagcggctaccctgtgatctgcatcacagcctgcaaccccaagtacagcgactatgacaagacaggcagcatctgtgccagcgagaacatcaatgacaccctgacccgctaccgctggctgatcagcgccccagctggcccagatggagtgaccagccccatgagggaggtggactttgacaccttcttcaccagcagcaagatggtgaccctggacagcatctacttccagcccggcagccgggtgcagtgtgccgcccgggctgtgaacaccaatggagatgagggcctggagctgatgagccccatcgtgaccatcagccgggaggagggcctgtgccagccccgggtgcctggggtggtgggcgctgagcccttcagcgccaagctgcgctacacaggcccagaagatgctgactacaccaacctgatcaagctgactgtgaccatgccccacattgatggcatgctgcccgtcatcagcacccgggagctgagcaactttgagctgaccctgagcccagatggcaccagggtgggcaaccacaagtgcagcaacctgctggactacacagaggtgaagacccactacggcttcctgacagatgccaccaagaaccctgagatcatcggggagacctacccctaccagtacagcctgagcatccggggcagcaccaccctgcgcttctacagaaacctgaacctggaggcctgcctgtgggagtttgtgtcctactatgacatgtctgagctgctggccgactgtggcggcaccatcggcacagatggccaggtgctgaacctggtgcagagctatgtgaccctgcgggtgcccctgtatgtgtcctatgtgttccacagccctgtgggcgtgggcggctggcagcactttgacctgaagtctgagctgcggctgacctttgtgtatgacacagccatcctgtggaatgatggcatcggcagccccccagaggccgagctgcagggcagcctgtaccccacctccatgagaattggagatgagggccgcctggccgtgcacttcaagacagaggcccagttccacggcctgtttgtgctgagccacccagccagcttcaccagcagcgtcatcatgtctgctgaccaccctggcctgaccttcagcctgcggctcatccgctctgagcccacctacaaccagcctgtgcagcagtggagctttgtgtctgactttgctgtgcgggactacagcggcacctacacagtgaagctggtgccctgcacagcccccagccaccaggagtaccgcctgcctgtgacctgcaacccccgggagcctgtgacctttgacctggacatccgcttccagcaggtgtctgaccctgtggccgctgagttcagcctgaacacccagatgtacctgctgagcaagaagagcctgtggctgagtgatggctccatgggcttcggccaggagagtgatgtggcctttgctgagggggacatcatctacggccgggtgatggtggaccctgtgcagaacctgggggacagcttctactgcagcattgagaaggtgttcctgtgcacaggagcagatggctacgtgcccaagtacagccccatgaatgcagaatatggctgcctggccgacagccccagcctgctgtaccgcttcaagatcgtggacaaggcccagcctgagacccaggccaccagctttggaaatgtgctcttcaatgccaagctggccgtggatgatcctgaggccatcctgctggtgaaccagcccggcagtgatggcttcaaggtggacagcacccccctcttccaggtggccctgggccgggagtggtacatccacaccatctacacagtgcgcagcaaggacaatgccaacagaggaattggcaagaggtctgtggagtaccacagcctggtgtcccagggcaagccccagagcaccaccaagagcaggaagaagcgggagatccgcagcacccccagcctggcctgggagattggagctgagaacagccggggcaccaacatccagcacatcgccctggacaggaccaagaggcagatcccccacggccgggcccccccagatggcatcctgccctgggagctgaacagccccagcagcgctgtgtccctggtgacagtggtgggcggcaccaccgtgggcctgctgaccatctgcctgactgtgattgctgtgctgatgtgccggggcaaggagagcttccggggcaaggatgcccccaagggcagcagcagcagcgagcccatggtgcccccccagagccaccacaatgacagcagcgaggtgtag

SEQ ID NO: 152880 - DNA, 12039 bp, Artificial Sequence
  Description of Artificial Sequence: Synthetic coding sequence
atgggcgtgctgaaggtgtggctgggcctggccctggccctggccgagtttgctgtgctgccccaccacagcgagggcgcctgtgtgtaccaggacagcctgctggctgatgccaccatctggaagccagacagctgccagagctgccgctgccacggggacatcgtcatctgcaagccagctgtgtgcaggaacccccagtgtgcctttgagaagggggaggtgctgcagattgctgccaaccagtgctgcccagaatgtgtgctgcggaccccaggcagctgccaccacgagaagaagatccacgagcacggcacagagtgggccagcagcccctgcagcgtgtgcagctgcaaccacggggaggtgcgctgcaccccccagccctgcccccccctgagctgtggccaccaggagctggccttcatccctgagggcagctgctgccctgtgtgtgtgggcctgggcaagccctgcagctatgagggccacgtgttccaggatggagaggactggaggctgagccgctgtgccaagtgcctgtgcagaaatggagtggcccagtgcttcaccgcccagtgccagcccctcttctgcaaccaggatgagaccgtggtgcgggtgcctgggaagtgctgcccccagtgcagcgcccggagctgcagcgctgctggccaggtgtatgagcacggggagcagtggagcgaaaatgcctgcaccacctgcatctgtgacagaggagaggtgcgctgccacaagcaggcctgcctgcccctgcgctgtgggaagggccagagccgggccaggagacatggccagtgctgtgaagaatgtgtgtccccagctggcagctgcagctatgatggagtggtgcgctaccaggatgagatgtggaagggcagcgcctgtgagttctgcatgtgtgaccacggccaggtgacctgccagacaggagaatgtgccaaggtggagtgtgccagagatgaggagctgatccacctggatggcaagtgctgcccagagtgcatcagcagaaatggctactgtgtgtatgaggagaccggggagttcatgagcagcaatgccagcgaggtgaagagaattcctgagggggagaagtgggaggatggcccctgcaaggtgtgtgaatgtagaggagcccaggtgacctgctatgagcccagctgccccccctgccctgtgggcaccctggccctggaggtgaagggccagtgctgcccagactgcacctctgtgcactgccacccagactgcctgacctgcagccagagcccagaccactgtgacctgtgccaggaccccaccaagctgctgcagaatggctggtgtgtgcacagctgtggcctgggcttctaccaggccggcagcctgtgcctggcctgccagccccagtgcagcacctgcaccagcggcctggagtgcagcagctgccagccccccctgctgatgagacatggccagtgtgtgcccacctgtggagatggcttctaccaggacagacacagctgtgctgtgtgccacgagagctgtgccggctgctggggccccacagagaagcactgcctggcctgccgggaccccctgcacgtgctgagagatggcggctgtgagagcagctgtgggaagggcttctacaaccggcagggcacctgcagcgcctgtgaccagagctgtgacagctgtggccccagcagcccccgctgcctgacctgcacagagaagacagtgctgcatgatggcaagtgcatgtctgagtgccctgggggctactatgcagatgccaccggccgctgcaaggtgtgccacaacagctgtgccagctgcagcggccccacccccagccactgcacagcctgcagcccccccaaggccctgcggcagggccactgcctgccccgctgtggggagggcttctacagcgaccatggagtgtgcaaggcctgccacagcagctgcctggcctgcatgggccctgcccccagccactgcaccggctgcaagaagccagaggagggcctgcaggtggagcagctgagtgatgtgggcatccccagcggggagtgcctggcccagtgccgggcccacttctacctggagagcacaggcatctgtgaggcctgccaccagagctgcttccgctgtgccggcaagagcccccacaactgcacagactgtggccccagccacgtgctgctggatggccagtgcctgagccagtgcccagatggctacttccaccaggagggcagctgcacagagtgccaccccacctgccggcagtgccacggccccctggagagtgactgcatcagctgctacccccacatcagcctgaccaatggaaactgcaggaccagctgccgggaggagcagttcctgaacctggtgggctactgtgccgactgccaccacctgtgccagcactgtgccgctgacctgcacaacacaggcagcatctgcctgcgctgccagaatgcccactacctgctgctgggggaccactgtgtgcctgactgccccagcggctactatgcagagcggggggcctgcaagaagtgccacagcagctgcaggacctgccagggccggggccccttcagctgcagcagctgtgacaccaacctggtgctgagccacacaggcacctgcagcaccacctgcttccctggccactacctggatgacaaccacgtgtgccagccctgcaacacccactgcggcagctgtgacagccaggccagctgcaccagctgccgggaccccaacaaggtgctgctgtttggagagtgccagtatgagagctgtgccccccagtactacctggacttcagcaccaacacctgcaaggaatgtgactggagctgcagcgcctgcagcggccccctgaagacagactgcctgcagtgcatggatggctacgtgctgcaggatggagcctgtgtggagcagtgcctgagcagcttctaccaggacagcggcctgtgcaagaactgtgacagctactgcctgcagtgccagggcccccatgaatgtacccgctgcaagggccccttcctgctgctggaggcccagtgtgtgcaggagtgtgggaagggctactttgctgaccacgccaagcacaagtgcacagcctgcccccagggctgcctgcagtgcagccaccgggaccgctgccacctgtgtgaccacggcttcttcctgaagagcggcctgtgtgtgtacaactgtgtgcccggcttctctgtgcacaccagcaatgagacctgcagcggcaagatccacacccccagcctgcacgtgaatggcagcctcatcctgcccatcggcagcatcaagcccctggacttcagcctgctgaatgtgcaggaccaggagggccgggtggaggacctgctcttccacgtggtgtccacccccaccaacggccagctggtgctgagcagaaatggcaaggaggtgcagctggacaaggccggccgcttctcctggaaggatgtgaatgagaagaaggtgcgctttgtgcacagcaaggagaagctgaggaagggctacctgttcctgaagatcagtgaccagcagttcttcagcgagccccagctgatcaacatccaggccttcagcacccaggccccctacgtgctgagaaatgaggtgctgcacatcagcagaggagagcgggccaccatcaccacccagatgctggacatcagagatgatgacaacccccaggatgtggtgattgagatcattgatcctcccctgcacggccagctgctgcagaccctgcagagccctgccacccccatctaccagttccagctggatgagctgagccggggcctgctgcactacgcccatgatggcagtgacagcaccagtgatgtggccgtgctgcaggccaatgatggccacagcttccacaacatcctcttccaggtgaagacagtgccccagaatgaccggggcctgcagctggtggccaacagcatggtgtgggtgcctgagggcggcatgctgcagatcaccaaccgcatcctgcaggccgaggcccctggggccagcgctgaggagatcatctacaagatcacccaggactacccccagtttggagaggtggtgctgctggtgaacatgcctgctgacagccctgcagatgagggccagcacctgcctgatggccgcacagccacccccaccagcaccttcacccagcaggacatcaatgaaggcatcgtgtggtaccgccacagcggggccccagcccagagcgacagcttccgctttgaggtgtcctctgccagcaatgcccagacccggctggagagccacatgttcaacatcgccatcctgccccagaccccagaggcccccaaggtgtccctggaggccagcctgcacatgacagcccgggaggatggcctgaccgtcatccagccccacagcctgtccttcatcaacagcgagaagcccagcggcaagatcgtgtacaacatcaccctgcccctgcaccccaaccagggcatcatcgagcaccgggaccacccccacagccccatccgctacttcacccaggaggacatcaaccagggcaaggtgatgtacagacctcctcctgctgccccccacctgcaggagctgatggccttctcctttgctggcctgcctgagagcgtgaagttccacttcaccgtgtctgatggagagcacaccagccctgagatggtgctgaccatccacctgctgcccagcgaccagcagctgcctgtgttccaggtgacagccccccggctggccgtgtcccctgggggcagcacctctgtgggcctgcaggtggtggtgagagatgctgagacagcccccaaggagctgttctttgagctgcggcggcccccccagcacggcgtgctgctgaagcacacagctgagttcagaagacccatggccaccggggacaccttcacctatgaagatgtggagaagaatgccctgcagtacatccatgatggcagcagcaccagagaagattccatggagatctctgtgacagatggcctgactgtgaccatgctggaggtgcgggtggaggtgtccctgtctgaagatcggggcccccggctggccgccggcagcagcctgagcatcaccgtggccagcaagagcacagccatcatcaccaggagccacctggcctacgtggatgacagcagcccagaccctgagatctggatccagctgaactacctgcccagctatggcaccctgctgcgcatcagcggcagcgaggtggaggagctgtctgaggtgagcaacttcaccatggaggacatcaacaacaagaagatccgctacagcgctgtgtttgaaacagatggccacctggtgacagacagcttctacttctctgtgtctgacatggaccacaaccacctggacaaccagatcttcaccatcatgatcaccccagctgagaaccccccacctgtgattgcctttgctgacctgatcaccgtggatgaaggaggccgggcccccctgtccttccaccacttctttgccacagatgatgatgacaacctgcagagagatgccatcatcaagctgagcgccctgcccaagtatggctgcatcgagaacacaggcaccggggaccgcttcggccctgagacagccagtgacctggaggccagcttccccatccaggatgtgctggagaactacatctactacttccagagcgtgcatgagagcattgagcccacccatgacatcttctccttctacgtgtctgatggcaccagccgctctgagatccacagcatcaacatcaccattgaaaggaagaatgatgagccccccaggatgaccctgcagcccctgcgggtgcagctgagcagcggcgtggtgatcagcaacagcagcctgagcctgcaggacctggacaccccagacaatgaactcatctttgtgctgaccaagaagccagaccacggccacgtgctgtggaggcagacagccagcgagcccctggagaatggccgggtgctggtgcagggcagcaccttcacctaccaggacatcctggccggcctggtgggctacgtgcccagcgtgcccggcatggtggtggatgagttccagttcagcctgacagatggcctgcacgtggacaccggccgcatgaagatctacacagagctgcctgccagtgacaccccccacctggccatcaaccagggcctgcagctgtctgctggctctgtggcccgcatcacagagcagcacctgaaggtgacagacatcgacagtgatgaccaccaggtgatgtacatcatgaaggaggaccccggggccggccgcctgcagatgatgaagcacggcaacctggagcagatcagcatcaagggccccatccgctccttcacccaggccgacatcagccagggccacgtggagtacagccatggaactggagagcccggcggcagctttgccttcaagtttgatgtggtggatggagagggcaaccggctgattgacaagagcttcagcatcagcatcctggaggacaagagcccccctgtgatcaccaccaacaagggcctggtgctggatgagaacagcgtgaagaagatcaccaccctgcagctgagcgccacagaccaggacagcggccccacagagctgatctaccgcatcacccggcagccccagctgggccacctggagcacgccgccagccctggcatccagatcagcagcttcacccaggccgacctgaccagcagaaatgtgcagtatgtgcacagcagcgaggccgagaagcacagtgatgccttctccttcaccctgagtgatggagtgtctgaggtgacccagaccttccacatcaccctgcaccctgtggatgacagcctgcctgtggtgcagaacctgggcatgagggtgcaggagggcatgaggaagaccatcacagaatttgagctgaaggctgtggatgctgacacagaggccgagagcgtgaccttcaccatcgtgcagccccccaggcatggcaccatcgagaggaccagcaatggccagcacttccacctgaccagcaccttcaccatgaaggacatctaccagaacagagtgtcctacagccatgatggcagcaacagcctgaaggaccgcttcaccttcaccgtgtctgatggcaccaaccccttcttcatcatcgaggagggcggcaaggagatcatgacagctgccccccagcccttccgggtggacatcctgcctgtggatgatggcaccccccgcatcgtgaccaacctgggcctgcagtggctggagtacatggatggcaaggccaccaacctgatcaccaagaaggagctgctgaccatggaccctgacacagaagatgcccagctggtgtatgagatcaccaccggccccaagcacggctttgtggagaacaagctgcagcccggccgggccgccgccaccttcacccaggaggatgtgaacctgggcctcatccgctacgtgctgcacaaggagaagatccgggagatgatggacagcttccagttcctggtgaaggacagcaagcccaacgtggtgtctgacaacgtgttccacatccagtggagcctcatctccttcaagtacaccagctacaacgtgtctgagaaggccggctctgtgtctgtgacagtgcagaggacaggcaacctgaaccagtatgccatcgtgctgtgcaggacagagcagggcacagccagcagcagcagccgggtgagcagccagcccggccagcaggactatgtggagtatgccggccaggtgcagtttgatgagcgggaggacaccaagagctgcaccatcgtcatcaatgatgatgatgtgtttgaaaatgtggagagcttcaccgtggagctgtccatgcctgcctatgccctgctgggggagttcacccaggccaaggtgatcatcaatgacacagaagatgagcccaccctggagtttgacaagaagatctactgggtgaatgaatctgctggcttcctgtttgcccccatcgagaggaaaggagatgccagcagcatcgtgtctgccatctgctacacagtgcccaagagcgccatgggcagcagcctgtatgccctggagagcggcagtgacttcaagagccggggcatgtctgctgccagcagggtcatcttcggccctggggtgaccatgagcacctgtgatgtgatgctgattgatgattctgaatatgaggaggaggaggagtttgaaattgccctggctgatgccagtgacaatgcccgcatcggccgggtggccacagccaaggtgctgatcagcggccccaatgatgccagcacagtgtccctgggcaacacagccttcaccgtgtctgaagatgctggcaccgtgaagatccctgtgatccgccacggcacagacctgagcacctttgcctctgtgtggtgtgccacccggcccagcgaccctgccagcgccaccccaggagtggactatgtgcccagcagcaggaaggtggagtttggacctggggtcatcgagcagtactgcaccctgaccatcctggatgacacccagtaccctgtgattgagggcctggagacctttgtggtgttcctgagcagcgcccagggcgctgagctgaccaagcccttccaggccgtgattgccatcaatgacaccttccaggatgtgcccagcatgcagtttgccaaggacctgctgctggtgaaggagaaggagggcgtgctgcacgtgcccatcaccaggtctggggacctgtcctatgagagctctgtgcgctgctacacccagagccacagcgcccaggtgatggaggactttgaggagcggcagaatgctgacagcagccgcatcaccttcctgaagggggacaaggtgaagaactgcaccgtgtacatccatgatgacagcatgtttgagcctgaggagcagttccgggtgtacctgggcctgcccctgggcaaccactggagcggggccagaattggcaagaacaacatggccaccatcaccatcagcaatgatgaagatgcccccaccatcgagtttgaggaggccgcctaccaggtgcgggagcctgctggcccagatgccatcgccatcctgaacatcaaggtgatcagaagaggagaccagaacagaaccagcaaggtgcgctgcagcaccagagatggcagcgcccagagcggcgtggactactaccccaagagccgggtgctgaagttcagccctggggtggaccacatcttcttcaaggtggagatcctgagcaatgaagatcgggagtggcatgagagcttcagcctggtgctgggcccagatgatcctgtggaggccgtgctgggagatgtgaccacagccaccgtgaccatcctggaccaggaggccgccggcagcctcatcctgcctgccccacccatcgtggtgaccctggccgactatgaccacgtggaggaggtgaccaaggagggcgtgaagaagagccccagccctggctaccccctggtgtgtgtgaccccctgtgacccccacttccccaggtatgctgtgatgaaggagcgctgcagcgaggccggcatcaaccagacctctgtgcagttctcctgggaggtggccgcccccacagatggaaatggagcccggagcccctttgagaccatcacagacaacacccccttcacctctgtgaaccacatggtgctggacagcatctacttcagccgccgcttccacgtgcgctgtgtggccaaggctgtggacaaggtgggccacgtgggcacccccctgcggagcaacatcgtgaccatcggcacagattctgccatctgccacacccctgtggtggccggcaccagccggggcttccaggcccagagcttcatcgccaccctgaagtacctggatgtgaagcacaaggagcaccccaaccgcatccacatctctgtgcagatcccccaccaggacggcatgctgcccctcatcagcaccatgcccctgcacaacctgcacttcctgctgtctgagagcatctaccgccaccagcacgtgtgcagcaacctggtgaccacctatgacctgcggggcatcagcgaggccggcttcctggatgatgtggtgtatgacagcacagccctgggccctggctatgaccggcccttccagtttgaccccagcgtgcgggagcccaagaccatccagctgtacaagcacctgaacctgaagagctgtgtgtggacctttgatgcctactatgacatgacagagctgattgatgtgtgtggcggctctgtgacagctgacttccaggtgcgggacagcgcccagagcttcctgactgtgcacgtgcccctgtatgtgtcctacatctacgtgacagccccccggggctgggccagcctggagcaccacacagagatggagttctccttcttctatgacacagtgctgtggaggacaggcatccagacagattctgtgctgagcgcccggctgcagatcatccgcatctacatccgggaggatggccgcctggtgattgagttcaagacccacgccaagttccggggccagtttgtgatggagcaccacaccctgcctgaggtgaagagctttgtgctgaccccagaccacctgggcggcattgaatttgacctgcagctgctgtggagcgcccagacctttgacagcccccaccagctgtggagggccaccagcagctacaacaggaaggactacagcggggagtacaccatctacctgatcccctgcaccgtgcagcccacccagccctgggtggaccccggggagaagcccctggcctgcacagcccacgcccctgagcgcttcctgatccccatcgccttccagcagaccaacagacctgtgcctgtggtgtacagcctgaacacagagttccagctgtgcaacaatgagaaggtgttcctgatggaccccaacaccagtgacatgagcctggccgagatggactacaagggggccttcagcaagggccagatcctgtatggccgggtgctgtggaaccctgagcagaacctgaacagcgcctacaagctgcagctggagaaggtgtacctgtgcaccgggaaggatggctacgtgcccttctttgaccccaccggcaccatctacaatgaaggcccccagtatggctgcatccagcccaacaagcacctgaagcaccgcttcctgctgctggacaggaaccagcctgaggtgacagacaagtacttccatgatgtgccctttgaggcccactttgccagcgagctgcctgacttccacgtggtgagcaacatgcctggggtggatggcttcaccctgaaggtggatgccctgtacaaggtggaggccggccaccagtggtacctgcaggtgatctacatcatcggccctgacaccatcagcggcccccgggtgcagaggagcctgacagcccccctgcggaggaacagaagagacctggtggagccagatggccagctgatcctggatgacagcctcatctatgacaatgaaggagaccaggtgaagaatggcaccaacatgaagagcctgaacctggagatgcaggagctggccgtggccgccagcctgagccagacaggagccagcatcggcagcgccctggccgccatcatgctgctgctgctggtgttcctggtggcctgcttcatcaacaggaagtgccagaagcagaggaagaagaagccagctgaggacatcctggaggagtaccccctgaacaccaaggtggaggtgcccaagaggcacccagacagagtggagaagaatgtgaacagacactactgcaccgtgagaaatgtgaacatcctgtctgagcctgaggccgcctacaccttcaagggggccaaggtgaagaggctgaacctggaggtgcgggtgcacaacaacctgcaggacggcacagaggtgtag

SEQ ID NO: 152881 - DNA, 2214 bp, Artificial Sequence
  Description of Artificial Sequence: Synthetic coding sequence
atgggcgtgctgaaggtgtggctgggcctggccctggccctggccgagtttgctgtgctgccccaccacagcgagggcgcctgtgtgtaccaggacagcctgctggctgatgccaccatctggaagccagacagctgccagagctgccgctgccacggggacatcgtcatctgcaagccagctgtgtgcaggaacccccagtgtgcctttgagaagggggaggtgctgcagattgctgccaaccagtgctgcccagaatgtgtgctgcggaccccaggcagctgccaccacgagaagaagatccacgagcacggcacagagtgggccagcagcccctgcagcgtgtgcagctgcaaccacggggaggtgcgctgcaccccccagccctgcccccccctgagctgtggccaccaggagctggccttcatccctgagggcagctgctgccctgtgtgtgtgggcctgggcaagccctgcagctatgagggccacgtgttccaggatggagaggactggaggctgagccgctgtgccaagtgcctgtgcagaaatggagtggcccagtgcttcaccgcccagtgccagcccctcttctgcaaccaggatgagaccgtggtgcgggtgcctgggaagtgctgcccccagtgcagcgcccggagctgcagcgctgctggccaggtgtatgagcacggggagcagtggagcgaaaatgcctgcaccacctgcatctgtgacagaggagaggtgcgctgccacaagcaggcctgcctgcccctgcgctgtgggaagggccagagccgggccaggagacatggccagtgctgtgaagaatgtgtgtccccagctggcagctgcagctatgatggagtggtgcgctaccaggatgagatgtggaagggcagcgcctgtgagttctgcatgtgtgaccacggccaggtgacctgccagacaggagaatgtgccaaggtggagtgtgccagagatgaggagctgatccacctggatggcaagtgctgcccagagtgcatcagcagaaatggctactgtgtgtatgaggagaccggggagttcatgagcagcaatgccagcgaggtgaagagaattcctgagggggagaagtgggaggatggcccctgcaaggtgtgtgaatgtagaggagcccaggtgacctgctatgagcccagctgccccccctgccctgtgggcaccctggccctggaggtgaagggccagtgctgcccagactgcacctctgtgcactgccacccagactgcctgacctgcagccagagcccagaccactgtgacctgtgccaggaccccaccaagctgctgcagaatggctggtgtgtgcacagctgtggcctgggcttctaccaggccggcagcctgtgcctggcctgccagccccagtgcagcacctgcaccagcggcctggagtgcagcagctgccagccccccctgctgatgagacatggccagtgtgtgcccacctgtggagatggcttctaccaggacagacacagctgtgctgtgtgccacgagagctgtgccggctgctggggccccacagagaagcactgcctggcctgccgggaccccctgcacgtgctgagagatggcggctgtgagagcagctgtgggaagggcttctacaaccggcagggcacctgcagcgcctgtgaccagagctgtgacagctgtggccccagcagcccccgctgcctgacctgcacagagaagacagtgctgcatgatggcaagtgcatgtctgagtgccctgggggctactatgcagatgccaccggccgctgcaaggtgtgccacaacagctgtgccagctgcagcggccccacccccagccactgcacagcctgcagcccccccaaggccctgcggcagggccactgcctgccccgctgtggggagggcttctacagcgaccatggagtgtgcaaggcctgccacagcagctgcctggcctgcatgggccctgcccccagccactgcaccggctgcaagaagccagaggagggcctgcaggtggagcagctgagtgatgtgggcatccccagcggggagtgcctggcccagtgccgggcccacttctacctggagagcacaggcatctgtgagggccagaacctggacttctgccagaacctggaggtgatctctgctgtgtgcctgggcatcagcagcacagagaactag

SEQ ID NO: 152882 - DNA, 954 bp, Artificial Sequence
  Description of Artificial Sequence: Synthetic coding sequence
atgggcgtgctgaaggtgtggctgggcctggccctggccctggccgagtttgctgtgctgccccaccacagcgagggcgcctgtgtgtaccaggacagcctgctggctgatgccaccatctggaagccagacagctgccagagctgccgctgccacggggacatcgtcatctgcaagccagctgtgtgcaggaacccccagtgtgcctttgagaagggggaggtgctgcagattgctgccaaccagtgctgcccagaatgtgtgctgcggaccccaggcagctgccaccacgagaagaagatccacgagcacggcacagagtgggccagcagcccctgcagcgtgtgcagctgcaaccacggggaggtgcgctgcaccccccagccctgcccccccctgagctgtggccaccaggagctggccttcatccctgagggcagctgctgccctgtgtgtgtgggcctgggcaagccctgcagctatgagggccacgtgttccaggatggagaggactggaggctgagccgctgtgccaagtgcctgtgcagaaatggagtggcccagtgcttcaccgcccagtgccagcccctcttctgcaaccaggatgagaccgtggtgcgggtgcctgggaagtgctgcccccagtgcagcgcccggagctgcagcgctgctggccaggtgtatgagcacggggagcagtggagcgaaaatgcctgcaccacctgcatctgtgacagaggagaggtgcgctgccacaagcaggcctgcctgcccctgcgctgtgggaagggccagagccgggccaggagacatggccagtgctgtgaagaatgtgtgtccccagccctggccagccagagcgtgggcatcaccggcatgagccaccacgcccagagcctgctgggccccttcctgacccagatcaagaagccccacttcagctgcctggagtag

SEQ ID NO: 152883 - DNA, 6726 bp, Artificial Sequence
  Description of Artificial Sequence: Synthetic coding sequence
tgaagtgaggtgagcaacttcaccatggaggacatcaacaacaagaagatccgctacagcgctgtgtttgaaacagatggccacctggtgacagacagcttctacttctctgtgtctgacatggaccacaaccacctggacaaccagatcttcaccatcatgatcaccccagcagaaaatcctcctcctgtgattgcctttgctgacctgatcaccgtggatgagggcggccgggcccccctgtccttccaccacttctttgccacagatgatgatgacaacctgcagagagatgccatcatcaagctgagcgccctgcccaagtatggctgcattgaaaatactggaactggagacagatttggacctgagacagccagtgacctggaggccagcttccccatccaggatgtgctggagaactacatctactacttccagagcgtgcatgagagcattgagcccacccatgacatcttctccttctacgtgtctgatggcaccagccgctctgagatccacagcatcaacatcaccatcgagaggaagaatgatgagccccccaggatgaccctgcagcccctgcgggtgcagctgagcagtggagtggtgatcagcaacagcagcctgagcctgcaggacctggacaccccagacaatgagctgatctttgtgctgaccaagaagccagaccacggccacgtgctgtggaggcagacagccagcgagcccctggagaatggccgggtgctggtgcagggcagcaccttcacctaccaggacatcctggccggcctggtgggctacgtgcccagcgtgcccggcatggtggtggatgagttccagttcagcctgacagatggcctgcacgtggacaccggccgcatgaagatctacacagagctgcctgccagtgacaccccccacctggccatcaaccagggcctgcagctgtctgctggctctgtggcccgcatcacagagcagcacctgaaggtgacagacatcgacagtgatgaccaccaggtgatgtacatcatgaaggaggaccctggagctggccgcctgcagatgatgaagcacggcaacctggagcagatcagcatcaagggccccatccgctccttcacccaggccgacatcagccagggccacgtggagtacagccacggcaccggggagcccggcggcagctttgccttcaagtttgatgtggtggatggagagggcaaccggctgattgacaagagcttcagcatcagcatcctggaggacaagagcccccctgtgatcaccaccaacaagggcctggtgctggatgaaaattctgtgaagaagatcaccaccctgcagctgagcgccacagaccaggacagcggccccacagagctgatctaccgcatcacccggcagccccagctgggccacctggagcacgccgccagccctggcatccagatcagcagcttcacccaggccgacctgaccagcagaaatgtgcagtatgtgcacagcagcgaggccgagaagcacagtgatgccttctccttcaccctgagtgatggagtgtctgaggtgacccagaccttccacatcaccctgcaccctgtggatgacagcctgcctgtggtgcagaacctgggcatgagggtgcaggagggcatgaggaagaccatcacagaatttgagctgaaggctgtggatgctgacacagaagctgagagcgtgaccttcaccatcgtgcagcccccaagacatggcaccattgaaagaaccagcaatggccagcacttccacctgaccagcaccttcaccatgaaggacatctaccagaacagagtgtcctacagccatgatggcagcaacagcctgaaggaccgcttcaccttcaccgtgtctgatggcaccaaccccttcttcatcatcgaggagggcggcaaggagatcatgacagctgccccccagcccttccgggtggacatcctgcctgtggatgatggcaccccaagaattgtgaccaacctgggcctgcagtggctggagtacatggatggcaaggccaccaacctgatcaccaagaaggagctgctgaccatggaccctgacacagaagatgcccagctggtgtatgagatcaccaccggccccaagcacggctttgtggagaacaagctgcagcccggccgggctgctgccaccttcacccaggaggatgtgaacctgggcctcatccgctacgtgctgcacaaggagaagatccgggagatgatggacagcttccagttcctggtgaaggacagcaagcccaacgtggtgtctgacaacgtgttccacatccagtggagcctcatctccttcaagtacaccagctacaacgtgtctgagaaggccggctctgtgtctgtgacagtgcagaggactggaaacctgaaccagtatgccatcgtgctgtgcaggacagagcagggcacagccagcagcagcagccgggtgagcagccagcccggccagcaggactatgtggagtatgccggccaggtgcagtttgatgaaagagaggacaccaagagctgcaccatcgtcatcaatgatgatgatgtgtttgaaaatgtggagagcttcaccgtggagctgtccatgcctgcctatgccctgctgggggagttcacccaggccaaggtgatcatcaatgacacagaagatgagcccaccctggagtttgacaagaagatctactgggtgaatgaatctgctggcttcctgtttgcccccattgaaagaaaaggagatgccagcagcatcgtgtctgccatctgctacacagtgcccaagagcgccatgggcagcagcctgtatgccctggagagcggcagtgacttcaagagccggggcatgtctgctgccagcagggtcatctttggacctggggtgaccatgagcacctgtgatgtgatgctgattgatgacagtgaatatgaggaggaggaggagtttgagatcgccctggctgatgccagtgacaatgccagaattggccgggtggccacagccaaggtgctgatcagcggccccaatgatgccagcacagtgtccctgggcaacacagccttcaccgtgtctgaagatgctggcaccgtgaagatccctgtgatcagacatggaacagacctgagcacctttgcctctgtgtggtgtgccacccggcccagcgaccctgccagcgccaccccaggagtggactatgtgcccagcagcaggaaggtggagtttggacctggggtgattgagcagtactgcaccctgaccatcctggatgacacccagtaccctgtgattgagggcctggagacctttgtggtgttcctgagcagcgcccagggcgctgagctgaccaagcccttccaggccgtcatcgccatcaatgacaccttccaggatgtgcccagcatgcagtttgccaaggacctgctgctggtgaaggagaaggagggcgtgctgcacgtgcccatcaccaggtctggggacctgtcctatgagagctctgtgcgctgctacacccagagccacagcgcccaggtgatggaggactttgaggagcggcagaatgctgacagcagccgcatcaccttcctgaagggggacaaggtgaagaactgcaccgtgtacatccatgatgacagcatgtttgagcctgaggagcagttccgggtgtacctgggcctgcccctgggcaaccactggagcggggcccgcatcggcaagaacaacatggccaccatcaccatcagcaatgatgaagatgcccccaccattgaatttgaggaggccgcctaccaggtgcgggagcccgccggcccagatgccatcgccatcctgaacatcaaggtgatccggcggggggaccagaacagaaccagcaaggtgcgctgcagcaccagagatggcagcgcccagagcggcgtggactactaccccaagagccgggtgctgaagttcagccctggggtggaccacatcttcttcaaggtggagatcctgagcaatgaagatcgggagtggcatgagagcttcagcctggtgctgggcccagatgatcctgtggaggccgtgctgggagatgtgaccacagccaccgtgaccatcctggaccaggaggccgccggcagcctcatcctgcctgccccacccatcgtggtgaccctggccgactatgaccacgtggaggaggtgaccaaggagggcgtgaagaagagccccagccctggctaccccctggtgtgtgtgaccccctgtgacccccacttccccaggtatgctgtgatgaaggagcgctgcagcgaggccggcatcaaccagacctctgtgcagttctcctgggaggtggccgcccccacagatggaaatggagcccggagcccctttgagaccatcacagacaacacccccttcacctctgtgaaccacatggtgctggacagcatctacttcagccgccgcttccacgtgcgctgtgtggccaaggctgtggacaaggtgggccacgtgggcacccccctgcggagcaacatcgtgaccatcggcacagacagcgccatctgccacacccctgtggtggccggcaccagccggggcttccaggcccagagcttcatcgccaccctgaagtacctggatgtgaagcacaaggagcaccccaaccgcatccacatctctgtgcagatcccccaccaggacggcatgctgcccctcatcagcaccatgcccctgcacaacctgcacttcctgctgtctgagagcatctaccgccaccagcacgtgtgcagcaacctggtgaccacctatgacctgcggggcatcagcgaggccggcttcctggatgatgtggtgtatgacagcacagccctgggccctggctatgaccggcccttccagtttgaccccagcgtgcgggagcccaagaccatccagctgtacaagcacctgaacctgaagagctgtgtgtggacctttgatgcctactatgacatgacagagctgattgatgtgtgtggcggctctgtgacagctgacttccaggtgcgggacagcgcccagagcttcctgactgtgcacgtgcccctgtatgtgtcctacatctacgtgacagccccccggggctgggccagcctggagcaccacacagagatggagttctccttcttctatgacacagtgctgtggaggacaggcatccagacagacagcgtgctgagcgcccggctgcagatcatccgcatctacatcagagaagatggccgcctggtgattgagttcaagacccacgccaagttccggggccagtttgtgatggagcaccacaccctgcctgaggtgaagagctttgtgctgaccccagaccacctgggcggcatcgagtttgacctgcagctgctgtggagcgcccagacctttgacagcccccaccagctgtggagggccaccagcagctacaacaggaaggactacagcggggagtacaccatctacctgatcccctgcaccgtgcagcccacccagccctgggtggaccctggagagaagcccctggcctgcacagcccacgcccctgagcgcttcctgatccccatcgccttccagcagaccaacagacctgtgcctgtggtgtacagcctgaacacagagttccagctgtgcaacaatgagaaggtgttcctgatggaccccaacaccagtgacatgagcctggccgagatggactacaagggggccttcagcaagggccagatcctgtatggccgggtgctgtggaaccctgagcagaacctgaacagcgcctacaagctgcagctggagaaggtgtacctgtgcaccgggaaggatggctacgtgcccttctttgaccccaccggcaccatctacaatgaaggcccccagtatggctgcatccagcccaacaagcacctgaagcaccgcttcctgctgctggacaggaaccagcctgaggtgacagacaagtacttccatgatgtgccctttgaggcccactttgccagcgagctgcctgacttccacgtggtgagcaacatgcctggggtggatggcttcaccctgaaggtggatgccctgtacaaggtggaggccggccaccagtggtacctgcaggtgatctacatcattggaccagacaccatcagcggcccccgggtgcagaggagcctgacagcccccctgcggaggaacagaagagacctggtggagccagatggccagctgatcctggatgacagcctcatctatgacaatgaaggagaccaggtgaagaatggcaccaacatgaagagcctgaacctggagatgcaggagctggccgtggccgccagcctgagccagacaggagccagcatcggcagcgccctggccgccatcatgctgctgctgctggtgttcctggtggcctgcttcatcaacaggaagtgccagaagcagaggaagaagaagccagctgaggacatcctggaggagtaccccctgaacaccaaggtggaggtgcccaagaggcacccagacagagtggagaagaatgtgaacagacactactgcaccgtgagaaatgtgaacatcctgtctgagcctgaggccgcctacaccttcaagggggccaaggtgaagaggctgaacctggaggtgcgggtgcacaacaacctgcaggatggaacagaggtgtag

SEQ ID NO: 152884 - DNA, 768 bp, Artificial Sequence
  Description of Artificial Sequence: Synthetic coding sequence
gagcggcagggccagagccgggccaggagacatggccagtgctgtgaagaatgtgtgtccccagctggcagctgcagctatgatggagtggtgcgctaccaggatgagatgtggaagggcagcgcctgtgagttctgcatgtgtgaccacggccaggtgacctgccagacaggagaatgtgccaaggtggagtgtgccagagatgaggagctgatccacctggatggcaagtgctgcccagagtgcatcagcagaaatggctactgtgtgtatgaggagaccggggagttcatgagcagcaatgccagcgaggtgaagagaattcctgagggggagaagtgggaggatggcccctgcaaggtgtgtgaatgtagaggagcccaggtgacctgctatgagcccagctgccccccctgccctgtgggcaccctggccctggaggtgaagggccagtgctgcccagactgcacctctgtgcactgccacccagactgcctgacctgcagccagagcccagaccactgtgacctgtgccaggaccccaccaagctgctgcagaatggctggtgtgtgcacagctgtggcctgggcttctaccaggccggcagcctgtgcctggatgatggcttcagcctgcctgcccctgtgctgcacgtgtaccagtgggccggcgtgctgatcctgcctgccagccctgcagatgctgcccgggctgtgtgtgcctacctgtggggccgcctgctgcccaggagccccttcctgtgctag

SEQ ID NO: 152885 - DNA, 840 bp, Artificial Sequence
  Description of Artificial Sequence: Synthetic coding sequence
atggtgctgaccatccacctgctgcccagcgaccagcagctgcctgtgttccaggtgacagccccccggctggccgtgtcccctgggggcagcacctctgtgggcctgcaggtggtggtgagagatgctgagacagcccccaaggagctgttctttgagctgcggcggcccccccagcacggcgtgctgctgaagcacacagctgagttcagaagacccatggccaccggggacaccttcacctatgaagatgtggagaagaatgccctgcagtacatccatgatggcagcagcaccagagaagattccatggagatctctgtgacagatggcctgactgtgaccatgctggaggtgcgggtggaggtgtccctgtctgaagatcggggcccccggctggccgccggcagcagcctgagcatcaccgtggccagcaagagcacagccatcatcaccaggagccacctggcctacgtggatgacagcagcccagaccctgagatctggatccagctgaactacctgcccagctatggcaccctgctgcgcatcagcggcagcgaggtggaggagctgtctgaggtgagcaacttcaccatggaggacatcaacaacaagaagatccgctacagcgctgtgtttgaaacagatggccacctggtgacagacagcttctacttctctgtgtctgacatggaccacaaccacctggacaaccagatcttcaccatcatgatcaccccagctgagaaccccccacctgtgattgcctttgctgacctgatcaccgtggatgaaggaggccgggcccccctgtccttccaccacttctgctactag

SEQ ID NO: 152886 - DNA, 5931 bp, Artificial Sequence
  Description of Artificial Sequence: Synthetic coding sequence
atgggcgtgctgaaggtgtggctgggcctggccctggccctggccgagtttgctgtgctgccccaccacagcgagggcgcctgtgtgtaccaggacagcctgctggctgatgccaccatctggaagccagacagctgccagagctgccgctgccacggggacatcgtcatctgcaagccagctgtgtgcaggaacccccagtgtgcctttgagaagggggaggtgctgcagattgctgccaaccagtgctgcccagaatgtgtgctgcggaccccaggcagctgccaccacgagaagaagatccacgagcacggcacagagtgggccagcagcccctgcagcgtgtgcagctgcaaccacggggaggtgcgctgcaccccccagccctgcccccccctgagctgtggccaccaggagctggccttcatccctgagggcagctgctgccctgtgtgtgtgggcctgggcaagccctgcagctatgagggccacgtgttccaggatggagaggactggaggctgagccgctgtgccaagtgcctgtgcagaaatggagtggcccagtgcttcaccgcccagtgccagcccctcttctgcaaccaggatgagaccgtggtgcgggtgcctgggaagtgctgcccccagtgcagcgcccggagctgcagcgctgctggccaggtgtatgagcacggggagcagtggagcgaaaatgcctgcaccacctgcatctgtgacagaggagaggtgcgctgccacaagcaggcctgcctgcccctgcgctgtgggaagggccagagccgggccaggagacatggccagtgctgtgaagaatgtgtgtccccagctggcagctgcagctatgatggagtggtgcgctaccaggatgagatgtggaagggcagcgcctgtgagttctgcatgtgtgaccacggccaggtgacctgccagacaggagaatgtgccaaggtggagtgtgccagagatgaggagctgatccacctggatggcaagtgctgcccagagtgcatcagcagaaatggctactgtgtgtatgaggagaccggggagttcatgagcagcaatgccagcgaggtgaagagaattcctgagggggagaagtgggaggatggcccctgcaaggtgtgtgaatgtagaggagcccaggtgacctgctatgagcccagctgccccccctgccctgtgggcaccctggccctggaggtgaagggccagtgctgcccagactgcacctctgtgcactgccacccagactgcctgacctgcagccagagcccagaccactgtgacctgtgccaggaccccaccaagctgctgcagaatggctggtgtgtgcacagctgtggcctgggcttctaccaggccggcagcctgtgcctggcctgccagccccagtgcagcacctgcaccagcggcctggagtgcagcagctgccagccccccctgctgatgagacatggccagtgtgtgcccacctgtggagatggcttctaccaggacagacacagctgtgctgtgtgccacgagagctgtgccggctgctggggccccacagagaagcactgcctggcctgccgggaccccctgcacgtgctgagagatggcggctgtgagagcagctgtgggaagggcttctacaaccggcagggcacctgcagcgcctgtgaccagagctgtgacagctgtggccccagcagcccccgctgcctgacctgcacagagaagacagtgctgcatgatggcaagtgcatgtctgagtgccctgggggctactatgcagatgccaccggccgctgcaaggtgtgccacaacagctgtgccagctgcagcggccccacccccagccactgcacagcctgcagcccccccaaggccctgcggcagggccactgcctgccccgctgtggggagggcttctacagcgaccatggagtgtgcaaggcctgccacagcagctgcctggcctgcatgggccctgcccccagccactgcaccggctgcaagaagccagaggagggcctgcaggtggagcagctgagtgatgtgggcatccccagcggggagtgcctggcccagtgccgggcccacttctacctggagagcacaggcatctgtgaggcctgccaccagagctgcttccgctgtgccggcaagagcccccacaactgcacagactgtggccccagccacgtgctgctggatggccagtgcctgagccagtgcccagatggctacttccaccaggagggcagctgcacagagtgccaccccacctgccggcagtgccacggccccctggagagtgactgcatcagctgctacccccacatcagcctgaccaatggaaactgcaggaccagctgccgggaggagcagttcctgaacctggtgggctactgtgccgactgccaccacctgtgccagcactgtgccgctgacctgcacaacacaggcagcatctgcctgcgctgccagaatgcccactacctgctgctgggggaccactgtgtgcctgactgccccagcggctactatgcagagcggggggcctgcaagaagtgccacagcagctgcaggacctgccagggccggggccccttcagctgcagcagctgtgacaccaacctggtgctgagccacacaggcacctgcagcaccacctgcttccctggccactacctggatgacaaccacgtgtgccagccctgcaacacccactgcggcagctgtgacagccaggccagctgcaccagctgccgggaccccaacaaggtgctgctgtttggagagtgccagtatgagagctgtgccccccagtactacctggacttcagcaccaacacctgcaaggaatgtgactggagctgcagcgcctgcagcggccccctgaagacagactgcctgcagtgcatggatggctacgtgctgcaggatggagcctgtgtggagcagtgcctgagcagcttctaccaggacagcggcctgtgcaagaactgtgacagctactgcctgcagtgccagggcccccatgaatgtacccgctgcaagggccccttcctgctgctggaggcccagtgtgtgcaggagtgtgggaagggctactttgctgaccacgccaagcacaagtgcacagcctgcccccagggctgcctgcagtgcagccaccgggaccgctgccacctgtgtgaccacggcttcttcctgaagagcggcctgtgtgtgtacaactgtgtgcccggcttctctgtgcacaccagcaatgagacctgcagcggcaagatccacacccccagcctgcacgtgaatggcagcctcatcctgcccatcggcagcatcaagcccctggacttcagcctgctgaatgtgcaggaccaggagggccgggtggaggacctgctcttccacgtggtgtccacccccaccaacggccagctggtgctgagcagaaatggcaaggaggtgcagctggacaaggccggccgcttctcctggaaggatgtgaatgagaagaaggtgcgctttgtgcacagcaaggagaagctgaggaagggctacctgttcctgaagatcagtgaccagcagttcttcagcgagccccagctgatcaacatccaggccttcagcacccaggccccctacgtgctgagaaatgaggtgctgcacatcagcagaggagagcgggccaccatcaccacccagatgctggacatcagagatgatgacaacccccaggatgtggtgattgagatcattgatcctcccctgcacggccagctgctgcagaccctgcagagccctgccacccccatctaccagttccagctggatgagctgagccggggcctgctgcactacgcccatgatggcagtgacagcaccagtgatgtggccgtgctgcaggccaatgatggccacagcttccacaacatcctcttccaggtgaagacagtgccccagaatgaccggggcctgcagctggtggccaacagcatggtgtgggtgcctgagggcggcatgctgcagatcaccaaccgcatcctgcaggccgaggcccctggggccagcgctgaggagatcatctacaagatcacccaggactacccccagtttggagaggtggtgctgctggtgaacatgcctgctgacagccctgcagatgagggccagcacctgcctgatggccgcacagccacccccaccagcaccttcacccagcaggacatcaatgaaggcatcgtgtggtaccgccacagcggggccccagcccagagcgacagcttccgctttgaggtgtcctctgccagcaatgcccagacccggctggagagccacatgttcaacatcgccatcctgccccagaccccagaggcccccaaggtgtccctggaggccagcctgcacatgacagcccgggaggatggcctgaccgtcatccagccccacagcctgtccttcatcaacagcgagaagcccagcggcaagatcgtgtacaacatcaccctgcccctgcaccccaaccagggcatcatcgagcaccgggaccacccccacagccccatccgctacttcacccaggaggacatcaaccagggcaaggtgatgtacagacctcctcctgctgccccccacctgcaggagctgatggccttctcctttgctggcctgcctgagagcgtgaagttccacttcaccgtgtctgatggagagcacaccagccctgagatggtgctgaccatccacctgctgcccagcgaccagcagctgcctgtgttccaggtgacagccccccggctggccgtgtcccctgggggcagcacctctgtgggcctgcaggtggtggtgagagatgctgagacagcccccaaggagctgttctttgagctgcggcggcccccccagcacggcgtgctgctgaagcacacagctgagttcagaagacccatggccaccggggacaccttcacctatgaagatgtggagaagaatgccctgcagtacatccatgatggcagcagcaccagagaagattccatggagatctctgtgacagatggcctgactgtgaccatgctggaggtgcgggtggaggtgtccctgtctgaagatcggggcccccggctggccgccggcagcagcctgagcatcaccgtggccagcaagagcacagccatcatcaccaggagccacctggcctacgtggatgacagcagcccagaccctgagatctggatccagctgaactacctgcccagctatggcaccctgctgcgcatcagcggcagcgaggtggaggagctgtctgaggtgagcaacttcaccatggaggacatcaacaacaagaagatccgctacagcgctgtgtttgaaacagatggccacctggtgacagacagcttctacttctctgtgtctgacatggaccacaaccacctggacaaccagatcttcaccatcatgatcaccccagctgagaaccccccacctgtgattgcctttgctgacctgatcaccgtggatgaaggaggccgggcccccctgtccttccaccacttctttgccacagatgatgatgacaacctgcagagagatgccatcatcaagctgagcgccctgcccaagtatggctgcatcgagaacacaggcaccggggaccgcttcggccctgagacagccagtgacctggaggccagcttccccatccaggatgtgctggagaactacatctactacttccagagcgtgcatgagagcattgagcccacccatgacatcttctccttctacgtgtctgatggcaccagccgctctgagatccacagcatcaacatcaccatcgaggtgaagaccctggaggtgggcaaggtggagcccctgaccaccatcttccacaccatccgggagctgagcctgtag

SEQ ID NO: 152887 - DNA, 633 bp, Artificial Sequence
  Description of Artificial Sequence: Synthetic coding sequence
atgtggaccctgggccggcgggctgtggccggcctgctggccagccccagccctgcccaggcccagaccctgaccagggtgcccaggcctgctgagctggcccccctgtgtggcagaagaggcctgaggacagacattgatgccacctgcaccccaagaagagccagcagcaaccagaggggcctgaaccagatctggaatgtgaagaagcagagcgtgtacctgatgaacctgaggaagagcggcaccctgggccaccctggcagcctggatgagaccacctatgagcggctggccgaggagaccctggacagcctggccgagttctttgaggacctggccgacaagccctacacctttgaagattatgatgtgtcctttggaagtggagtgctgactgtgaagctgggcggggacctgggcacctacgtgatcaacaagcagacccccaacaagcagatctggctgagcagccccagcagcggccccaagagatatgactggacaggcaagaactgggtgtacagccatgatggagtgtccctgcacgagctgctggccgctgagctgaccaaggccctgaagaccaagctggacctgagcagcctggcctacagcggcaaggatgcctag

SEQ ID NO: 152888 - DNA, 516 bp, Artificial Sequence
  Description of Artificial Sequence: Synthetic coding sequence
atgtggaccctgggccggcgggctgtggccggcctgctggccagccccagccctgcccaggcccagaccctgaccagggtgcccaggcctgctgagctggcccccctgtgtggcagaagaggcctgaggacagacattgatgccacctgcaccccaagaagagccagcagcaaccagaggggcctgaaccagatctggaatgtgaagaagcagagcgtgtacctgatgaacctgaggaagagcggcaccctgggccaccctggcagcctggatgagaccacctatgagcggctggccgaggagaccctggacagcctggccgagttctttgaggacctggccgacaagccctacacctttgaagattatgatgtgtcctttggaagtggagtgctgactgtgaagctgggcggggacctgggcacctacgtgatcaacaagcagacccccaacaagcagatctggctgagcagccccagccggctgacctggctgctgtggctgttccacccctag

SEQ ID NO: 152889 - DNA, 591 bp, Artificial Sequence
  Description of Artificial Sequence: Synthetic coding sequence
atgtggaccctgggccggcgggctgtggccggcctgctggccagccccagccctgcccaggcccagaccctgaccagggtgcccaggcctgctgagctggcccccctgtgtggcagaagaggcctgaggacagacattgatgccacctgcaccccaagaagagccagcagcaaccagaggggcctgaaccagatctggaatgtgaagaagcagagcgtgtacctgatgaacctgaggaagagcggcaccctgggccaccctggcagcctggatgagaccacctatgagcggctggccgaggagaccctggacagcctggccgagttctttgaggacctggccgacaagccctacacctttgaagattatgatgtgtcctttggaagtggagtgctgactgtgaagctgggcggggacctgggcacctacgtgatcaacaagcagacccccaacaagcagatctggctgagcagccccagccgctacgtggtggacctgtctgtgatgacaggcctgggcaagacaggctgcacccccaccacagcctgccccagcatgagctgctggccccagagcagcctgaagccctag

SEQ ID NO: 152890 - DNA, 702 bp, Artificial Sequence
  Description of Artificial Sequence: Synthetic coding sequence
atgccctgccggcgggaggaggaggaggaggccggggaggaggccgagggggaggaggaggaggatgacagcttcctgctgctgcagcagagcgtgaccctgggcagcagtggagaggtggaccggctggtggcccagattggagagaccctgcagctggatgctgcccaggacagccctgccagcccctgtgcccctcctggggtgcccctgcgggcccctggccccctggccgctgctgtgcctgctgacaaggcccggcccccagctgtgcccctgctgctgcccccagccagcgctgagaccgtgggccctgcccccagcggggccctgcgctgtgccctgggggaccggggccgggtgcggggccgggccgccccctactgtgtggccgaggtggccgccggccccagcgccctgcccggcccctgcagaagaggctggctgagagatgctgtgaccagccggcggctgcagcagaggcgctggacccaggccggggcccgggctggagatgatgacccccaccggctgctgcagcagctggtgctgagcggcaacctgatcaaggaggccgtgcggcggctgcagagagctgtggccgctgtggccgccaccggccctgccagcgcccctggccctgggggcggccgcagcggccctgaccgcatcgccctgcagcccagcggcagcctgctgtag

SEQ ID NO: 152891 - DNA, 1161 bp, Artificial Sequence
  Description of Artificial Sequence: Synthetic coding sequence
atggagggcggcctggccggggagcgggcccgggagagccctgtggactgcagcgtgtccaagtgcagcaagctggtgggcggcggggagagcaaccccatgaactacaacagctacatggatgagaagaatggccccccaccacccaacatgaccaccaatgaaagaagagtgattgtgcctgctgaccccaccctgtggacccaggagcacgtgcggcagtggctggagtgggccatcaaggagtacagcctgatggagattgacaccagcttcttccagaacatggatggcaaggagctgtgcaagatgaacaaggaggacttcctgcgggccaccaccctgtacaacacagaggtgctgctgagccacctgagctacctgcgggagagcagcctgctggcctacaacaccaccagccacacagaccagagcagccggctgtctgtgaaggaggaccccagctatgacagcgtgcggcggggggcctggggcaacaacatgaacagcggcctgaacaagagcccccccctgggcggggcccagaccatcagcaagaacacagagcagaggccccagcctgacccctaccagatcctgggccccaccagcagccggctggccaaccctggcagcggccagatccagctgtggcagttcctgctggagctgctgagtgacagcgccaatgccagctgcatcacctgggagggcaccaacggggagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccatggaattgcccaggccctgcagccccaccccacagagagctccatgtacaagtaccccagcgacatctcctacatgcccagctaccacgcccaccagcagaaggtgaactttgtgcccccccaccccagctccatgcctgtgaccagcagcagcttcttcggggccgccagccagtactggaccagccccactggaggcatctaccccaaccccaacgtgcccaggcaccccaacacccacgtgcccagccacctgggcagctactactag

SEQ ID NO: 152892 - DNA, 1260 bp, Artificial Sequence
  Description of Artificial Sequence: Synthetic coding sequence
atgacagccagcggcagcccagactatggccagccccacaagatcaaccccctgcccccccagcaggagtggatcaaccagcctgtgcgggtgaatgtgaagcgggagtatgaccacatgaatggcagccgggagagccctgtggactgcagcgtgtccaagtgcagcaagctggtgggcggcggggagagcaaccccatgaactacaacagctacatggatgagaagaatggacctcctccacccaacatgaccaccaatgaaagaagagtcatcgtgcctgctgaccccaccctgtggacccaggagcacgtgcggcagtggctggagtgggccatcaaggagtacagcctgatggagattgacaccagcttcttccagaacatggatggcaaggagctgtgcaagatgaacaaggaggacttcctgcgggccaccaccctgtacaacacagaggtgctgctgagccacctgagctacctgcgggagagcagcctgctggcctacaacaccaccagccacacagaccagagcagccggctgtctgtgaaggaggaccccagctatgattctgtgagaagaggagcctggggcaacaacatgaacagcggcctgaacaagagcccccccctgggcggggcccagaccatcagcaagaacacagagcagaggccccagcctgacccctaccagatcctgggccccaccagcagccggctggccaaccctggcagcggccagatccagctgtggcagttcctgctggagctgctgagtgacagcgccaatgccagctgcatcacctgggagggcaccaatggagagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccacggcatcgcccaggccctgcagccccaccccacagagagctccatgtacaagtaccccagcgacatctcctacatgcccagctaccacgcccaccagcagaaggtgaactttgtgcccccccaccccagctccatgcctgtgaccagcagcagcttctttggagctgccagccagtactggaccagccccaccggcggcatctaccccaaccccaacgtgcccaggcaccccaacacccacgtgcccagccacctgggcagctactactag

SEQ ID NO: 152893 - DNA, 1359 bp, Artificial Sequence
  Description of Artificial Sequence: Synthetic coding sequence
atggatggcaccatcaaggaggccctgtctgtggtgtctgatgaccagagcctgtttgattctgcctatggagctgctgcccacctgcccaaggctgacatgacagccagcggcagcccagactatggccagccccacaagatcaaccccctgcccccccagcaggagtggatcaaccagcctgtgcgggtgaatgtgaagcgggagtatgaccacatgaatggcagccgggagagccctgtggactgcagcgtgtccaagtgcagcaagctggtgggcggcggggagagcaaccccatgaactacaacagctacatggatgagaagaatggccccccaccacccaacatgaccaccaatgaaagaagagtgattgtgcctgctgaccccaccctgtggacccaggagcacgtgcggcagtggctggagtgggccatcaaggagtacagcctgatggagattgacaccagcttcttccagaacatggatggcaaggagctgtgcaagatgaacaaggaggacttcctgcgggccaccaccctgtacaacacagaggtgctgctgagccacctgagctacctgcgggagagcagcctgctggcctacaacaccaccagccacacagaccagagcagccggctgtctgtgaaggaggaccccagctatgacagcgtgcggcggggggcctggggcaacaacatgaacagcggcctgaacaagagcccccccctgggcggggcccagaccatcagcaagaacacagagcagaggccccagcctgacccctaccagatcctgggccccaccagcagccggctggccaaccctggcagcggccagatccagctgtggcagttcctgctggagctgctgagtgacagcgccaatgccagctgcatcacctgggagggcaccaacggggagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccatggaattgcccaggccctgcagccccaccccacagagagctccatgtacaagtaccccagcgacatctcctacatgcccagctaccacgcccaccagcagaaggtgaactttgtgcccccccaccccagctccatgcctgtgaccagcagcagcttcttcggggccgccagccagtactggaccagccccactggaggcatctaccccaaccccaacgtgcccaggcaccccaacacccacgtgcccagccacctgggcagctactactag

SEQ ID NO: 152894 - DNA, 780 bp, Artificial Sequence
  Description of Artificial Sequence: Synthetic coding sequence
atggaccccggcagcctgctggcctacaacaccaccagccacacagaccagagcagccggctgtctgtgaaggaggaccccagctatgattctgtgagaagaggagcctggggcaacaacatgaacagcggcctgaacaagagcccccccctgggcggggcccagaccatcagcaagaacacagagcagaggccccagcctgacccctaccagatcctgggccccaccagcagccggctggccaaccctggcagcggccagatccagctgtggcagttcctgctggagctgctgagtgacagcgccaatgccagctgcatcacctgggagggcaccaatggagagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccacggcatcgcccaggccctgcagccccaccccacagagagctccatgtacaagtaccccagcgacatctcctacatgcccagctaccacgcccaccagcagaaggtgaactttgtgcccccccaccccagctccatgcctgtgaccagcagcagcttctttggagctgccagccagtactggaccagccccaccggcggcatctaccccaaccccaacgtgcccaggcaccccaacacccacgtgcccagccacctgggcagctactactag

SEQ ID NO: 152895 - DNA, 1944 bp, Artificial Sequence
  Description of Artificial Sequence: Synthetic coding sequence
atggccgaggaggaggcccccaagaagagcagagctgctgggggcggggcctcctgggagctgtgtgccggggccctgagcgcccggctggccgaggagggcagcggagatgctgggggcagaagaagacctcctgtggacccccggcggctggcccggcagctgctgctgctgctgtggctgctggaggcccccctgctgctgggcgtgcgggcccaggccgccggccagggccctggccagggccctggccctggccagcagcccccacctccaccccagcagcagcagagcggccagcagtacaatggagagcggggcatctctgtgcctgaccacggctactgccagcccatcagcatccccctgtgcacagacatcgcctacaaccagaccatcatgcccaacctgctgggccacaccaaccaggaggatgctggcctggaggtgcaccagttctaccccctggtgaaggtgcagtgcagcgctgagctgaagttcttcctgtgcagcatgtatgcccctgtgtgcaccgtgctggagcaggccctgcccccctgccgcagcctgtgtgagcgggcccggcagggctgtgaggccctgatgaacaagtttggcttccagtggccagacaccctgaagtgtgagaagtttcctgtgcatggagctggggagctgtgtgtgggccagaacaccagtgacaagggcacccccacccccagcctgctgcctgagttctggaccagcaacccccagcacggcggcggcggccaccggggcggcttccctggaggagctggggccagcgagcggggcaagttcagctgcccccgggccctgaaggtgcccagctacctgaactaccacttcctgggggagaaggactgtggggccccctgtgagcccaccaaggtgtatggcctgatgtactttggacctgaggagctgcgcttcagcaggacctggattggcatctggagcgtgctgtgctgtgccagcaccctcttcaccgtgctgacctacctggtggacatgaggcgcttctcctacccagagcggcccatcatcttcctgagcggctgctacacagctgtggccgtggcctacatcgccggcttcctgctggaggacagagtggtgtgcaatgacaagtttgctgaagatggagccaggacagtggcccagggcaccaagaaggagggctgcaccatcctcttcatgatgctgtacttcttctccatggccagcagcatctggtgggtgatcctgagcctgacctggttcctggccgccggcatgaagtggggccacgaggccatcgaggccaacagccagtacttccacctggccgcctgggccgtgcctgccatcaagaccatcaccatcctggccctgggccaggtggatggagatgtgctgagcggcgtgtgctttgtgggcctgaacaacgtggatgccctgcggggctttgtgctggcccccctgtttgtgtacctgttcatcggcaccagcttcctgctggccggctttgtgtccctcttccgcatccgcaccatcatgaagcatgatggcaccaagacagagaagctggagaagctgatggtgagaattggagtcttctctgtgctgtacacagtgcctgccaccatcgtcatcgcctgctacttctatgagcaggccttccgggaccagtgggagaggtcctgggtggcccagagctgcaagagctatgccatcccctgcccccacctgcaggccggcggcggggccccaccccacccccccatgagcccagacttcaccgtcttcatgatcaagtacctgatgaccctcatcgtgggcatcaccagcggcttctggatctggagcggcaagaccctgaacagctggaggaagttctacacccggctgaccaacagcaagcagggcgagaccaccgtgtag

SEQ ID NO: 152896 - DNA, 1284 bp, Artificial Sequence
  Description of Artificial Sequence: Synthetic coding sequence
atggaggccatggccgccagcaccagcctgcctgaccccggggactttgacagaaatgtgccccgcatctgtggggtgtgtggggaccgggccaccggcttccacttcaatgccatgacctgtgagggctgcaagggcttcttcagaagatccatgaagaggaaggccctcttcacctgccccttcaatggagactgccgcatcaccaaggacaacagaagacactgccaggcctgccgcctgaagagatgtgtggacatcggcatgatgaaggagttcatcctgacagatgaggaggtgcagaggaagcgggagatgatcctgaagaggaaggaggaggaggccctgaaggacagcctgcggcccaagctgtctgaggagcagcagaggatcatcgccatcctgctggatgcccaccacaagacctatgaccccacctacagcgacttctgccagttccggccccctgtgcgggtgaatgatggcggcggcagccaccccagccggcccaacagccgccacacccccagcttcagcggggacagcagcagcagctgcagcgaccactgcatcaccagcagtgacatgatggacagcagcagcttcagcaacctggacctgtctgaggaggacagtgatgaccccagcgtgaccctggagctgagccagctgtccatgctgccccacctggccgacctggtgtcctacagcatccagaaggtgattggatttgccaagatgatccctggcttccgggacctgaccagcgaggaccagatcgtgctgctgaagagcagcgccatcgaggtgatcatgctgcggagcaatgaaagcttcaccatggatgacatgtcctggacctgtggcaaccaggactacaagtacagagtgtctgatgtgaccaaggccggccacagcctggagctgattgagcccctcatcaagttccaggtgggcctgaagaagctgaacctgcacgaggaggagcacgtgctgctgatggccatctgcatcgtgtccccagacaggcctggggtgcaggatgctgccctgattgaggccatccaggaccggctgagcaacaccctgcagacctacatccgctgccgccaccccccacctggcagccacctgctgtatgccaagatgatccagaagctggccgacctgcggagcctgaatgaggagcacagcaagcagtaccgctgcctgtccttccagccagaatgttccatgaagctgacccccctggtgctggaggtgtttggaaatgagatctcctag

SEQ ID NO: 152897 - DNA, 1365 bp, Artificial Sequence
  Description of Artificial Sequence: Synthetic coding sequence
atgcctgcccaccgggaccctgatgtgcagggccaccggctgcagcacgacagctatgcccagccagatggcccccgggagcccgcccggggcagccaccctgtggcccgggtgcgggctgctggaggagtgcggctgccccggcccccacccctgctgcctgtgctggccgtgcgggcagatgtgcacagagctggcctgtacccccacccccggctgcccggccacgtgcgggccggccctgcccaggtgctgcctgactatggagctgtgcagctgcaggtggcccggctgcccggcctgcctgagaccccccagcaggagcggccccagctgcctgtgcatggaggagcccagcagaggctgggccgggcccaccctggcctgggccctgtgcctgctgctgtgcctgctgctgctgccccccagagagctggggccccagctgagggccggggcccccgggcccggcggctgcggcagcccggccaggtgcccccaagaggagaggagcgggtggtgcgggccgccctgcacgcccggcggggccgggtgctggagccccggggccaggccctgcggagcggcctggccggccacctgggcggcgctgtgctgctgctgcagaggctgcaccgggcccacctgccccaccggcccggccccctgcccctgccccgggccccccaccacctgcccctgcacgtgctgctgcggctgctgcggggcctgccccacccccccctgcggcggcggcgggagcaccggctgcggcccggccagaggcctgccctgtgccaccctgggggcactggagagcaccggctgcacgccggcctgcccggccccctgctgctgcggcacggccagctggccgtggtgggcggcccccacgcccacctggtgcctggaagacggcaggaggtgggcccccggggccacaggagccagcagcagctgctgcccccaggcagcctgggccaccctggaggagaggaccacccagaccccggccacgcccagggcggcggcggccgggcccaccggggcctgctgcggggccagcacggccggcagagggcccaccggctgcgggcccacagccctggcctgctgcccggccacagacatgtgctgcaccccctgggcctgcggggccctgtgccccacccagaaggagatgaagatggccggcgggagcacggccaggccggggaggcccacggggcctaccgggccctgctgtgtgctgtgcacagagctggccacctgtgtgaccggctgctgctgctgcggaccccccagcacggcctgctggaggaccccggcggggccgcccaggtgcagaatgagcagcctgactag

SEQ ID NO: 152898 - DNA, 1698 bp, Artificial Sequence
  Description of Artificial Sequence: Synthetic coding sequence
atgaggcccaggtctgccctgccccggctgctgctgcccctgctgctgctgcctgctgctggccctgcccagttccacggggagaagggcatcagcatcccagaccacggcttctgccagcccatcagcatccccctgtgcacagacatcgcctacaaccagaccatcatgcccaacctgctgggccacaccaaccaggaggatgctggcctggaggtgcaccagttctaccccctggtgaaggtgcagtgcagccctgagctgcgcttcttcctgtgcagcatgtatgcccctgtgtgcaccgtgctggagcaggccatccccccctgccgcagcatctgtgagcgggcccggcagggctgtgaggccctgatgaacaagtttggcttccagtggccagagcggctgcgctgtgagcacttccccaggcatggagctgagcagatctgtgtgggccagaaccacagtgaagatggagccccagccctgctgaccacagcccctcctcctggcctgcagcccggggccggcggcacccctgggggccctgggggcggcggggccccacccaggtatgccaccctggagcaccccttccactgcccccgggtgctgaaggtgcccagctacctgagctacaagttcctgggggagcgggactgtgccgccccctgtgagcccgcccggccagatggctccatgttcttcagccaggaggagaccaggtttgcccggctgtggatcctgacctggagcgtgctgtgctgtgccagcaccttcttcaccgtgaccacctacctggtggacatgcagcgcttccgctacccagagcggcccatcatcttcctgagcggctgctacaccatggtgtctgtggcctacatcgccggctttgtgctgcaggagcgggtggtgtgcaatgaacgcttctctgaagatggctacagaacagtggtgcagggcaccaagaaggagggctgcaccatcctcttcatgatgctgtacttcttctccatggccagcagcatctggtgggtgatcctgagcctgacctggttcctggccgccggcatgaagtggggccacgaggccatcgaggccaacagccagtacttccacctggccgcctgggccgtgcctgctgtgaagaccatcaccatcctggccatgggccagattgatggagacctgctgtctggagtgtgctttgtgggcctgaacagcctggaccccctgcggggctttgtgctggcccccctgtttgtgtacctgttcatcggcaccagcttcctgctggccggctttgtgtccctcttccgcatccgcaccatcatgaagcatgatggcaccaagacagagaagctggagcggctgatggtgcgcatcggggtcttctctgtgctgtacacagtgcctgccaccatcgtgattgcctgctacttctatgagcaggccttccgggagcactgggagaggtcctgggtgtcccagcactgcaagagcctggccatcccctgcccagcccactacacccccaggatgagcccagacttcaccgtgtacatgatcaagtacctgatgaccctcatcgtgggcatcaccagcggcttctggatctggagcggcaagaccctgcacagctggaggaagttctacacccggctgaccaacagccgccacggggagaccaccgtgtag

SEQ ID NO: 152899 - DNA, 1926 bp, Artificial Sequence
  Description of Artificial Sequence: Synthetic coding sequence
gcccggggcgtgtctggctgcagcgtgcggccccggcaggccagcggccaggcccaccggcccctgcccaggcctgccagccccaccctgcggccccgggtgaagtttgccaagagaagaggccggcggcagccccagaggggcggcggcggggaggaggcccagagccctggctggggccggggccggggcggccggcagggcgccggctggggcgccgccgcctccatgaggcccaggtctgccctgccccggctgctgctgcccctgctgctgctgcctgctgctggccctgcccagttccacggggagaagggcatcagcatcccagaccacggcttctgccagcccatcagcatccccctgtgcacagacatcgcctacaaccagaccatcatgcccaacctgctgggccacaccaaccaggaggatgctggcctggaggtgcaccagttctaccccctggtgaaggtgcagtgcagccctgagctgcgcttcttcctgtgcagcatgtatgcccctgtgtgcaccgtgctggagcaggccatccccccctgccgcagcatctgtgagcgggcccggcagggctgtgaggccctgatgaacaagtttggcttccagtggccagagcggctgcgctgtgagcacttccccaggcatggagctgagcagatctgtgtgggccagaaccacagtgaagatggagccccagccctgctgaccacagcccctcctcctggcctgcagcccggggccggcggcacccctgggggccctgggggcggcggggccccacccaggtatgccaccctggagcaccccttccactgcccccgggtgctgaaggtgcccagctacctgagctacaagttcctgggggagcgggactgtgccgccccctgtgagcccgcccggccagatggctccatgttcttcagccaggaggagaccaggtttgcccggctgtggatcctgacctggagcgtgctgtgctgtgccagcaccttcttcaccgtgaccacctacctggtggacatgcagcgcttccgctacccagagcggcccatcatcttcctgagcggctgctacaccatggtgtctgtggcctacatcgccggctttgtgctgcaggagcgggtggtgtgcaatgaacgcttctctgaagatggctacagaacagtggtgcagggcaccaagaaggagggctgcaccatcctcttcatgatgctgtacttcttctccatggccagcagcatctggtgggtgatcctgagcctgacctggttcctggccgccggcatgaagtggggccacgaggccatcgaggccaacagccagtacttccacctggccgcctgggccgtgcctgctgtgaagaccatcaccatcctggccatgggccagattgatggagacctgctgtctggagtgtgctttgtgggcctgaacagcctggaccccctgcggggctttgtgctggcccccctgtttgtgtacctgttcatcggcaccagcttcctgctggccggctttgtgtccctcttccgcatccgcaccatcatgaagcatgatggcaccaagacagagaagctggagcggctgatggtgcgcatcggggtcttctctgtgctgtacacagtgcctgccaccatcgtgattgcctgctacttctatgagcaggccttccgggagcactgggagaggtcctgggtgtcccagcactgcaagagcctggccatcccctgcccagcccactacacccccaggatgagcccagacttcaccgtgtacatgatcaagtacctgatgaccctcatcgtgggcatcaccagcggcttctggatctggagcggcaagaccctgcacagctggaggaagttctacacccggctgaccaacagccgccacggggagaccaccgtgtag

SEQ ID NO: 152900 - DNA, 2001 bp, Artificial Sequence
  Description of Artificial Sequence: Synthetic coding sequence
atggccatgacctggatcgtgttcagcctgtggcccctgaccgtcttcatgggccacatcggcggccacagcctcttcagctgtgagcccatcaccctgaggatgtgccaggacctgccctacaacaccaccttcatgcccaacctgctgaaccactatgaccagcagacagctgccctggccatggagcccttccaccccatggtgaacctggactgcagccgggacttccggcccttcctgtgtgccctgtatgcccccatctgcatggagtatggccgggtgaccctgccctgccggcggctgtgccagagggcctacagtgaatgttccaagctgatggagatgtttggagtgccctggccagaggacatggagtgcagccgcttcccagactgtgatgagccctacccccggctggtggacctgaacctggccggggagcccacagagggcgcccctgtggccgtgcagagggactatggcttctggtgcccccgggagctgaagattgatcctgacctgggctacagcttcctgcacgtgcgggactgcagccccccctgccccaacatgtacttcagaagagaggagctgagctttgcccgctacttcatcggcctcatcagcatcatctgcctgagcgccaccctcttcaccttcctgaccttcctgattgatgtgacccgcttccgctacccagagcggcccatcatcttctatgctgtgtgctacatgatggtgtccctcatcttcttcatcggcttcctgctggaggacagagtggcctgcaatgccagcatcccagcccagtacaaggccagcacagtgacccagggcagccacaacaaggcctgcaccatgctgttcatgatcctgtacttcttcaccatggccggctctgtgtggtgggtgatcctgaccatcacctggttcctggccgctgtgcccaagtggggcagcgaggccatcgagaagaaggccctgctcttccacgccagcgcctggggcatccctggcaccctgaccatcatcctgctggccatgaacaagattgaaggagacaacatcagcggcgtgtgctttgtgggcctgtatgatgtggatgccctgcgctactttgtgctggcccccctgtgcctgtatgtggtggtgggcgtgtccctgctgctggccggcatcatcagcctgaacagagtgcgcatcgagatccccctggagaaggagaaccaggacaagctggtgaagttcatgatcagaattggagtcttcagcatcctgtacctggtgcccctgctggtggtgattggctgctacttctatgagcaggcctaccggggcatctgggagaccacctggatccaggagcgctgccgggagtaccacatcccctgcccctaccaggtgacccagatgagcaggccagacctgatcctcttcctgatgaagtacctgatggccctgattgtgggcatccccagcgtcttctgggtgggcagcaagaagacctgctttgagtgggccagcttcttccacggccgcaggaagaaggagatcgtgaatgaaagccggcaggtgctgcaggagccagactttgcccagagcctgctgcgggaccccaacacccccatcatcaggaagagccggggcaccagcacccagggcaccagcacccacgccagcagcacccagctggccatggtggatgaccagaggagcaaggccggcagcatccacagcaaggtgagcagctaccacggcagcctgcacaggagcagagatggccgctacaccccctgcagctaccggggcatggaggagcggctgccccacggctccatgagccggctgacagaccacagccgccacagcagcagccaccggctgaatgagcagagccgccacagcagcatccgggacctgagcaacaaccccatgacccacatcacccacggcacctccatgaacagagtgattgaagaagatggcaccagcgcctag

SEQ ID NO: 152901 - DNA, 108 bp, Artificial Sequence
  Description of Artificial Sequence: Synthetic coding sequence
atggccatgacctggatcgtgttcagcctgtggcccctgaccgtcttcatgggccacatcggcggccacagcctcttcagctgtgagcccatcaccctgaggatgtag

SEQ ID NO: 152902 - DNA, 2001 bp, Artificial Sequence; identical to SEQ ID NO: 152900
  Description of Artificial Sequence: Synthetic coding sequence

SEQ ID NO: 152903 - DNA, 1614 bp, Artificial Sequence
  Description of Artificial Sequence: Synthetic coding sequence
atggcctggaggggggccggccccagcgtgcctggggcccctgggggcgtgggcctgagcctgggcctgctgctgcagctgctgctgctgctgggccctgcccggggctttggagatgaggaggagcggcgctgtgaccccatccgcatctccatgtgccagaacctgggctacaacgtgaccaagatgcccaacctggtgggccacgagctgcagacagatgctgagctgcagctgaccaccttcacccccctcatccagtatggctgcagcagccagctgcagttcttcctgtgcagcgtgtatgtgcccatgtgcacagagaagatcaacatccccatcggcccctgtggcggcatgtgcctgtctgtgaagaggcgctgtgagcctgtgctgaaggagtttggatttgcctggccagagagcctgaactgcagcaagtttcctccccagaatgaccacaaccacatgtgcatggagggccctggagatgaggaggtgcccctgccccacaagacccccatccagcctggagaggagtgccacagcgtgggcaccaacagcgaccagtacatctgggtgaagaggagcctgaactgtgtgctgaagtgtggctatgatgctggcctgtacagccgcagcgccaaggagttcacagacatctggatggctgtgtgggccagcctgtgcttcatcagcacagccttcaccgtgctgaccttcctgattgacagcagccgcttctcctacccagagcggcccatcatcttcctgtccatgtgctacaacatctacagcatcgcctacatcgtgcggctgactgtgggccgggagcgcatcagctgtgactttgaggaggccgctgagcctgtgctgatccaggagggcctgaagaacacaggctgtgccatcatcttcctgctgatgtacttcttcggcatggccagcagcatctggtgggtgatcctgaccctgacctggttcctggccgccggcctgaagtggggccacgaggccatcgagatgcacagcagctacttccacatcgccgcctgggccatcccagctgtgaagaccatcgtcatcctgatcatgaggctggtggatgctgatgagctgaccggcctgtgctacgtgggcaaccagaacctggatgccctgaccggctttgtggtggcccccctcttcacctacctggtgattggcaccctcttcatcgccgccggcctggtggccctcttcaagatccgcagcaacctgcagaaggatggcaccaagacagacaagctggagcggctgatggtgaagattggagtcttctctgtgctgtacacagtgcctgccacctgtgtgattgcctgctacttctatgagatcagcaactgggccctcttccgctacagcgcagatgacagcaacatggctgtggagatgctgaagatcttcatgagcctgctggtgggcatcaccagcggcatgtggatctggagcgccaagaccctgcacacctggcagaagtgcagcaaccggctggtgaacagcggcaaggtgaagcgggagaagagaggaaatggctgggtgaagccaggaaaaggaagtgaaacagtggtgtag

SEQ ID NO: 152904 - DNA, 2121 bp, Artificial Sequence
  Description of Artificial Sequence: Synthetic coding sequence
atggagatgttcaccttcctgctgacctgcatcttcctgcccctgctgcggggccacagcctcttcacctgtgagcccatcaccgtgccccgctgcatgaagatggcctacaacatgaccttcttccccaacctgatgggccactatgaccagagcattgctgctgtggagatggagcacttcctgcccctggccaacctggagtgcagccccaacatcgagaccttcctgtgcaaggcctttgtgcccacctgcatcgagcagatccacgtggtgcccccctgcaggaagctgtgtgagaaggtgtacagcgactgcaagaagctgattgacaccttcggcatccgctggccagaggagctggagtgtgaccggctgcagtactgtgatgagaccgtgcctgtgacctttgacccccacacagagttcctgggcccccagaagaagacagagcaggtgcagagggacatcggcttctggtgccccaggcacctgaagaccagcggcggccagggctacaagttcctgggcatcgaccagtgtgccccaccctgccccaacatgtacttcaagagtgatgagctggagtttgccaagagcttcatcggcaccgtgtccatcttctgcctgtgtgccaccctcttcaccttcctgaccttcctgattgatgtgcggcgcttccgctacccagagcggcccatcatctactacagcgtgtgctacagcatcgtgtccctgatgtacttcatcggcttcctgctgggggacagcacagcctgcaacaaggcagatgagaagctggagctgggggacacagtggtgctgggcagccagaacaaggcctgcaccgtgctcttcatgctgctgtacttcttcaccatggccggcaccgtgtggtgggtgatcctgaccatcacctggttcctggccgccggcaggaagtggagctgtgaggccatcgagcagaaggctgtgtggttccacgctgtggcctggggcaccccaggcttcctgactgtgatgctgctggccatgaacaaggtggagggggacaacatcagcggcgtgtgctttgtgggcctgtatgacctggatgccagccgctactttgtgctgctgcccctgtgcctgtgtgtgtttgtgggcctgagcctgctgctggccggcatcatcagcctgaaccacgtgcggcaggtgatccagcatgatggaagaaaccaggagaagctgaagaagttcatgatcagaattggagtcttcagcggcctgtacctggtgcccctggtgaccctgctgggctgctacgtgtatgagcaggtgaaccgcatcacctgggagatcacctgggtgtctgaccactgccggcagtaccacatcccctgcccctaccaggccaaggccaaggcccggcctgagctggccctcttcatgatcaagtacctgatgaccctgattgtgggcatctctgctgtgttctgggtgggcagcaagaagacctgcacagagtgggccggcttcttcaagaggaacaggaagagggaccccatcagcgagagccggcgggtgctgcaggagagctgtgagttcttcctgaagcacaacagcaaggtgaagcacaagaagaagcactacaagcccagcagccacaagctgaaggtgatcagcaagtccatgggcaccagcactggagccacagccaaccacggcaccagcgctgtggccatcaccagccatgactacctgggccaggagaccctgacagagatccagaccagccctgagacctccatgagggaggtgaaggcagatggagccagcaccccccggctgcgggagcaggactgtggggagcccgccagccctgctgccagcatcagccggctgtctggagagcaggtggatggcaagggccaggccggctctgtgtctgagagcgcccggtctgagggccgcatcagccccaagagtgacatcacagacaccggcctggcccagagcaacaacctgcaggtgcccagcagcagcgagcccagcagcctgaagggcagcaccagcctgctggtgcaccctgtgtctggagtgaggaaggagcagggcggcggctgccacagcgacacctag

SEQ ID NO: 152905 - DNA, 2121 bp, Artificial Sequence; identical to SEQ ID NO: 152904
  Description of Artificial Sequence: Synthetic coding sequence

SEQ ID NO: 152906 - DNA, 2025 bp, Artificial Sequence
  Description of Artificial Sequence: Synthetic coding sequence
atgaagatggcctacaacatgaccttcttccccaacctgatgggccactatgaccagagcattgctgctgtggagatggagcacttcctgcccctggccaacctggagtgcagccccaacatcgagaccttcctgtgcaaggcctttgtgcccacctgcatcgagcagatccacgtggtgcccccctgcaggaagctgtgtgagaaggtgtacagcgactgcaagaagctgattgacaccttcggcatccgctggccagaggagctggagtgtgaccggctgcagtactgtgatgagaccgtgcctgtgacctttgacccccacacagagttcctgggcccccagaagaagacagagcaggtgcagagggacatcggcttctggtgccccaggcacctgaagaccagcggcggccagggctacaagttcctgggcatcgaccagtgtgccccaccctgccccaacatgtacttcaagagtgatgagctggagtttgccaagagcttcatcggcaccgtgtccatcttctgcctgtgtgccaccctcttcaccttcctgaccttcctgattgatgtgcggcgcttccgctacccagagcggcccatcatctactacagcgtgtgctacagcatcgtgtccctgatgtacttcatcggcttcctgctgggggacagcacagcctgcaacaaggcagatgagaagctggagctgggggacacagtggtgctgggcagccagaacaaggcctgcaccgtgctcttcatgctgctgtacttcttcaccatggccggcaccgtgtggtgggtgatcctgaccatcacctggttcctggccgccggcaggaagtggagctgtgaggccatcgagcagaaggctgtgtggttccacgctgtggcctggggcaccccaggcttcctgactgtgatgctgctggccatgaacaaggtggagggggacaacatcagcggcgtgtgctttgtgggcctgtatgacctggatgccagccgctactttgtgctgctgcccctgtgcctgtgtgtgtttgtgggcctgagcctgctgctggccggcatcatcagcctgaaccacgtgcggcaggtgatccagcatgatggaagaaaccaggagaagctgaagaagttcatgatcagaattggagtcttcagcggcctgtacctggtgcccctggtgaccctgctgggctgctacgtgtatgagcaggtgaaccgcatcacctgggagatcacctgggtgtctgaccactgccggcagtaccacatcccctgcccctaccaggccaaggccaaggcccggcctgagctggccctcttcatgatcaagtacctgatgaccctgattgtgggcatctctgctgtgttctgggtgggcagcaagaagacctgcacagagtgggccggcttcttcaagaggaacaggaagagggaccccatcagcgagagccggcgggtgctgcaggagagctgtgagttcttcctgaagcacaacagcaaggtgaagcacaagaagaagcactacaagcccagcagccacaagctgaaggtgatcagcaagtccatgggcaccagcactggagccacagccaaccacggcaccagcgctgtggccatcaccagccatgactacctgggccaggagaccctgacagagatccagaccagccctgagacctccatgagggaggtgaaggcagatggagccagcaccccccggctgcgggagcaggactgtggggagcccgccagccctgctgccagcatcagccggctgtctggagagcaggtggatggcaagggccaggccggctctgtgtctgagagcgcccggtctgagggccgcatcagccccaagagtgacatcacagacaccggcctggcccagagcaacaacctgcaggtgcccagcagcagcgagcccagcagcctgaagggcagcaccagcctgctggtgcaccctgtgtctggagtgaggaaggagcagggcggcggctgccacagcgacacctag

SEQ ID NO: 152907 - DNA, 1956 bp, Artificial Sequence
  Description of Artificial Sequence: Synthetic coding sequence
atgctggcccagcacttcctgcccctggccaacctggagtgcagccccaacatcgagaccttcctgtgcaaggcctttgtgcccacctgcatcgagcagatccacgtggtgcccccctgcaggaagctgtgtgagaaggtgtacagcgactgcaagaagctgattgacaccttcggcatccgctggccagaggagctggagtgtgaccggctgcagtactgtgatgaaacagtgcctgtgacctttgacccccacacagagttcctgggcccccagaagaagacagagcaggtgcagagggacatcggcttctggtgccccaggcacctgaagaccagcggcggccagggctacaagttcctgggcatcgaccagtgtgccccaccctgccccaacatgtacttcaagagtgatgagctggagtttgccaagagcttcatcggcaccgtgtccatcttctgcctgtgtgccaccctcttcaccttcctgaccttcctgattgatgtgcggcgcttccgctacccagagcggcccatcatctactacagcgtgtgctacagcatcgtgtccctgatgtacttcatcggcttcctgctgggggacagcacagcctgcaacaaggcagatgagaagctggagctgggggacacagtggtgctgggcagccagaacaaggcctgcaccgtgctcttcatgctgctgtacttcttcaccatggccggcaccgtgtggtgggtgatcctgaccatcacctggttcctggccgccggcaggaagtggagctgtgaggccatcgagcagaaggctgtgtggttccacgctgtggcctggggcaccccaggcttcctgactgtgatgctgctggccatgaacaaggtggagggggacaacatctctggagtgtgctttgtgggcctgtatgacctggatgccagccgctactttgtgctgctgcccctgtgcctgtgtgtgtttgtgggcctgagcctgctgctggccggcatcatcagcctgaaccacgtgcggcaggtgatccagcatgatggcaggaaccaggagaagctgaagaagttcatgatccgcatcggggtcttcagcggcctgtacctggtgcccctggtgaccctgctgggctgctacgtgtatgagcaggtgaaccgcatcacctgggagatcacctgggtgtctgaccactgccggcagtaccacatcccctgcccctaccaggccaaggccaaggcccggcctgagctggccctcttcatgatcaagtacctgatgaccctcatcgtgggcatctctgctgtgttctgggtgggcagcaagaagacctgcacagagtgggccggcttcttcaagaggaacaggaagagggaccccatcagcgagagcagaagagtgctgcaggagagctgtgagttcttcctgaagcacaacagcaaggtgaagcacaagaagaagcactacaagcccagcagccacaagctgaaggtgatcagcaagtccatgggcaccagcactggagccacagccaaccacggcaccagcgctgtggccatcaccagccatgactacctgggccaggagaccctgacagagatccagaccagccctgagacctccatgagggaggtgaaggcagatggagccagcaccccccggctgcgggagcaggactgtggggagcccgccagccctgctgccagcatcagccggctgagcggggagcaggtggatggcaagggccaggccggctctgtgtctgagagcgcccggtctgagggccgcatcagccccaagagtgacatcacagacaccggcctggcccagagcaacaacctgcaggtgcccagcagcagcgagcccagcagcctgaagggcagcaccagcctgctggtgcaccctgtgtctggagtgaggaaggagcagggcggcggctgccacagcgacacctag

SEQ ID NO: 152908 - DNA, 1206 bp, Artificial Sequence
  Description of Artificial Sequence: Synthetic coding sequence
atgaccagggtgctgccccgctggaagtggagctgtgaggccatcgagcagaaggctgtgtggttccacgctgtggcctggggcaccccaggcttcctgactgtgatgctgctggccatgaacaaggtggagggggacaacatctctggagtgtgctttgtgggcctgtatgacctggatgccagccgctactttgtgctgctgcccctgtgcctgtgtgtgtttgtgggcctgagcctgctgctggccggcatcatcagcctgaaccacgtgcggcaggtgatccagcatgatggcaggaaccaggagaagctgaagaagttcatgatccgcatcggggtcttcagcggcctgtacctggtgcccctggtgaccctgctgggctgctacgtgtatgagcaggtgaaccgcatcacctgggagatcacctgggtgtctgaccactgccggcagtaccacatcccctgcccctaccaggccaaggccaaggcccggcctgagctggccctcttcatgatcaagtacctgatgaccctcatcgtgggcatctctgctgtgttctgggtgggcagcaagaagacctgcacagagtgggccggcttcttcaagaggaacaggaagagggaccccatcagcgagagcagaagagtgctgcaggagagctgtgagttcttcctgaagcacaacagcaaggtgaagcacaagaagaagcactacaagcccagcagccacaagctgaaggtgatcagcaagtccatgggcaccagcactggagccacagccaaccacggcaccagcgctgtggccatcaccagccatgactacctgggccaggagaccctgacagagatccagaccagccctgagacctccatgagggaggtgaaggcagatggagccagcaccccccggctgcgggagcaggactgtggggagcccgccagccctgctgccagcatcagccggctgagcggggagcaggtggatggcaagggccaggccggctctgtgtctgagagcgcccggtctgagggccgcatcagccccaagagtgacatcacagacaccggcctggcccagagcaacaacctgcaggtgcccagcagcagcgagcccagcagcctgaagggcagcaccagcctgctggtgcaccctgtgtctggagtgaggaaggagcagggcggcggctgccacagcgacacctag

SEQ ID NO: 152909 - DNA, 2085 bp, Artificial Sequence
  Description of Artificial Sequence: Synthetic coding sequence
atggagtggggctacctgctggaggtgaccagcctgctggccgccctggccctgctgcagaggagcagtggagctgctgctgccagcgccaaggagctggcctgccaggagatcaccgtgcccctgtgcaagggcatcggctacaactacacctacatgcccaaccagttcaaccacgacacccaggatgaagctggcctggaggtgcaccagttctggcccctggtggagatccagtgcagcccagacctgaagttcttcctgtgcagcatgtacacccccatctgcctggaggactacaagaagcccctgcccccctgccgctctgtgtgtgagcgggccaaggccggctgtgcccccctgatgaggcagtatggctttgcctggccagacaggatgagatgtgaccggctgcctgagcagggcaacccagacaccctgtgcatggactacaacagaacagacctgaccacagctgcccccagccccccccggcggctgcccccacctcctcctggagagcagccccccagcggcagcggccacggccggcccccaggggcccggcccccccaccggggcggcggccggggcggcggcggcggagatgctgctgcccccccagcccggggcggcggcggcggcggcaaggcccggcccccaggcggcggggccgccccctgtgagcccggctgccagtgccgggcccccatggtgtctgtgtcctctgagcggcaccccctgtacaacagagtgaagacaggccagatcgccaactgtgccctgccctgccacaaccccttcttcagccaggatgagcgggccttcaccgtcttctggattggcctgtggagcgtgctgtgctttgtgtccacctttgccaccgtgtccaccttcctgattgacatggagcgcttcaagtacccagagcggcccatcatcttcctgagcgcctgctacctgtttgtgtctgtgggctacctggtgcggctggtggccggccacgagaaggtggcctgcagcggcggggcccctggagctggaggagctgggggcgccggcggcgctgctgctggggccggggctgctggagctggagctgggggccctgggggccgcggggagtatgaggagctgggcgctgtggagcagcacgtgcgctatgagaccactggacctgccctgtgcaccgtggtgttcctgctggtgtacttcttcggcatggccagcagcatctggtgggtgatcctgagcctgacctggttcctggccgccggcatgaagtggggcaatgaggccatcgccggctacagccagtacttccacctggccgcctggctggtgcccagcgtgaagagcattgctgtgctggccctgagctctgtggatggagaccctgtggccggcatctgctacgtgggcaaccagagcctggacaacctgcggggctttgtgctggcccccctggtgatctacctgttcatcggcaccatgttcctgctggccggctttgtgtccctcttccgcatccgcagcgtcatcaagcagcaggacggccccaccaagacccacaagctggagaagctgatgatccggctgggcctcttcaccgtgctgtacacagtgcctgctgctgtggtggtggcctgcctcttctatgagcagcacaaccggccccgctgggaggccacccacaactgcccctgcctgcgggacctgcagcctgaccaggcccggcggccagactatgctgtgttcatgctgaagtacttcatgtgcctggtggtgggcatcaccagcggcgtgtgggtgtggagcggcaagaccctggagagctggaggagcctgtgcacccgctgctgctgggccagcaaaggagctgctgtgggcggcggggccggggccacagctgctgggggcggcggcggccctgggggcggcggcggcggcggccctgggggcggcggcggccctgggggcggcggcggcagcctgtacagtgatgtgtccacaggcctgacctggaggtctggaacagccagctctgtgtcctaccccaagcagatgcccctgagccaggtgtag

SEQ ID NO: 152910 - DNA, 1776 bp, Artificial Sequence
  Description of Artificial Sequence: Synthetic coding sequence
atggctgtggcccccctgcggggggccctgctgctgtggcagctgctggccgccggcggggccgccctggagatcggccgctttgatcctgagcggggccgcggggccgccccctgccaggccgtggagatccccatgtgccggggcatcggctacaacctgaccaggatgcccaacctgctgggccacaccagccagggcgaggccgctgctgagctggccgagtttgcccccctggtgcagtatggctgccacagccacctgcgcttcttcctgtgcagcctgtatgcccccatgtgcacagaccaggtgtccacccccatcccagcctgccggcccatgtgtgagcaggcccggctgcgctgtgcccccatcatggagcagttcaactttggctggccagacagcctggactgtgcccggctgcccaccagaaatgacccccacgccctgtgcatggaggccccagaaaatgccacagctggccctgctgagccccacaagggcctgggcatgctgcctgtggcccccaggcctgcccggcccccaggggacctgggccctggggccggcggcagcggcacctgtgaaaatcctgagaagttccagtatgtggagaagagccgcagctgtgccccccgctgtggccctggggtggaggtgttctggagcagaagagacaaggactttgccctggtgtggatggctgtgtggagcgccctgtgcttcttcagcacagccttcaccgtgctgaccttcctgctggagccccaccgcttccagtacccagagcggcccatcatcttcctgtccatgtgctacaacgtgtacagcctggccttcctgatccgggctgtggccggggcccagagcgtggcctgtgaccaggaggccggggccctgtatgtgatccaggagggcctggagaacacaggctgcaccctggtgttcctgctgctgtactacttcggcatggccagcagcctgtggtgggtggtgctgaccctgacctggttcctggccgccggcaagaagtggggccacgaggccatcgaggcccacggcagctacttccacatggccgcctggggcctgcctgccctgaagaccatcgtcatcctgaccctgaggaaggtggccggagatgagctgaccggcctgtgctacgtggccagcacagatgctgctgccctgactggatttgtgctggtgcccctgagcggctacctggtgctgggcagcagcttcctgctgactggatttgtggccctcttccacatcaggaagatcatgaagacaggaggcaccaacacagagaagctggagaagctgatggtgaagattggagtcttcagcatcctgtacacagtgcctgccacctgtgtgattgtgtgctacgtgtatgaaaggctgaacatggacttctggaggctgcgggccacagagcagccctgtgccgctgctgctggccctgggggccggcgggactgcagcctgcccggcggctctgtgcccaccgtggccgtgttcatgctgaagatcttcatgagcctggtggtgggcatcaccagcggcgtgtgggtgtggagcagcaagaccttccagacctggcagagcctgtgctacaggaagattgctgctggccgggcccgggccaaggcctgccgggcccctggcagctatggccggggcacccactgccactacaaggcccccaccgtggtgctgcacatgaccaagacagaccccagcctggagaaccccacccacctgtag

SEQ ID NO: 152911 - DNA, 978 bp, Artificial Sequence
  Description of Artificial Sequence: Synthetic coding sequence
atggtgtgtggcagccctgggggcatgctgctgctgcgggccggcctgctggccctggccgccctgtgcctgctgcgggtgcctggggcccgggctgctgcctgtgagcctgtgcgcatccccctgtgcaagagcctgccctggaacatgaccaagatgcccaaccacctgcaccacagcacccaggccaatgccatcctggccatcgagcagtttgagggcctgctgggcacccactgcagcccagacctgctcttcttcctgtgtgccatgtatgcccccatctgcaccatcgacttccagcacgagcccatcaagccctgcaagtctgtgtgtgagcgggcccggcagggctgtgagcccatcctgatcaagtaccgccacagctggccagagaacctggcctgtgaggagctgcctgtgtatgacagaggagtgtgcatcagccctgaggccatcgtgacagcagatggagctgacttccccatggacagcagcaatggaaactgccgcggggccagcagcgagcgctgcaagtgcaagcccatccgggccacccagaagacctacttcaggaacaactacaactacgtgatccgggccaaggtgaaggagatcaagaccaagtgccatgatgtgacagctgtggtggaggtgaaggagatcctgaagagcagcctggtgaacatcccccgggacacagtgaacctgtacaccagcagcggctgcctgtgcccccccctgaatgtgaatgaggagtacatcatcatgggctatgaagatgaggagaggagccggctgctgctggtggagggcagcattgctgagaagtggaaggaccggctgggcaagaaggtgaagcgctgggacatgaagctgcggcacctgggcctgagcaagagtgacagcagcaacagcgacagcacccagagccagaagagcggcaggaacagcaacccccggcaggccaggaactag

SEQ ID NO: 152912 - DNA, 930 bp, Artificial Sequence
  Description of Artificial Sequence: Synthetic coding sequence
atggaggagctgctgcggcgggagctgggctgcagctctgtgcgggccaccggccacagcggcggcggctgcatcagccagggccgctcctatgacacagaccagggccgggtgtttgtgaaggtgaaccccaaggccgaggcccggaggatgtttgaaggagagatggccagcctgacagccatcctgaagaccaacacagtgaaggtgcccaagcccatcaaggtgctggatgcccctgggggcggctctgtgctggtgatggagcacatggacatgaggcacctgagcagccacgccgccaagctgggcgcccagctggccgacctgcacctggacaacaagaagctgggggagatgaggctgaaggaggccggcaccgtgggccggggcggcggccaggaggagcggccctttgtggccaggtttggatttgatgtggtgacctgctgcggctacctgccccaggtgaatgactggcaggaggactgggtggtgttctacgcccggcagaggatccagccccagatggacatggtggagaaggagagcggggaccgggaggccctgcagctgtggagcgccctgcagctgaagatcccagacctcttccgggacctggagatcatcccagccctgctgcatggagacctgtggggcggcaatgtggccgaggacagcagcggccctgtgatctttgatcctgccagcttctacggccacagtgaatatgagctggccatcgccggcatgtttggaggcttcagcagcagcttctacagcgcctaccacggcaagatccccaaggcccctggctttgagaagaggctgcagctgtaccagctgttccactacctgaaccactggaaccacttcggcagcggctaccggggcagcagcctgaacatcatgaggaacctggtgaagtag

SEQ ID NO: 152913 - DNA, 780 bp, Artificial Sequence
  Description of Artificial Sequence: Synthetic coding sequence
atgtttgaaggagagatggccagcctgacagccatcctgaagaccaacacagtgaaggtgcccaagcccatcaaggtgctggatgcccctgggggcggctctgtgctggtgatggagcacatggacatgaggcacctgagcagccacgccgccaagctgggcgcccagctggccgacctgcacctggacaacaagaagctgggggagatgaggctgaaggaggccggcaccgtgggccggggcggcggccaggaggagcggccctttgtggccaggtttggatttgatgtggtgacctgctgcggctacctgccccaggtgaatgactggcaggaggactgggtggtgttctacgcccggcagaggatccagccccagatggacatggtggagaaggagagcggggaccgggaggccctgcagctgtggagcgccctgcagctgaagatcccagacctcttccgggacctggagatcatcccagccctgctgcatggagacctgtggggcggcaatgtggccgaggacagcagcggccctgtgatctttgatcctgccagcttctacggccacagtgaatatgagctggccatcgccggcatgtttggaggcttcagcagcagcttctacagcgcctaccacggcaagatccccaaggcccctggctttgagaagaggctgcagctgtaccagctgttccactacctgaaccactggaaccacttcggcagcggctaccggggcagcagcctgaacatcatgaggaacctggtgaagtag

SEQ ID NO: 152914 - DNA, 1017 bp, Artificial Sequence
  Description of Artificial Sequence: Synthetic coding sequence
atggctgaccaggccccctttgacacagatgtgaacaccctgaccaggtttgtgatggaggagggcaggaaggcccggggcaccggggagctgacccagctgctgaacagcctgtgcacagctgtgaaggccatcagcagcgctgtgaggaaggccggcatcgcccacctgtatggaattgctggcagcaccaacgtgactggagaccaggtgaagaagctggatgtgctgagcaatgacctggtgatgaacatgctgaagagcagctttgccacctgtgtgctggtgtctgaggaggacaagcacgccatcatcgtggagcctgagaagaggggcaagtatgtggtgtgctttgaccccctggatggcagcagcaacatcgactgcctggtgtctgtgggcaccatcttcggcatctacaggaagaagagcacagatgagcccagcgagaaggatgccctgcagcccggcaggaacctggtggccgccggctacgccctgtatggcagcgccaccatgctggtgctggccatggactgtggggtgaactgcttcatgctggaccctgccatcggggagttcatcctggtggacaaggatgtgaagatcaagaagaagggcaagatctacagcctgaatgaaggctacgcccgggactttgatcctgctgtgacagagtacatccagaggaagaagttccccccagacaacagcgccccctatggagcccgctacgtgggctccatggtggctgatgtgcacaggaccctggtgtatggaggcatcttcctgtacccagccaacaagaagagccccaacgggaagctgcggctgctgtatgagtgcaaccccatggcctacgtgatggagaaggccggcggcatggccaccaccgggaaggaggccgtgctggatgtgatccccacagacatccaccagagggcccctgtgatcctgggcagcccagatgatgtgctggagttcctgaaggtgtatgagaagcacagcgcccagtag

SEQ ID NO: 152915 - DNA, 456 bp, Artificial Sequence
  Description of Artificial Sequence: Synthetic coding sequence
atgctgaagagcagctttgccacctgtgtgctggtgtctgaggaggacaagcacgccatcatcgtggagcctgagaagaggggcaagtatgtggtgtgctttgaccccctggatggcagcagcaacatcgactgcctggtgtctgtgggcaccatcttcggcatctacaggaagaagagcacagatgagcccagcgagaaggatgccctgcagcccggcaggaacctggtggccgccggctacgccctgtatggcagcgccaccatgctggtgctggccatggactgtggggtgaactgcttcatgctggaccctgccatcggggagttcatcctggtggacaaggatgtgaagatcaagaagaagggcaagatctacagcctgaatgaaggctacgcccgggactttgatcctgctgtgacagagtacatccagaggaagaagttccccccatag

SEQ ID NO: 152916 - DNA, 1017 bp, Artificial Sequence; identical to SEQ ID NO: 152914
  Description of Artificial Sequence: Synthetic coding sequence

SEQ ID NO: 152917 - DNA, 1020 bp, Artificial Sequence
  Description of Artificial Sequence: Synthetic coding sequence
atgacagacaggagcccctttgaaacagacatgctgaccctgaccaggtatgtgatggagaagggccggcaggccaagggcaccggggagctgacccagctgctgaacagcatgctgacagccatcaaggccatcagcagcgctgtgaggaaggccggcctggcccacctgtatggaattgctggctctgtgaatgtgactggagatgaggtgaagaagctggatgtgctgagcaacagcctggtgatcaacatggtgcagagcagctacagcacctgtgtgctggtgtctgaggagaacaaggatgccatcatcacagccaaggagaagaggggcaagtatgtggtgtgctttgaccccctggatggcagcagcaacatcgactgcctggccagcatcggcaccatctttgccatctacaggaagaccagtgaagatgagcccagcgagaaggatgccctgcagtgtggcaggaacatcgtggccgccggctacgccctgtatggcagcgccaccctggtggccctgagcacaggccagggcgtggacctcttcatgctggaccctgccctgggggagtttgtgctggtggagaaggatgtgaagatcaagaagaagggcaagatctacagcctgaatgaaggctacgccaagtactttgatgctgccaccacagaatatgtgcagaagaagaagttcccagaagatggcagcgccccctatggagcccgctacgtgggctccatggtggctgatgtgcacaggaccctggtgtatggaggcatcttcctgtacccagccaaccagaagagccccaagggcaagctgcggctgctgtatgagtgcaaccctgtggcctacatcatcgagcaggccggcggcctggccaccaccggcacccagcctgtgctggatgtgaagccagaggccatccaccagagggtgcccctcatcctgggcagcccagaagatgtgcaggagtacctgacctgtgtgcagaagaaccaggccggcagctag

SEQ ID NO: 152918 - DNA, 837 bp, Artificial Sequence
  Description of Artificial Sequence: Synthetic coding sequence
atgggcaaaggaaatgaagacagcgacctgcactgcagcagcatccagtgcagcacagaccagccccccttccagcagatctccttcacagagaagggcagtgatgagaagaagcccttcaaggagaagggcaagacagccttcagccacagcagcgagaagcacatccagaggcagggcagcgagcccaaccccaacaaggagaacagcgaggagaccaagctgaaggccggcaacagcacagctggcagcgagcctgagagcagcagctaccgggagaactgcaggaagaggaagatgagcagcaaggacagctgccaggacacagctggcaactgcccagagaaggaatgttccctgagcctgaacaagaagagccgcagcagcacagctgtgcacaacagcgagatccaggagacctgtgatgcccaccaccggggccacagccgggcctgcaccggccacagcaagaggcacaggagccgggccctgggcgtgcagacccccagcatcaggaagagcctggtgacctctgtgcgggccatgtctgaggccgtgtaccaggacctggcccaggtgtgggcccagcagatccacagccccctgacctgtgagcagctgaccctgctgacccggctgcggggccccctgtgtgcccaggtgcagaccctgtacagcatggccacccaggccgcctacgtgtttcctgctgagagctggctggtgcctgccaccctgcccggccctggagagagcgccctggaccgggaggcccaccccttccctggccaggagatcacagaaacagtgtctggcagtgatgaggccaagctgtag

SEQ ID NO: 152919 - DNA, 984 bp, Artificial Sequence
  Description of Artificial Sequence: Synthetic coding sequence
atgggccgcaccagcaaggacaagagagatgtgtactaccgcctggccaaggaaaatggctggagggcccggagcgccttcaagctgctgcagctggacaaggagttccagctgttccagggcgtgaccagggctgtggacctgtgtgccgcccctggctcctggagccaggtgctgagccagaagattggaggccagggcagcggccacgtggtggccgtggacctgcaggccatggcccccctgcccggggtggtgcagatccagggcgacatcacccagctgagcacagccaaggagatcatccagcacttcaagggctgcccagctgacctggtggtgtgtgatggagccccagatgtgacaggcctgcatgatgtggatgagtacatgcaggcccagctgctgctggccgccctgaacatcgccacccacgtgctgaagccaggcggctgctttgtggccaagatcttccggggcagagatgtgaccctgctgtacagccagctgcaggtgttcttcagctctgtgctgtgtgccaagcccaggagcagcaggaacagcagcattgaggcctttgctgtgtgccagggctatgaccccccagagggcttcatcccagacctgagcaagcccctgctggaccacagctatgacttcaaccagctggatggccccacccgcatcatcgtgccctttgtgacctgtggggacctgagcagctatgacagcgacaggagctaccccctggacctggagggcggcagcgagtacaagtacaccccacccacccagccccccatcagccccccctaccaggaggcctgcaccctgaagaggaagggccagctggccaaggagatccggccccaggactgccccatcagccgggtggacaccttcccccagcccctggccgccccccagtgccacaccctgctggcccctgagatggaggacaatgagatgagctgcagcccctag

SEQ ID NO: 152920 - DNA, 990 bp, Artificial Sequence
  Description of Artificial Sequence: Synthetic coding sequence
atgggccgcaccagcaaggacaagagagatgtgtactaccgcctggccaaggaaaatggctggagggcccggagcgccttcaagctgctgcagctggacaaggagttccagctgttccagggcgtgaccagggctgtggacctgtgtgccgcccctggctcctggagccaggtgctgagccagaagattggaggccagggcagcggccacgtggtggccgtggacctgcaggccatggcccccctgcccggggtggtgcagatccagggcgacatcacccagctgagcacagccaaggagatcatccagcacttcaagggctgcccagctgacctggtggtgtgtgatggagccccagatgtgacaggcctgcatgatgtggatgagtacatgcaggcccagctgctgctggccgccctgaacatcgccacccacgtgctgaagccaggcggctgctttgtggccaagatcttccggggcagagatgtgaccctgctgtacagccagctgcaggtgttcttcagctctgtgctgtgtgccaagcccaggagcagcaggaacagcagcattgaggcctttgctgtgtgccagggctatgaccccccagagggcttcatcccagacctgagcaagcccctgctggaccacagctatgaccctgacttcaaccagctggatggccccacccgcatcatcgtgccctttgtgacctgtggggacctgagcagctatgacagcgacaggagctaccccctggacctggagggcggcagcgagtacaagtacaccccacccacccagccccccatcagccccccctaccaggaggcctgcaccctgaagaggaagggccagctggccaaggagatccggccccaggactgccccatcagccgggtggacaccttcccccagcccctggccgccccccagtgccacaccctgctggcccctgagatggaggacaatgagatgagctgcagcccctag

SEQ ID NO: 152921 - DNA, 579 bp, Artificial Sequence
  Description of Artificial Sequence: Synthetic coding sequence
atggccctgaacatcgccacccacgtgctgaagccaggcggctgctttgtggccaagatcttccggggcagagatgtgaccctgctgtacagccagctgcaggtgttcttcagctctgtgctgtgtgccaagcccaggagcagcaggaacagcagcattgaggcctttgctgtgtgccagggctatgaccccccagagggcttcatcccagacctgagcaagcccctgctggaccacagctatgaccctgacttcaaccagctggatggccccacccgcatcatcgtgccctttgtgacctgtggggacctgagcagctatgacagcgacaggagctaccccctggacctggagggcggcagcgagtacaagtacaccccacccacccagccccccatcagccccccctaccaggaggcctgcaccctgaagaggaagggccagctggccaaggagatccggccccaggactgccccatcagccgggtggacaccttcccccagcccctggccgccccccagtgccacaccctgctggcccctgagatggaggacaatgagatgagctgcagcccctag

SEQ ID NO: 152922 - DNA, 984 bp, Artificial Sequence; identical to SEQ ID NO: 152919
  Description of Artificial Sequence: Synthetic coding sequence

SEQ ID NO: 152923 - DNA, 741 bp, Artificial Sequence
  Description of Artificial Sequence: Synthetic coding sequence
atggccggctacctgaagctggtgtgtgtgtccttccagaggcagggcttccacacagtgggcagccgctgcaagaacagaactggagctgagcacctgtggctgaccaggcacctgcgggacccctttgtgaaggccgccaaggtggagagctaccgctgccgcagcgccttcaagctgctggaggtgaatgaaagacaccagatcctgcggcccggcctgcgggtgctggactgtggggccgcccctggggcctggagccaggtggccgtgcagaaggtgaatgctgctggaacagaccccagcagccctgtgggctttgtgctgggcgtggacctgctgcacatcttccccctggagggcgccaccttcctgtgcccagcagatgtgacagaccccaggaccagccagaggatcctggaggtgctgcccggccggcgggcagatgtgatcctgagtgacatggccccaaatgccaccggcttccgggacctggaccatgacaggctcatcagcctgtgcctgaccctgctgtctgtgaccccagacatcctgcagcccggcggcaccttcctgtgcaagacctgggccggcagccagagccggcggctgcagaggcggctgacagaggagttccagaatgtgcgcatcatcaagccagaggccagcaggaaggagagcagcgaggtgtacttcctggccacccagtaccacggcaggaaaggaacagtgaagcagtag

SEQ ID NO: 152924 - DNA, 438 bp, Artificial Sequence
  Description of Artificial Sequence: Synthetic coding sequence
atggccggctacctgaagctggtgtgtgtgtccttccagaggcagggcttccacacagtgggcagccgctgcaagaacagaactggagctgagcacctgtggctgaccaggcacctgcgggacccctttgtgaaggccgccaaggtggagagctaccgctgccgcagcgccttcaagctgctggaggtgaatgaaagacaccagatcctgcggcccggcctgcgggtgctggactgtggggccgcccctggggcctggagccaggtggccgtgcagaaggtgaatgctgctggaacagatggagtgtccctgctgccccggctgcagtgcaatggagtcatcagcgcccactgcaacctgtgcctgcccggcagcagtgacagccctgccagcgccagccagatcccagccctgctgctggccagctgcctgggctag

SEQ ID NO: 152925 - DNA, 768 bp, Artificial Sequence
  Description of Artificial Sequence: Synthetic coding sequence
atgcctgagctgtatgacctggtgaacagctacaagccagacctgatctggagcgatggagagtgggagtgcccagacacctactggaacagcaccaacttcctgtcctggctgtacaatgacagccctgtgaaggatgaggtggtggtgaatgaccgctggggccagaactgcagctgccaccacggcggctactacaactgtgaggacaagttcaagccccagagcctgcctgaccacaagtgggagatgtgcaccagcattgacaagttctcctggggctaccgccgggacatggccctgagtgatgtgacagaggagagcgagatcatcagcgagctggtgcagacagtgtccctgggcggcaactacctgctgaacatcggccccaccaaggatggcctcatcgtgcccatcttccaggagcggctgctggccgtgggcaagtggctgagcatcaacggggaggccatctatgccagcaagccctggagggtgcagtgggagaagaacaccacctctgtgtggtacaccagcaagggcagcgctgtgtatgccatcttcctgcactggccagaaaatggagtgctgaacctggagagccccatcaccaccagcaccaccaagatcaccatgctgggcatccagggcgacctgaagtggagcacagatcctgacaagggcctcttcatcagcctgccccagctgcccccatctgctgtgcctgctgagtttgcctggaccatcaagctgactggagtgaagtag

SEQ ID NO: 152926 - DNA, 1401 bp, Artificial Sequence
  Description of Artificial Sequence: Synthetic coding sequence
atgagggcccctggcatgaggagcaggcctgctggccctgccctgctgctgctgctgctcttcctgggcgctgctgagagcgtgagaagagcccagcccccccggcgctacaccccagactggcccagcctggacagccggcccctgcctgcctggtttgatgaggccaagtttggagtcttcatccactggggcgtcttctctgtgcctgcctggggcagcgagtggttctggtggcactggcagggcgagggccggccccagtaccagcgcttcatgagggacaactacccacctggcttctcctatgctgactttggcccccagttcaccgcccgcttcttccaccctgaggagtgggccgacctcttccaggccgccggggccaagtatgtggtgctgaccaccaagcaccacgagggcttcaccaactggcccagccctgtgtcctggaactggaacagcaaggatgtgggcccccaccgggacctggtgggggagctgggcacagccctgaggaagaggaacatccgctatggcctgtaccacagcctgctggagtggttccaccccctgtacctgctggacaagaagaatggcttcaagacccagcactttgtgtctgccaagaccatgcctgagctgtatgacctggtgaacagctacaagccagacctgatctggagcgatggagagtgggagtgcccagacacctactggaacagcaccaacttcctgtcctggctgtacaatgacagccctgtgaaggatgaggtggtggtgaatgaccgctggggccagaactgcagctgccaccacggcggctactacaactgtgaggacaagttcaagccccagagcctgcctgaccacaagtgggagatgtgcaccagcattgacaagttctcctggggctacagaagagacatggccctgagtgatgtgacagaggagagcgagatcatcagcgagctggtgcagacagtgtccctgggcggcaactacctgctgaacatcggccccaccaaggatggcctgattgtgcccatcttccaggagcggctgctggccgtgggcaagtggctgagcatcaatggagaggccatctatgccagcaagccctggagggtgcagtgggagaagaacaccacctctgtgtggtacaccagcaaaggatctgctgtgtatgccatcttcctgcactggccagaaaatggagtgctgaacctggagagccccatcaccaccagcaccaccaagatcaccatgctgggcatccagggcgacctgaagtggagcacagatcctgacaagggcctcttcatcagcctgccccagctgccccccagcgctgtgcctgctgagtttgcctggaccatcaagctgactggagtgaagtag

SEQ ID NO: 152927 - DNA, 1404 bp, Artificial Sequence
  Description of Artificial Sequence: Synthetic coding sequence
atgaggccccaggagctgccccggctggccttccccctgctgctgctgctgctgctgctgctgcccccaccaccctgcccagcccacagcgccaccaggtttgaccccacctgggagagcctggatgcccggcagctgcctgcctggtttgaccaggccaagtttggcatcttcatccactggggcgtcttctctgtgcccagctttggaagtgagtggttctggtggtactggcagaaggagaagatccccaagtatgtggagttcatgaaggacaactacccacccagcttcaagtatgaagattttggccccctcttcaccgccaagttcttcaatgccaaccagtgggccgacatcttccaggccagcggggccaagtacatcgtgctgaccagcaagcaccacgagggcttcaccctgtggggcagcgagtacagctggaactggaatgccattgatgagggccccaagagggacatcgtgaaggagctggaggtggccatccggaacagaacagacctgcgcttcggcctgtactacagcctgtttgagtggttccaccccctcttcctggaggatgagagcagcagcttccacaagaggcagtttcctgtgtccaagaccctgcctgagctgtatgagctggtgaacaactaccagcctgaggtgctgtggagcgatggagatggaggagccccagaccagtactggaacagcacaggcttcctggcctggctgtacaatgaaagccctgtgcggggcaccgtggtgaccaatgaccgctggggcgccggcagcatctgcaagcatggaggcttctacacctgcagcgaccgctacaaccctggccacctgctgccccacaagtgggagaactgcatgaccatcgacaagctgtcctggggctacagaagagaggccggcatcagtgactacctgaccatcgaggagctggtgaagcagctggtggagaccgtgtcctgtggcggcaacctgctgatgaacatcggccccaccctggatggcaccatctctgtggtgtttgaggagcggctgcggcagatgggctcctggctgaaggtgaatggagaggccatctatgagacccacacctggaggagccagaatgacacagtgaccccagatgtgtggtacaccagcaagcccaaggagaagctggtgtatgccatcttcctgaagtggcccaccagcggccagctgttcctgggccaccccaaggccatcctgggcgccacagaggtgaagctgctgggccacggccagcccctgaactggatcagcctggagcagaatggcatcatggtggagctgccccagctgaccatccaccagatgccctgcaagtggggctgggccctggccctgaccaacgtcatctag

SEQ ID NO: 152928 - DNA, 498 bp, Artificial Sequence
  Description of Artificial Sequence: Synthetic coding sequence
atgaggccccaggagctgccccggctggccttccccctgctgctgctgctgctgctgctgctgcccccaccaccctgcccagcccacagcgccaccaggtttgaccccacctgggagagcctggatgcccggcagctgcctgcctggtttgaccaggccaagtttggcatcttcatccactggggcgtcttctctgtgcccagctttggaagtgagtggttctggtggtactggcagaaggagaagatccccaagtatgtggagttcatgaaggacaactacccacccagcttcaagtatgaagattttggccccctcttcaccgccaagttcttcaatgccaaccagtgggccgacatcttccaggccagcggggccaagtacatcgtgctgaccagcaagcaccacgaggccacctgccgggacagcttcatgtggaggaagagctttgatgagtactgggcccacacccgctggcaccacttctgcagcttctag

SEQ ID NO: 152929 - DNA, 498 bp, Artificial Sequence; identical to SEQ ID NO: 152928
  Description of Artificial Sequence: Synthetic coding sequence

SEQ ID NO: 152930 - DNA, 330 bp, Artificial Sequence
  Description of Artificial Sequence: Synthetic coding sequence
cagctggtggagaccgtgtcctgtggcggcaacctgctgatgaacatcggccccaccctggatggcaccatctctgtggtgtttgaggagcggctgcggcagatgggctcctggctgaaggtgaatggagaggccatctatgagacccacacctggaggagccagaatgacacagtgaccccagatgtgtggtacaccagcaagcccaaggagaagctggtgtatgccatcttcctgaagtggcccaccagcggccagctgttcctgggccaccccaaggccatcctgggcgccacagaggtgcggggcaacttcaccctcttcctgtag

SEQ ID NO: 152931 - DNA, 1098 bp, Artificial Sequence
  Description of Artificial Sequence: Synthetic coding sequence
atgtggctgcggagccaccggcagctgtgcctggccttcctgctggtgtgtgtgctgagcgtcatcttcttcctgcacatccaccaggacagcttcccccacggcctgggcctgagcatcctgtgcccagaccggcggctggtgaccccacctgtggccatcttctgcctgcccggcacagccatgggccccaatgccagcagcagctgcccccagcacccagccagcctgagcggcacctggacagtgtaccccaacggccgctttggaaaccagatgggccagtatgccaccctgctggccctggcccagctgaatggccggcgggccttcatcctgcctgccatgcacgccgccctggcccctgtgttccgcatcaccctgcctgtgctggcccctgaggtggacagcaggaccccctggagggagctgcagctgcatgactggatgtctgaggagtatgctgacctgcgggaccccttcctgaagctgagcggcttcccctgctcctggaccttcttccaccacctgcgggagcagatccggcgggagttcaccctgcatgaccacctgcgggaggaggcccagagcgtgctgggccagctgcggctgggccgcactggagaccggcccaggacctttgtgggcgtgcacgtgcggcggggggactacctgcaggtgatgccccagcgctggaagggcgtggtgggggacagcgcctacctgcggcaggccatggactggttccgggcccggcatgaggcccctgtgtttgtggtgaccagcaatggcatggagtggtgcaaggagaacatcgacaccagccagggagatgtgacctttgctggagatggccaggaggccaccccctggaaggactttgccctgctgacccagtgcaaccacaccatcatgaccatcggcaccttcggcttctgggccgcctacctggccggcggggacacagtgtacctggccaacttcaccctgcctgattctgagttcctgaagatcttcaagccagaggccgccttcctgcctgagtgggtgggcatcaatgctgacctgagccccctgtggaccctggccaagccctag

SEQ ID NO: 152932 - DNA, 1068 bp, Artificial Sequence
  Description of Artificial Sequence: Synthetic coding sequence
atgtggctgcggagccaccggcagctgtgcctggccttcctgctggtgtgtgtgctgagcgtcatcttcttcctgcacatccaccaggacagcttcccccacggcctgggcctgagcatcctgtgcccagaccggcggctggtgaccccacctgtggccatcttctgcctgcccggcacagccatgggccccaatgccagcagcagctgcccccagcacccagccagcctgagcggcacctggacagtgtaccccaacggccgctttggaaaccagatgggccagtatgccaccctgctggccctggcccagctgaatggccggcgggccttcatcctgcctgccatgcacgccgccctggcccctcctgaggtggacagcaggaccccctggagggagctgcagctgcatgactggatgtctgaggagtatgctgacctgcgggaccccttcctgaagctgagcggcttcccctgctcctggaccttcttccaccacctgcgggagcagatccggcgggagttcaccctgcatgaccacctgcgggaggaggcccagagcgtgctgggccagctgcggctgggccgcactggagaccggcccaggacctttgtgggcgtgcacgtgcggcggggggactacctgcaggtgatgccccagcgctggaagggcgtggtgggggacagcgcctacctgcggcaggccatggactggttccgggcccggcatgaggcccctgtgtttgtggtgaccagcaatggcatggagtggtgcaaggagaacatcgacaccagccagggagatgtgacctttgctggagatggccaggaggccaccccctggaaggactttgccctgctgacccagtgcaaccacaccatcatgaccatcggcaccttcggcttctgggccgcctacctggccggcggggacacagtgtacctggccaacttcaccctgcctgattctgagttcctgaagatcttcaagccagaggccgccttcctgcctgagtgggtgggcatcaatgctgacctgagccccctgtggaccctggccaagccctag

SEQ ID NO: 152933 - DNA, 1032 bp, Artificial Sequence
  Description of Artificial Sequence: Synthetic coding sequence
atgctggtggtgcagatgcccttctccttccccatggcccacttcatcctgtttgtgttcaccgtgtccaccatcttccacgtgcagcagaggctggccaagatccaggccatgtgggagctgcctgtgcagatccctgtgctggccagcaccagcaaggccctgggccccagccagctgcggggcatgtggaccatcaatgccatcggccgcctgggcaaccagatgggagaatatgccaccctgtatgccctggccaagatgaatggccggcctgccttcatcccagcccagatgcacagcaccctggcccccatcttccgcatcaccctgcctgtgctgcacagcgccacagccagccgcatcccctggcagaactaccacctgaatgactggatggaggaggagtaccgccacatccctggagaatatgtgcgcttcaccggctacccctgctcctggaccttctaccaccacctgcggcaggagatcctgcaggagttcaccctgcatgaccacgtgcgggaggaggcccagaagttcctgcggggcctgcaggtgaatggcagccggcccggcacctttgtgggcgtgcacgtgagaagaggagactatgtgcacgtgatgcccaaggtgtggaagggcgtggtggccgaccggcgctacctgcagcaggccctggactggttccgggcccgctacagcagcctcatctttgtggtgaccagcaatggcatggcctggtgcagagaaaatattgacaccagccatggagatgtggtgtttgctggagatggcatcgagggcagccctgccaaggactttgccctgctgacccagtgcaaccacaccatcatgaccatcggcaccttcggcatctgggccgcctacctgactggaggagacaccatctacctggccaactacaccctgcctgacagccccttcctgaagatcttcaagccagaggccgccttcctgcctgagtggacaggaattgctgctgacctgagccccctgctgaagcactag

SEQ ID NO: 152934 - DNA, 1032 bp, Artificial Sequence; identical to SEQ ID NO: 152933
  Description of Artificial Sequence: Synthetic coding sequence

SEQ ID NO: 152935 - DNA, 663 bp, Artificial Sequence
  Description of Artificial Sequence: Synthetic coding sequence
atgctggtggtgcagatgcccttctccttccccatggcccacttcatcctgtttgtgttcaccgtgtccaccatcttccacgtgcagcagaggctggccaagatccaggccatgtgggagctgcctgtgcagatccctgtgctggccagcaccagcaaggccctgggccccagccagctgcggggcatgtggaccatcaatgccatcggccgcctgggcaaccagatgggagaatatgccaccctgtatgccctggccaagatgaatggccggcctgccttcatcccagcccagatgcacagcaccctggcccccatcttccgcatcaccctgcctgtgctgcacagcgccacagccagccgcatcccctggcagaactaccacctgaatgactggatggaggaggagtaccgccacatccctggagaatatgtgcgcttcaccggctacccctgctcctggaccttctaccaccacctgcggcaggagatcctgcaggagttcaccctgcatgaccacgtgcgggaggaggcccagaagttcctgcggggcctgcaggtgaatggcagccggcccggcacctttgtgggcgtgcacgtgagaagaggagactatgtgcacgtgatgcccaaggtgtggaagggcgtggtggccgacagatag

SEQ ID NO: 152936 - DNA, 1086 bp, Artificial Sequence
  Description of Artificial Sequence: Synthetic coding sequence
atggaccccctgggcgccgccaagccccagtggccctggaggcgctgcctggccgccctgctcttccagctgctggtggccgtgtgcttcttctcctacctgcgggtgtccagagatgatgccaccggcagcccccgggcccccagcggcagcagccggcaggacaccacccccacccggcccaccctgctgatcctgctgcggacctggcccttccacatccctgtggccctgagccgctgcagcgagatggtgcccggcacagctgactgccacatcacagctgacaggaaggtgtacccccaggccgacatggtgattgtgcaccactgggacatcatgagcaaccccaagagccggctgccccccagcccccggccccagggccagcgctggatctggttcaacctggagcccccacccaactgccagcacctggaggccctggaccgctacttcaacctgaccatgagctacagaagtgacagcgacatcttcaccccctacggctggctggagccctggagcggccagcctgcccacccccccctgaacctgagcgccaagacagagctggtggcctgggccgtgagcaactggaagccagacagcgcccgggtgcgctactaccagagcctgcaggcccacctgaaggtggatgtgtatggccgcagccacaagcccctgcccaagggcaccatgatggagaccctgagccgctacaagttctacctggcctttgagaacagcctgcacccagactacatcacagagaagctgtggagaaatgccctggaggcctgggccgtgcctgtggtgctgggccccagccgcagcaactatgagcgcttcctgcccccagatgccttcatccacgtggatgacttccagagccccaaggacctggcccgctacctgcaggagctggacaaggaccacgcccgctacctgagctacttccgctggagggagaccctgcggcccaggagcttctcctgggccctggacttctgcaaggcctgctggaagctgcagcaggagagccgctaccagacagtgcgcagcattgctgcctggttcacctag

SEQ ID NO: 152937 - DNA, 1086 bp, Artificial Sequence; identical to SEQ ID NO: 152936
  Description of Artificial Sequence: Synthetic coding sequence

SEQ ID NO: 152938 - DNA, 1086 bp, Artificial Sequence; identical to SEQ ID NO: 152936
  Description of Artificial Sequence: Synthetic coding sequence

SEQ ID NO: 152939 - DNA, 1086 bp, Artificial Sequence; identical to SEQ ID NO: 152936
  Description of Artificial Sequence: Synthetic coding sequence

SEQ ID NO: 152940 - DNA, 1593 bp, Artificial Sequence
  Description of Artificial Sequence: Synthetic coding sequence
atgaggcggctgtggggcgccgccaggaagcccagcggggccggctgggagaaggagtgggccgaggccccccaggaggcccctggggcctggagcggccgcctgggccctggccgcagcggcaggaagggccgggctgtgcccggctgggcctcctggccagcccacctggccctggccgcccggcctgcccggcacctgggcggggccggccagggcccccggcccctgcacagcggcacagcccccttccacagccgggccagcggggagcggcagaggcggctggagccccagctgcagcacgagagccgctgccgcagcagcaccccagcagatgcctggagggctgaggccgccctgcctgtgcgggccatgggcgccccctggggcagccccacagctgctgctgggggccggcggggctggaggcggggccggggcctgccctggacagtgtgtgtgctggccgctgctggcctgacctgcacagccctgatcacctacgcctgctggggccagctgccccccctgccctgggccagccccacccccagcaggcctgtgggcgtgctgctgtggtgggagccctttggaggccgggacagcgcccccaggcctcctccagactgccgcctgcgcttcaacatcagcggctgccgcctgctgacagaccgggccagctatggagaggcccaggccgtgctcttccaccaccgggacctggtgaagggccccccagactggcccccaccctggggcatccaggcccacacagctgaggaggtggacctgcgggtgctggactatgaggaggccgctgctgctgctgaggccctggccaccagcagccccaggcctcctggccagcgctgggtgtggatgaactttgagagccccagccacagccctggcctgcggagcctggccagcaacctcttcaactggaccctgagctacagagctgacagtgatgtgtttgtgccctacggctacctgtaccccaggagccaccctggggacccccccagcggcctggccccacccctgagcaggaagcagggcctggtggcctgggtggtgagccactgggatgagcggcaggcccgggtgcgctactaccaccagctgagccagcacgtgacagtggatgtgtttggccggggcggccctggccagcctgtgcctgagatcggcctgctgcacacagtggcccgctacaagttctacctggcctttgagaacagccagcacctggactacatcacagagaagctgtggagaaatgccctgctggccggggctgtgcctgtggtgctgggccctgaccgggccaactatgaaagatttgtgcccaggggggccttcatccacgtggatgacttccccagcgccagcagcctggccagctacctgctcttcctggacagaaatcctgctgtgtaccgccgctacttccactggaggaggagctatgctgtgcacatcaccagcttctgggatgagccctggtgccgggtgtgccaggccgtgcagagagctggggaccggcccaagagcatccggaacctggcctcctggtttgagaggtag

SEQ ID NO: 152941 - DNA, 1125 bp, Artificial Sequence
  Description of Artificial Sequence: Synthetic coding sequence
atggaccccctgggccctgccaagccccagtggctgtggaggcgctgcctggccggcctgctcttccagctgctggtggccgtgtgcttcttctcctacctgcgggtgtccagagatgatgccaccggcagccccaggcctggcctgatggctgtggagcctgtgactggagcccccaacggcagccgctgccaggacagcatggccaccccagcccaccccaccctgctgatcctgctgtggacctggcccttcaacacccctgtggccctgccccgctgcagcgagatggtgcctggagctgctgactgcaacatcacagctgacagctctgtgtacccccaggctgatgctgtgattgtgcaccactgggacatcatgtacaaccccagcgccaacctgcccccacccacccggccccagggccagcgctggatctggttctccatggagagccccagcaactgccgccacctggaggccctggatggctacttcaacctgaccatgagctacagaagtgacagcgacatcttcaccccctacggctggctggagccctggagcggccagcctgcccacccccccctgaacctgagcgccaagacagagctggtggcctgggccgtgagcaactggaagccagattctgcccgggtgcgctactaccagagcctgcaggcccacctgaaggtggatgtgtatggccgcagccacaagcccctgcccaagggcaccatgatggagaccctgagccgctacaagttctacctggcctttgagaacagcctgcacccagactacatcacagagaagctgtggagaaatgccctggaggcctgggccgtgcctgtggtgctgggccccagccgcagcaactatgagcgcttcctgcccccagatgccttcatccacgtggatgacttccagagccccaaggacctggcccgctacctgcaggagctggacaaggaccacgcccgctacctgagctacttccactggagggagaccctgcggcccaggagcttctcctgggccctggccttctgcaaggcctgctggaagctgcagcaggagagccgctaccagacagtgcgcagcattgctgcctggttcacctag

SEQ ID NO: 152942 - DNA, 1125 bp, Artificial Sequence; identical to SEQ ID NO: 152941
  Description of Artificial Sequence: Synthetic coding sequence

SEQ ID NO: 152943 - DNA, 1080 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttcttctcctacctgcgggtgtcccaggatgaccccaccgtgtaccccaacggcagccgcttcccagacagcacaggcaccccagcccacagcatccccctcatcctgctgtggacctggcccttcaacaagcccatcgccctgccccgctgcagcgagatggtgcctggaacagctgactgcaacatcacagctgacaggaaggtgtacccccaggctgatgctgtgattgtgcaccaccgggaggtgatgtacaaccccagcgcccagctgcccaggagcccccggcggcagggccagcgctggatctggttctccatggagagccccagccactgctggcagctgaaggccatggatggctacttcaacctgaccatgagctacagaagtgacagcgacatcttcaccccctacggctggctggagccctggagcggccagcctgcccacccccccctgaacctgagcgccaagacagagctggtggcctgggccgtgagcaactggggccccaacagcgcccgggtgcgctactaccagagcctgcaggcccacctgaaggtggatgtgtatggccgcagccacaagcccctgccccagggcaccatgatggagaccctgagccgctacaagttctacctggcctttgagaacagcctgcacccagactacatcacagagaagctgtggagaaatgccctggaggcctgggccgtgcctgtggtgctgggccccagccgcagcaactatgagcgcttcctgcccccagatgccttcatccacgtggatgacttccagagccccaaggacctggcccgctacctgcaggagctggacaaggaccacgcccgctacctgagctacttccgctggagggagaccctgcggcccaggagcttctcctgggccctggccttctgcaaggcctgctggaagctgcaggaggagagccgctaccagacccggggcattgctgcctggttcacctag

SEQ ID NO: 152944 - DNA, 1080 bp, Artificial Sequence; identical to SEQ ID NO: 152943
  Description of Artificial Sequence: Synthetic coding sequence

SEQ ID NO: 152945 - DNA, 1098 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttcttctcctacctgcgggtgtcccaggatgaccccaccgtgtaccccaacggcagccgcttcccagacagcacaggcaccccagcccacagcatccccctcatcctgctgtggacctggcccttcaacaagcccatcgccctgccccgctgcagcgagatggtgcctggaacagctgactgcaacatcacagctgacaggaaggtgtacccccaggctgatgctgtgattgtgcaccaccgggaggtgatgtacaaccccagcgcccagctgcccaggagcccccggcggcagggccagcgctggatctggttctccatggagagccccagccactgctggcagctgaaggccatggatggctacttcaacctgaccatgagctacagaagtgacagcgacatcttcaccccctacggctggctggagccctggagcggccagcctgcccacccccccctgaacctgagcgccaagacagagctggtggcctgggccgtgagcaactggggccccaacagcgcccgggtgcgctactaccagagcctgcaggcccacctgaaggtggatgtgtatggccgcagccacaagcccctgccccagggcaccatgatggagaccctgagccgctacaagttctacctggcctttgagaacagcctgcacccagactacatcacagagaagctgtggagaaatgccctggaggcctgggccgtgcctgtggtgctgggccccagccgcagcaactatgagcgcttcctgcccccagatgccttcatccacgtggatgacttccagagccccaaggacctggcccgctacctgcaggagctggacaaggaccacgcccgctacctgagctacttccgctggagggagaccctgcggcccaggagcttctcctgggccctggccttctgcaaggcctgctggaagctgcaggaggagagccgcagcggcggcctcatctacctgcggacccggctgcctgaggccagccctgcctag

SEQ ID NO: 152946 - DNA, 1080 bp, Artificial Sequence; identical to SEQ ID NO: 152943
  Description of Artificial Sequence: Synthetic coding sequence

SEQ ID NO: 152947 - DNA, 1080 bp, Artificial Sequence; identical to SEQ ID NO: 152943
  Description of Artificial Sequence: Synthetic coding sequence

SEQ ID NO: 152948 - DNA, 93 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttctag

SEQ ID NO: 152949 - DNA, 414 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttcttctcctacctgcgggtgtcccaggatgaccccaccgtgtaccccaacggcagccgcttcccagacagcacaggcaccccagcccacagcatccccctcatcctgctgtggacctggcccttcaacaagcccatcgccctgccccgctgcagcgagatggtgcctggaacagctgactgcaacatcacagctgacaggaaggtgtacccccaggctgatgctgtgattgtgcaccaccgggaggtgatgtacaaccccagcgcccagctgcccaggagcccccggcggcagggccagcgctggatctggttctccatggagtag

SEQ ID NO: 152950 - DNA, 210 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttcttctcctacctgcgggtgtcccaggatgaccccaccgtgtaccccaacggcagccgcttcccagacagcacaggcaccccagcccacagcatccccctcatcctgctgtggacctggtag

SEQ ID NO: 152951 - DNA, 201 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttcttctcctacctgcgggtgtcccaggatgaccccaccgtgtaccccaacggcagccgcttcccagacagcacaggcaccccagcccacagcatccccctcatcctgctgtag

SEQ ID NO: 152952 - DNA, 138 bp, Artificial Sequence
  Description of Artificial Sequence: Synthetic coding sequence
atggaccccctgggccctgccaagccccagtggagctggcgctgctgcctgaccaccctgctcttccagctgctgatggctgtgtgcttcttctcctacctgcgggtgtcccaggatgaccccaccgtgtacccctag

SEQ ID NO: 152953 - DNA, 1029 bp, Artificial Sequence
  Description of Artificial Sequence: Synthetic coding sequence
atgaacaatgccggccacggccccacccggcggctgcggggcctgggcgtgctggccggcgtggccctgctggccgccctgtggctgctgtggctgctgggcagcgccccccggggcaccccagccccccagcccaccatcaccatcctggtgtggcactggcccttcacagaccagcccccagagctgcccagcgacacctgcaccaggtatggaattgcccgctgccacctgagcgccaacagaagcctgctggccagcgcagatgctgtggtgttccaccaccgggagctgcagaccaggaggagccacctgcccctggcccagaggccccggggccagccctgggtgtgggcctccatggagagccccagccacacccacggcctgagccacctgcggggcatcttcaactgggtgctgagctaccgccgggacagcgacatctttgtgccctacggccgcctggagccccactggggccccagcccccccctgcctgccaagagccgggtggccgcctgggtggtgagcaacttccaggagcggcagctgcgggcccggctgtaccggcagctggccccccacctgcgggtggatgtgtttggccgggccaacggccggcccctgtgtgccagctgcctggtgcccaccgtggcccagtaccgcttctacctgagctttgagaacagccagcaccgggactacatcacagagaagttctggagaaatgccctggtggccggcaccgtgcctgtggtgctgggccccccccgggccacctatgaggcctttgtgcctgcagatgcctttgtgcacgtggatgactttggaagtgcccgggagctggccgccttcctgaccggcatgaatgaaagccgctaccagcgcttctttgcctggagggaccggctgcgggtgcggctcttcacagactggagggagcgcttctgtgccatctgtgaccgctacccccacctgcccaggagccaggtgtatgaggacctggagggctggttccaggcctag

SEQ ID NO: 152954 - DNA, 1728 bp, Artificial Sequence
  Description of Artificial Sequence: Synthetic coding sequence
atgaggccctggacaggctcctggcgctggatcatgctgatcctgtttgcctggggcaccctgctcttctacatcggcggccacctggtgcgggacaatgaccacccagaccacagcagccgggagctgagcaagatcctggccaagctggagcggctgaagcagcagaatgaagacctgcggaggatggccgagagcctgcgcatccctgagggccccatcgaccagggccctgccatcggccgggtgcgggtgctggaggagcagctggtgaaggccaaggagcagatcgagaactacaagaagcagaccagaaatggcctgggcaaggaccacgagatcctgcggaggagaattgaaaatggagccaaggagctgtggttcttcctgcagagcgagctgaagaagctgaagaacctggagggcaatgagctgcagagacatgctgatgagttcctgctggacctgggccaccacgagaggagcatcatgacagacctgtactacctgagccagacagatggagctggggactggagggagaaggaggccaaggacctgacagagctggtgcagaggcgcatcacctacctgcagaaccccaaggactgcagcaaggccaagaagctggtgtgcaacatcaacaagggctgcggctacggctgccagctgcaccacgtggtgtactgcttcatgattgcctacggcacccagaggaccctcatcctggagagccagaactggaggtatgccaccggcggctgggagaccgtcttccggcctgtgtctgagacctgcacagacaggagcggcatcagcacaggccactggagcggggaggtgaaggacaagaatgtgcaggtggtggagctgcccatcgtggacagcctgcaccccaggcctccctacctgcccctggccgtgcctgaggacctggccgaccggctggtgcgggtgcacggggaccctgctgtgtggtgggtgtcccagtttgtgaagtacctgatccggccccagccctggctggagaaggagattgaggaggccaccaagaagctgggcttcaagcaccctgtgattggagtgcacgtgagaagaacagacaaggtgggcacagaggccgccttccaccccatcgaggagtacatggtgcacgtggaggagcacttccagctgctggcccggaggatgcaggtggacaagaagagggtgtacctggccacagatgaccccagcctgctgaaggaggccaagaccaagtaccccaactatgagttcatcagtgacaacagcatctcctggagcgctggcctgcacaaccgctacacagagaacagcctgcggggcgtcatcctggacatccacttcctgagccaggccgacttcctggtgtgcaccttcagcagccaggtgtgccgggtggcctatgagatcatgcagaccctgcacccagatgccagcgccaacttccacagcctggatgacatctactactttggaggccagaatgcccacaaccagatcgccatctatgcccaccagcccaggacagcagatgagatccccatggagcccggggacatcattggagtggccggcaaccactgggatggctacagcaaaggagtgaacaggaagctgggccgcacaggcctgtaccccagctacaaggtgcgggagaagattgagaccgtgaagtaccccacctacccagaggccgagaagtag

SEQ ID NO: 152955 - DNA, 1728 bp, Artificial Sequence; identical to SEQ ID NO: 152954
  Description of Artificial Sequence: Synthetic coding sequence

SEQ ID NO: 152956 - DNA, 1728 bp, Artificial Sequence; identical to SEQ ID NO: 152954
  Description of Artificial Sequence: Synthetic coding sequence

SEQ ID NO: 152957 - DNA, 510 bp, Artificial Sequence
  Description of Artificial Sequence: Synthetic coding sequence
atgcaccggcagatctggcacctgcactggaccctggtgcgctaccccaactatgagttcatcagtgacaacagcatctcctggagcgctggcctgcacaaccgctacacagagaacagcctgcggggcgtcatcctggacatccacttcctgagccaggccgacttcctggtgtgcaccttcagcagccaggtgtgccgggtggcctatgagatcatgcagaccctgcacccagatgccagcgccaacttccacagcctggatgacatctactactttggaggccagaatgcccacaaccagatcgccatctatgcccaccagcccaggacagcagatgagatccccatggagcccggggacatcattggagtggccggcaaccactgggatggctacagcaaaggagtgaacaggaagctgggccgcacaggcctgtaccccagctacaaggtgcgggagaagattgagaccgtgaagtaccccacctacccagaggccgagaagtag

SEQ ID NO: 152958 - DNA, 48 bp, Artificial Sequence
  Description of Artificial Sequence: Synthetic coding sequence
atgaggccctggacaggctcctggcgctggatcatgctgatcctgtag

SEQ ID NO: 152959 - DNA, 135 bp, Artificial Sequence
  Description of Artificial Sequence: Synthetic coding sequence
atgaggccctggacaggctcctggcgctggatcatgctgatcctgtttgcctggggcaccctgctcttctacatcggcggccacctggtgcgggacaatgaccacccagaccacagcagccgggagctgtcctag

SEQ ID NO: 152960 - DNA, 141 bp, Artificial Sequence
  Description of Artificial Sequence: Synthetic coding sequence
atgaggccctggacaggctcctggcgctggatcatgctgatcctgtttgcctggggcaccctgctcttctacatcggcggccacctggtgcgggacaatgaccacccagaccacagcagccgggagctgagcaagatctag

SEQ ID NO: 152961 - DNA, 126 bp, Artificial Sequence
  Description of Artificial Sequence: Synthetic coding sequence
atgaggccctggacaggctcctggcgctggatcatgctgatcctgtttgcctggggcaccctgctcttctacatcggcggccacctggtgcgggacaatgaccacccagaccacagcagcaggtag

SEQ ID NO: 152962 - DNA, 93 bp, Artificial Sequence
  Description of Artificial Sequence: Synthetic coding sequence
atgaggccctggacaggctcctggcgctggatcatgctgatcctgtttgcctggggcaccctgctcttctacatcggcggccacctggtgtag

SEQ ID NO: 152963 - DNA, 1239 bp, Artificial Sequence
  Description of Artificial Sequence: Synthetic coding sequence
atgacagacctgtactacctgagccagacagatggagctggggactggagggagaaggaggccaaggacctgacagagctggtgcagaggcgcatcacctacctgcagaaccccaaggactgcagcaaggccaagaagctggtgtgcaacatcaacaagggctgcggctacggctgccagctgcaccacgtggtgtactgcttcatgattgcctacggcacccagaggaccctcatcctggagagccagaactggaggtatgccactggaggctgggagaccgtcttccggcctgtgtctgagacctgcacagacagaagtggcatcagcacaggccactggagcggggaggtgaaggacaagaatgtgcaggtggtggagctgcccatcgtggacagcctgcacccccggcccccctacctgcccctggccgtgcctgaggacctggccgaccggctggtgcgggtgcatggagaccctgctgtgtggtgggtgtcccagtttgtgaagtacctgatccggccccagccctggctggagaaggagattgaggaggccaccaagaagctgggcttcaagcaccctgtgattggagtgcacgtgcggaggacagacaaggtgggcacagaagctgccttccaccccatcgaggagtacatggtgcacgtggaggagcacttccagctgctggcccggaggatgcaggtggacaagaagagggtgtacctggccacagatgaccccagcctgctgaaggaggccaagaccaagtaccccaactatgagttcatcagtgacaacagcatctcctggagcgctggcctgcacaaccgctacacagagaacagcctgcggggcgtcatcctggacatccacttcctgagccaggccgacttcctggtgtgcaccttcagcagccaggtgtgccgggtggcctatgagatcatgcagaccctgcacccagatgccagcgccaacttccacagcctggatgacatctactactttggaggccagaatgcccacaaccagatcgccatctatgcccaccagcccaggacagcagatgagatccccatggagcccggggacatcatcggcgtggccggcaaccactgggatggctacagcaagggcgtgaacaggaagctgggccgcacaggcctgtaccccagctacaaggtgcgggagaagattgaaacagtgaagtaccccacctacccagaggccgagaagtag

SEQ ID NO: 152964 - DNA, 153 bp, Artificial Sequence
  Description of Artificial Sequence: Synthetic coding sequence
atgaggccctggacaggctcctggcgctggatcatgctgatcctgtttgcctggggcaccctgctcttctacatcggcggccacctggtgcgggacaatgaccacccagaccacagcagccgggagctgagcaagatcctggccaagctgtag

SEQ ID NO: 152965 - DNA, 1080 bp, Artificial Sequence
  Description of Artificial Sequence: Synthetic coding sequence
atgaccagcaccagcaagggcatcctgcggcccttcctgattgtgtgcatcatcctgggctgcttcatggcctgcctgctgatctacatcaagcccaccaacagctggatcttcagccccatggagagcgccagctctgtgctgaagatgaagaacttcttcagcaccaagacagactacttcaatgagaccaccatcctggtgtgggtgtggcccttcggccagacctttgacctgaccagctgccaggccatgttcaacatccagggctgccacctgaccacagacaggagcctgtacaacaagagccatgctgtgctgatccaccaccgggacatctcctgggacctgaccaacctgccccagcaggcccggccccccttccagaagtggatctggatgaacctggagagccccacccacaccccccagaagagcggcatcgagcacctgttcaacctgaccctgacctacagaagagacagcgacatccaggtgccctacggcttcctgactgtgtccaccaacccctttgtgtttgaggtgcccagcaaggagaagctggtgtgctgggtggtgagcaactggaaccctgagcacgcccgggtgaagtactacaatgagctgagcaagagcattgagatccacacctacggccaggccttcggggagtatgtgaatgacaagaacctgatccccaccatcagcacctgcaagttctacctgagctttgaaaattccatccacaaggactacatcacagagaagctgtacaatgccttcctggccggctctgtgcctgtggtgctgggccccagcagagaaaattatgagaactacatcccagctgacagcttcatccacgtggaggactacaacagccccagcgagctggccaagtacctgaaggaggtggacaagaacaacaagctgtacctgagctacttcaactggaggaaggacttcaccgtgaacctgccccgcttctgggagagccacgcctgcctggcctgtgaccacgtgaagaggcaccaggagtacaagtctgtgggcaacctggagaagtggttctggaactag

SEQ ID NO: 152966 - DNA, 660 bp, Artificial Sequence
  Description of Artificial Sequence: Synthetic coding sequence
atgaaccggctgtttgggaaggccaagcccaaggcccccccacccagcctgacagactgcattggaacagtggacagcagagctgagagcattgacaagaagatcagccggctggatgctgagctggtgaagtacaaggaccagatcaagaagatgagggagggccctgccaagaacatggtgaagcagaaggccctgcgggtgctgaagcagaagaggatgtatgagcagcagagggacaacctggcccagcagagcttcaacatggagcaggccaactacaccatccagagcctgaaggacaccaagaccaccgtggatgccatgaagctgggcgtgaaggagatgaagaaggcctacaagcaggtgaagattgaccagatcgaggacctgcaggaccagctggaggacatgatggaggatgccaatgagatccaggaggccctgagccgctcctatggcaccccagagctggatgaagatgacctggaggccgagctggatgccctgggagatgagctgctggctgatgaggacagcagctacctggatgaggccgccagcgccccagccatccctgagggcgtgcccacagacaccaagaacaaggatggagtgctggtggatgaatttggcctgccccagatcccagccagctag

SEQ ID NO: 152967 - DNA, 1293 bp, Artificial Sequence
  Description of Artificial Sequence: Synthetic coding sequence
atgagccgcatcaacaagaatgtggtgctggccctgctgaccctgaccagcagcgccttcctgctcttccagctgtactactacaagcactacctgagcaccaagaatggagctggcctgagcaagagcaagggcagccgcatcggctttgacagcacccagtggagggctgtgaagaagttcatcatgctgaccagcaaccagaatgtgcctgtgttcctgattgaccccctcatcctggagctgatcaacaagaactttgagcaggtgaagaacaccagccacggcagcaccagccagtgcaagttcttctgtgtgccccgggacttcaccgcctttgccctgcagtaccacctgtggaagaatgaggagggctggttcagaattgctgagaacatgggcttccagtgcctgaagattgagagcaaggacccccggctggatggcatcgacagcctgagcggcacagagatccccctgcactacatctgcaagctggccacccacgccatccacctggtggtgttccacgagaggagcggcaactacctgtggcacggccacctgcggctgaaggagcacatcgacaggaagtttgtgcccttcaggaagctgcagtttggccgctacccaggggcctttgacaggcctgagctgcagcaggtgacagtggatggcctggaggtgctgatccccaaggaccccatgcactttgtggaggaggtgccccacagccgcttcattgaatgtcgctacaaggaggcccgggccttcttccagcagtacctggatgacaacacagtggaggccgtggccttcaggaagagcgccaaggagctgctgcagctggccgccaagaccctgaacaagctgggcgtgcccttctggctgagcagcggcacctgcctgggctggtaccggcagtgcaacatcatcccctacagcaaggatgtggacctgggcatcttcatccaggactacaagagtgacatcatcctggccttccaggatgctggcctgcccctgaagcacaagtttgggaaggtggaggacagcctggagctgtccttccagggcaaggatgatgtgaagctggatgtgttcttcttctatgaggagacagaccacatgtggaatggaggcacccaggccaagacaggcaagaagttcaagtacctgttccccaagttcaccctgtgctggacagaatttgtggacatgaaggtgcacgtgccctgtgagaccctggagtacatcgaggccaactacggcaagaaccagcagggcgcctag

SEQ ID NO: 152968 - DNA, 708 bp, Artificial Sequence
  Description of Artificial Sequence: Synthetic coding sequence
atgatcctggaggtgggagaaaataatggcttcttcagcaagagcctgctgcccaggtatgccagcaagaagctgaagagcagcctgccccacagcagagctgtgaagaagttcatcatgctgaccagcaaccagaatgtgcctgtgttcctgattgaccccctcatcctggagctgatcaacaagaactttgagcaggtgaagaacaccagccacggcagcaccagccagtgcaagttcttctgtgtgccccgggacttcaccgcctttgccctgcagtaccacctgtggaagaatgaggagggctggttcagaattgctgagaacatgggcttccagtgcctgaagattgagagcaaggacccccggctggatggcatcgacagcctgtctggaacagagatccccctgcactacatctgcaagctggccacccacgccatccacctggtggtgttccacgagaggagcggcaactacctgtggcacggccacctgcggctgaaggagcacatcgacaggaagtttgtgcccttcaggaagctgcagtttggccgctacccaggggcctttgacaggcctgagctgcagcaggtgacagtggatggcctggaggtgctgatccccaaggaccccatgcactttgtggaggaggtgccccacagccgcttcatcgagtgccgctacaaggaggcccgggccttctag

SEQ ID NO: 152969 - DNA, 552 bp, Artificial Sequence
  Description of Artificial Sequence: Synthetic coding sequence
atgagccgcatcaacaagaatgtggtgctggccctgctgaccctgaccagcagcgccttcctgctcttccagctgtactactacaagcactacctgagcaccaagaatggagctggcctgagcaagagcaagggcagccgcatcggctttgacagcacccagtggagggctgtgaagaagttcatcatgctgaccagcaaccagaatgtgcctgtgttcctgattgaccccctcatcctggagctgatcaacaagaactttgagcaggtgaagaacaccagccacggcagcaccagccagtgcaagttcttctgtgtgccccgggacttcaccgcctttgccctgcagtaccacctgtggaagaatgaggagggctggttcagaattgctgagaacatgggcttccagtgcctgaagattgagagcaaggacccccggctggatggcatcgacagcctgagcggcacagagatccccctgcactacatctgcaagctggccacccacgccatccacctggtggtgttccacgagaggagcggcaactactag

SEQ ID NO: 152970 - DNA, 483 bp, Artificial Sequence
  Description of Artificial Sequence: Synthetic coding sequence
tgatggtaccggcagtgcaacatcatcccctacagcaaggatgtggacctgggcatcttcatccaggactacaagagtgacatcatcctggccttccaggatgctggcctgcccctgaagcacaagtttgggaaggtggaggacagcctggagctgtccttccagggcaaggatgatgtgaagctggatgtgttcttcttctatgaggagacagaccacatgtggaatggaggcacccaggccaagacaggcaagaagttcaagtacctgttccccaagttcaccctgtgctggacagaatttgtggacatgaaggtgcacgtgccctgtgagaccctggagtacatcgaggccaactacggcaaggaggccgagagctacatcctgtccatgctgttccgcaccaccttctggagcctggccgacttccccctgaccccagagaacaacagcagcctgaagaatggaaacctgaatgtgtag

SEQ ID NO: 152971 - DNA, 816 bp, Artificial Sequence
  Description of Artificial Sequence: Synthetic coding sequence
atgagccgcatcaacaagaatgtggtgctggccctgctgaccctgaccagcagcgccttcctgctcttccagctgtactactacaagcactacctgagcaccaagaatggagctggcctgagcaagagcaagggcagccgcatcggctttgacagcacccagtggagggctgtgaagaagttcatcatgctgaccagcaaccagaatgtgcctgtgttcctgattgaccccctcatcctggagctgatcaacaagaactttgagcaggtgaagaacaccagccacggcagcaccagccagtgcaagttcttctgtgtgccccgggacttcaccgcctttgccctgcagtaccacctgtggaagaatgaggagggctggttcagaattgctgagaacatgggcttccagtgcctgaagattgagagcaaggacccccggctggatggcatcgacagcctgagcggcacagagatccccctgcactacatctgcaagctggccacccacgccatccacctggtggtgttccacgagaggagcggcaactacctgtggcacggccacctgcggctgaaggagcacatcgacaggaagtttgtgcccttcaggaagctgcagtttggccgctacccaggggcctttgacaggcctgagctgcagcaggtgacagtggatggcctggaggtgctgatccccaaggaccccatgcactttgtggaggaggtgccccacagccgcttcattgaatgtcgctacaaggaggcccgggccttcttccagatccctgtgtctgaggtgtacacagtgctggactag

SEQ ID NO: 152972 - DNA, 1488 bp, Artificial Sequence
  Description of Artificial Sequence: Synthetic coding sequence
atgaggctgacccgctgccaggccgccctggccgccgccatcaccctgaacctgctggtgctcttctacgtgtcctggctgcagcaccagcccaggaacagccgggcccggggcccccggcgggccagcgctgctggcccccgggtgacagtgctggtgcgggagtttgaggcctttgacaatgctgtgcctgagctggtggacagcttcctgcagcaggaccctgcccagcctgtggtggtggccgctgacaccctgccctacccacccctggccctgccccgcatccccaacgtgcggctggccctgctgcagcctgccctggacaggcctgctgctgccagcaggcctgagacctacgtggccacagaatttgtggccctggtgcctgatggagcccgggcagaggcccctggcctgctggagaggatggtggaggccctgcgggccggcagcgcccggctggtggccgcccctgtggccacagccaacccagcccgctgcctggccctgaatgtgtccctgcgggagtggacagcccgctacggggccgccccagctgccccccgctgtgatgccctggatggagatgctgtggtgctgctgcgggcccgggacctcttcaacctgagcgcccccctggcccggcctgtgggcaccagcctcttcctgcagacagccctgcggggctgggccgtgcagctgctggacctgacctttgctgctgcccggcagccccccctggccacagcccacgcccgctggaaggccgagcgggagggccgggcccggcgggccgccctgctgcgggccctgggcatccggctggtgtcctgggagggcggccgcctggagtggtttggctgcaacaaggagaccacccgctgctttggaacagtggtgggggacaccccagcctacctgtatgaggagcgctggaccccaccctgctgcctgcgggccctgcgggagacagcccgctacgtggtgggcgtgctggaggccgccggcgtgcgctactggctggagggcggcagcctgctgggcgccgcccggcatggagacatcatcccctgggactatgatgtggacctgggcatctacctggaggatgtgggcaactgtgagcagctgcggggagctgaggccggctctgtggtggatgagcggggctttgtgtgggagaaggctgtggagggggacttcttccgggtgcagtacagcgagagcaaccacctgcacgtggacctgtggcccttctaccccagaaatggagtgatgaccaaggacacctggctggaccaccggcaggatgtggagttccctgagcacttcctgcagcccctggtgcccctgccctttgctggctttgtggcccaggcccccaacaactaccgccgcttcctggagctgaagtttggacctggggtgattgagaacccccagtaccccaacccagccctgctgagcctgaccggcagcggctag

SEQ ID NO: 152973 - DNA, 1488 bp, Artificial Sequence; identical to SEQ ID NO: 152972
  Description of Artificial Sequence: Synthetic coding sequence

SEQ ID NO: 152974 - DNA, 2385 bp, Artificial Sequence
  Description of Artificial Sequence: Synthetic coding sequence
atggagctgcggccctggctgctgtgggtggtggccgccaccggcaccctggtgctgctggccgcagatgcccagggccagaaggtgttcaccaacacctgggccgtgcgcatccctgggggccctgctgtggccaacagcgtggccaggaagcacggcttcctgaacctgggccagatctttggagactactaccacttctggcacagaggagtgaccaagaggagcctgagcccccaccggcccaggcacagccggctgcagcgggagccccaggtgcagtggctggagcagcaggtggccaagaggaggaccaagagagatgtgtaccaggagcccacagaccccaagttcccccagcagtggtacctgtctggagtgacccagagggacctgaatgtgaaggccgcctgggcccagggctacacaggccatggaattgtggtgtccatcctggatgatggcatcgagaagaaccacccagacctggccggcaactatgaccccggggccagctttgatgtgaatgaccaggaccctgacccccagccccgctacacccagatgaatgacaacagacatggcacccgctgtgccggggaggtggccgctgtggccaacaacggggtgtgtggggtgggcgtggcctacaatgccagaattggaggagtgaggatgctggatggagaggtgacagatgctgtggaggcccggagcctgggcctgaaccccaaccacatccacatctacagcgcctcctggggcccagaagatgatggcaagacagtggatggccctgcccggctggccgaggaggccttcttccggggcgtgtcccagggccggggcggcctgggcagcatctttgtgtgggccagcggaaatggaggccgggagcatgacagctgcaactgtgatggctacaccaacagcatctacaccctgagcatcagcagcgccacccagtttggaaatgtgccctggtacagcgaggcctgcagcagcaccctggccaccacctacagcagcggcaaccagaatgagaagcagatcgtgaccacagacctgcggcagaagtgcacagagagccacacaggcaccagcgccagcgcccccctggccgccggcatcatcgccctgaccctggaggccaacaagaacctgacctggagggacatgcagcacctggtggtgcagaccagcaagccagcccacctgaatgccaatgactgggccaccaacggggtgggcaggaaggtgagccacagctatggctacggcctgctggatgctggggccatggtggccctggcccagaactggaccaccgtggccccccagaggaagtgcatcatcgacatcctgacagagcccaaggacatcggcaagaggctggaggtgaggaagacagtgacagcctgcctgggggagcccaaccacatcacccggctggagcacgcccaggcccggctgaccctgagctacaacagaagaggagacctggccatccacctggtgagccccatgggcaccaggagcaccctgctggccgcccggccccatgactacagcgcagatggcttcaatgactgggccttcatgaccacccacagctgggatgaggaccccagcggggagtgggtgctggagattgagaacaccagcgaggccaacaactacggcaccctgaccaagttcaccctggtgctgtatggaacagcccctgagggcctgcctgtgcccccagagagcagcggctgcaagaccctgaccagcagccaggcctgtgtggtgtgtgaggagggcttcagcctgcaccagaagagctgtgtgcagcactgccccccaggctttgccccccaggtgctggacacccactacagcacagaaaatgatgtggagaccatccgggcctctgtgtgtgccccctgccacgccagctgtgccacctgccagggccctgccctgacagactgcctgagctgccccagccacgccagcctggaccctgtggagcagacctgcagccggcagagccagagcagccgggagagccccccccagcagcagcccccccggctgcccccagaggtggaggccggccagaggctgcgggccggcctgctgcccagccacctgcctgaggtggtggccggcctgagctgtgccttcatcgtgctggtgtttgtgacagtgttcctggtgctgcagctgcggagcggcttctccttccggggcgtgaaggtgtacaccatggaccggggcctcatctcctacaagggcctgcccccagaggcctggcaggaggagtgccccagcgacagtgaagaagatgagggccgcggggagaggacagccttcatcaaggaccagagcgccctgtag

SEQ ID NO: 152975 - DNA, 210 bp, Artificial Sequence
  Description of Artificial Sequence: Synthetic coding sequence
aagccagcccacctgaatgccaatgactgggccaccaatggagtgggcaggaaggtgagccacagctatggctacggcctgtggacccaggccccctggtggccctggcccagaattggcccccagtggccacccagcggcagcgccagcagcaccagcagccccagccccaagaccagcggaaatggcagccgctgtggccggccctag

SEQ ID NO: 152976 - DNA, 210 bp, Artificial Sequence
  Description of Artificial Sequence: Synthetic coding sequence
atggagctgcggccctggctgctgtgggtggtggccgccaccggcaccctggtgctgctggccgcagatgcccagggccagaaggtgttcaccaacacctgggccgtgcgcatccctgggggccctgctgtggccaacagcgtggccaggaagcacggcttcctgaacctgggccagatctttggagactactaccacttctggcactag

SEQ ID NO: 152977 - DNA, 1581 bp, Artificial Sequence
  Description of Artificial Sequence: Synthetic coding sequence
atggccagcaatgactacacccagcaggccacccagagctatggagcctaccccacccagcccggccagggctacagccagcagagcagccagccctacggccagcagagctacagcggctacagccagagcacagacaccagcggctacggccagagcagctacagcagctatggccagagccagaacacaggctacggcacccagagcaccccccagggctacggcagcactggaggctacggcagcagccagagcagccagagcagctatggccagcagagcagctacccaggctacggccagcagcctgcccccagcagcaccagcggcagctatggcagcagcagccagagcagcagctatggccagccccagagcggcagctacagccagcagcccagctatggaggccagcagcagagctatggccagcagcagagctacaaccccccccagggctacggccagcagaaccagtacaacagcagcagcggcggcggcggcggcggcggcggcggcggcaactacggccaggaccagagctccatgagcagcggcggcggcagcggcggcggctacggcaaccaggaccagagcggcggcggcggcagcggcggctacggccagcaggaccggggcggccggggccggggcggcagcggcggcggcggcggcggcggcggcggcggctacaacagaagcagcggcggctatgagccccggggccggggcggcggccggggcggccggggcggcatgggcggcagtgaccggggcggcttcaacaagtttggaggcccccgggaccagggcagcagacatgattctgagcaggacaacagcgacaacaacaccatctttgtgcagggcctgggggagaatgtgaccatcgagagcgtggccgactacttcaagcagatcggcatcatcaagaccaacaagaagacaggccagcccatgatcaacctgtacacagaccgggagaccgggaagctgaagggggaggccaccgtgtcctttgatgacccccccagcgccaaggccgccatcgactggtttgatggcaaggagttcagcggcaaccccatcaaggtgtcctttgccaccaggagagctgacttcaacagaggaggcggcaatggccggggcggccggggccggggcggccccatgggccggggcggctatggaggcggcggcagcggcggcggcggccggggcggcttccccagcggcggcggcggcggcggcggccagcagagagctggggactggaagtgccccaaccccacctgtgagaacatgaacttctcctggagaaatgaatgcaaccagtgcaaggcccccaagccagatggccctgggggcggccctgggggcagccacatgggcggcaactatggagatgaccggcggggcggccggggcggctatgaccggggcggctaccggggccggggcggggaccggggcggcttccggggcggccggggcggcggggaccggggcggcttcggccctgggaagatggacagcagaggagagcaccggcaggacagaagagagcggccctactag

SEQ ID NO: 152978 - DNA, 456 bp, Artificial Sequence
  Description of Artificial Sequence: Synthetic coding sequence
atgaaccctgaggtggtggaggtggccgtggaggccgaggtggcctgggccgaggtgacagtggtggccagcatcaacctggtggccctgggcaccaaggaccacgtgatgacccccaccaacaagaagacaggccagcccatgatcaacctgtacacagaccgggagaccgggaagctgaagggggaggccaccgtgtcctttgatgatcctccttctgccaaggccgccatcgactggtttgatggcaaggagttcagcggcaaccccatcaaggtgtcctttgccacccggcgggctgacttcaacagaggaggcggcaatggccggggcggccggggccggggcggccccatgggccggggcggctacggcggcggcggcagcggcggcggcggccggggcggcttccccagcggcggcggcggcggcggcggccagcagagagctggatag

SEQ ID NO: 152979 - DNA, 1290 bp, Artificial Sequence
  Description of Artificial Sequence: Synthetic coding sequence
atggccagcaatgactacacccagcaggccacccagagctatggagcctaccccacccagcccggccagggctacagccagcagagcagccagccctacggccagcagagctacagcggctacagccagagcacagacaccagcggctacggccagagcagctacagcagctatggccagagccagaacacaggctacggcacccagagcaccccccagggctacggcagcactggaggctacggcagcagccagagcagccagagcagctatggccagcagagcagctacccaggctacggccagcagcctgcccccagcagcaccagcggcagctatggcagcagcagccagagcagcagctatggccagccccagagcggcagctacagccagcagcccagctatggaggccagcagcagagctatggccagcagcagagctacaaccccccccagggctacggccagcagaaccagtacaacagcagcagcggcggctatgagccccggggccggggcggcggccggggcggccggggcggcatgggcggcagtgacagaggaggcttcaacaagtttggaggcccccgggaccagggcagcagacatgacagcgagcaggacaacagcgacaacaacaccatctttgtgcagggcctgggagaaaatgtgaccattgaatctgtggccgactacttcaagcagatcggcatcatcaagaccaacaagaagacaggccagcccatgatcaacctgtacacagaccgggagaccgggaagctgaagggggaggccaccgtgtcctttgatgatcctccttctgccaaggccgccatcgactggtttgatggcaaggagttcagcggcaaccccatcaaggtgtcctttgccacccggcgggctgacttcaacagaggaggcggcaatggccggggcggccggggccggggcggccccatgggccggggcggctacggcggcggcggcagcggcggcggcggccggggcggcttccccagcggcggcggcggcggcggcggccagcagagagctggggactggaagtgccccaaccccacctgtgagaacatgaacttctcctggagaaatgaatgcaaccagtgcaaggcccccaagccagatggccctgggggcggccctgggggcagccacatgggcggcaactatggagatgacagaagaggaggagacagaggaggctttggacctgggaagatggacagcagaggagagcaccggcaggaccggcgggagcggccctactag

SEQ ID NO: 152980 - DNA, 1257 bp, Artificial Sequence
  Description of Artificial Sequence: Synthetic coding sequence
atgggagaggagggcaccggcggcaccgtgcacctgctgtgcctggccgccagcagtggagtgcccctcttctgccgcagcagccggggcggggccccagcccggcagcagctgcccttctctgtgattggcagcctgaatggagtgcacatgtttggccagaacctggaggtgcagctgagcagcgccaggacagagaacaccaccgtggtgtggaagagcttccatgacagcatcaccctcatcgtgctgagcagcgaggtgggcatcagcgagctgcggctggagcggctgctgcagatggtgtttggagccatggtgctgctggtgggcctggaggagctgaccaacatcagaaatgtggagcggctgaagaaggacctgcgggccagctactgcctgattgacagcttcctgggggacagcgagctgattggagacctgacccagtgtgtggactgtgtgattcctcctgagggcagcctgctgcaggaggccctgagcggctttgctgaggccgccggcaccacctttgtgtccctggtggtgtctggccgggtggtggccgccacagagggctggtggaggctgggcaccccagaggccgtgctgctgccctggctggtgggcagcctgcccccccagacagcccgggactaccctgtgtacctgccccacggcagccccaccgtgccccaccggctgctgaccctgaccctgctgcccagcctggagctgtgcctgctgtgtggccccagcccccccctgagccagctgtacccccagctgctggagcgctggtggcagcccctgctggaccccctgcgggcctgcctgcccctgggcccccgggccctgcccagcggcttccccctgcacacagacatcctgggcctgctgctgctgcacctggagctgaagcgctgcctcttcaccgtggagcccctgggggacaaggagcccagccctgagcagaggcggcggctgctgaggaacttctacaccctggtgaccagcacccacttccccccagagcccggccccccagagaagacagaagatgaggtgtaccaggcccagctgccccgggcctgctacctggtgctgggcacagaggagcccggcaccggggtgcggctggtggccctgcagctgggcctgcggcggctgctgctgctgctgagcccccagagccccacccacggcctgcggagcctggccacccacaccctgcacgccctgacccccctgctgtag

SEQ ID NO: 152981 - DNA, 711 bp, Artificial Sequence
  Description of Artificial Sequence: Synthetic coding sequence
atgggagaggagggcaccggcggcaccgtgcacctgctgtgcctggccgccagcagtggagtgcccctcttctgccgcagcagccggggcggggccccagcccggcagcagctgcccttctctgtgattggcagcctgaatggagtgcacatgtttggccagaacctggaggtgcagctgagcagcgccaggacagagaacaccaccgtggtgtggaagagcttccatgacagcatcaccctcatcgtgctgagcagcgaggtgggcatcagcgagctgcggctggagcggctgctgcagatggtgtttggagccatggtgctgctggtgggcctggaggagctgaccaacatcagaaatgtggagcggctgaagaaggacctgcgggccagctactgcctgattgacagcttcctgggggacagcgagctgattggagacctgacccagtgtgtggactgtgtgattcctcctgagggcagcctgctgcaggtgctgggcatgctgtggaagctgctgcacctgttctgctggccctggctgagcccccaccccctgagcagcggccccctgagccagcccccacccatcctgagcgccagcagccccatccccacctggagccagaagaacctcttctccttcttcttctccttcctgagcctgtccttcctgttctccttcctgagcctcttcctgtttgagacctag

SEQ ID NO: 152982 - DNA, 1164 bp, Artificial Sequence
  Description of Artificial Sequence: Synthetic coding sequence
atgggagaggagggcaccggcggcaccgtgcacctgctgtgcctggccgccagcagtggagtgcccctcttctgccgcagcagccggggcggggccccagcccggcagcagctgcccttctctgtgattggcagcctgaatggagtgcacatgtttggccagaacctggaggtgcagctgagcagcgccaggacagagaacaccaccgtggtgtggaagagcttccatgacagcatcaccctcatcgtgctgagcagcgaggtgggcatcagcgagctgcggctggagcggctgctgcagatggtgtttggagccatggtgctgctggtgggcctggaggagctgaccaacatcagaaatgtggagcggctgaagaaggacctgcgggccagctactgcctgattgacagcttcctgggggacagcgagctgattggagacctgacccagtgtgtggactgtgtgattcctcctgagggcagcctgctgcaggaggccctgagcggctttgctgaggccgccggcaccacctttgtgtccctggtggtgtctggccgggtggtggccgccacagagggctggtggaggctgggcaccccagaggccgtgctgctgccctggctggtgggcagcctgcccccccagacagcccgggactaccctgtgtacctgccccacggcagccccaccgtgccccaccggctgctgaccctgaccctgctgcccagcctggagctgtgcctgctgtgtggccccagcccccccctgagccagctgtacccccagctgctggagcgctggtggcagcccctgctggaccccctgcgggcctgcctgcccctgggcccccgggccctgcccagcggcttccccctgcacacagacatcctgggcctgctgctgctgcacctggagctgaagcgctgcctcttcaccgtggagcccctgggggacaaggagcccagccctgagcagaggcggcggctgctgaggaacttctacaccctggtgaccagcacccacttccccccagagcccggccccccagagaagacagaagatgaggtgtaccaggcccagctgccccgggcctgctacctggtgatgggagatggccacagacatggagctgtgtctgtgtccctcttcatccgcagccagtag

SEQ ID NO: 152983 - DNA, 1149 bp, Artificial Sequence
  Description of Artificial Sequence: Synthetic coding sequence
atgggagaggagggcaccggcggcaccgtgcacctgctgtgcctggccgccagcagtggagtgcccctcttctgccgcagcagccggggcggggccccagcccggcagcagctgcccttctctgtgattggcagcctgaatggagtgcacatgtttggccagaacctggaggtgcagctgagcagcgccaggacagagaacaccaccgtggtgctgctggtgggcctggaggagctgaccaacatcagaaatgtggagcggctgaagaaggacctgcgggccagctactgcctgattgacagcttcctgggggacagcgagctgattggagacctgacccagtgtgtggactgtgtgattcctcctgagggcagcctgctgcaggaggccctgagcggctttgctgaggccgccggcaccacctttgtgtccctggtggtgtctggccgggtggtggccgccacagagggctggtggaggctgggcaccccagaggccgtgctgctgccctggctggtgggcagcctgcccccccagacagcccgggactaccctgtgtacctgccccacggcagccccaccgtgccccaccggctgctgaccctgaccctgctgcccagcctggagctgtgcctgctgtgtggccccagcccccccctgagccagctgtacccccagctgctggagcgctggtggcagcccctgctggaccccctgcgggcctgcctgcccctgggcccccgggccctgcccagcggcttccccctgcacacagacatcctgggcctgctgctgctgcacctggagctgaagcgctgcctcttcaccgtggagcccctgggggacaaggagcccagccctgagcagaggcggcggctgctgaggaacttctacaccctggtgaccagcacccacttccccccagagcccggccccccagagaagacagaagatgaggtgtaccaggcccagctgccccgggcctgctacctggtgctgggcacagaggagcccggcaccggggtgcggctggtggccctgcagctgggcctgcggcggctgctgctgctgctgagcccccagagccccacccacggcctgcggagcctggccacccacaccctgcacgccctgacccccctgctgtag

SEQ ID NO: 152984 - DNA, 279 bp, Artificial Sequence
  Description of Artificial Sequence: Synthetic coding sequence
atggccagcctgggccacatcctggtgttctgtgtgggcctgctgaccatggccaaggccgagagccccaaggagcatgaccccttcacctatgactaccagagcctgcagatcggcggcctggtgattgctggcatcctcttcatcctgggcatcctgattgtgctgagccgccgctgccgctgcaagttcaaccagcagcagaggactggagagccagatgaggaggagggcaccttccgcagcagcatccggcggctgagcaccaggagaagatag

SEQ ID NO: 152985 - DNA, 279 bp, Artificial Sequence; identical to SEQ ID NO: 152984
  Description of Artificial Sequence: Synthetic coding sequence

SEQ ID NO: 152986 - DNA, 195 bp, Artificial Sequence
  Description of Artificial Sequence: Synthetic coding sequence
atggaccgctggtacctgggcggcagccccaagggagatgtggaccccttctactatgactatgaaacagtgagaaatggaggcctcatctttgctggcctggccttcatcgtgggcctgctgatcctgctgagccgccgcttccgctgtggcggcaacaagaagaggcggcagatcaatgaagatgagccctag

SEQ ID NO: 152987 - DNA, 201 bp, Artificial Sequence
  Description of Artificial Sequence: Synthetic coding sequence
atgacaggcctgtccatggatggcggcggcagccccaagggagatgtggaccccttctactatgactatgaaacagtgagaaatggaggcctcatctttgctggcctggccttcatcgtgggcctgctgatcctgctgagccgccgcttccgctgtggcggcaacaagaagaggcggcagatcaatgaagatgagccctag

SEQ ID NO: 152988 - DNA, 195 bp, Artificial Sequence; identical to SEQ ID NO: 152986
  Description of Artificial Sequence: Synthetic coding sequence

SEQ ID NO: 152989 - DNA, 264 bp, Artificial Sequence
  Description of Artificial Sequence: Synthetic coding sequence
atgcagaaggtgaccctgggcctgctggtgttcctggccggcttccctgtgctggatgccaatgacctggaggacaagaacagccccttctactatgactggcacagcctgcaggtgggcggcctcatctgtgccggcgtgctgtgtgccatgggcatcatcatcgtgatgtctgccaagtgcaagtgcaagtttggccagaagagcggccaccaccctggagagaccccacccctcatcaccccaggcagcgcccagagctag

SEQ ID NO: 152990 - DNA, 342 bp, Artificial Sequence
  Description of Artificial Sequence: Synthetic coding sequence
atgcagaaggtgaccctgggcctgctggtgttcctggccggcttccctgtgctggatgccaatgacctggaggacaagaacagccccttctactatgactggcacagcctgcaggtgggcggcctcatctgtgccggcgtgctgtgtgccatgggcatcatcatcgtgatgtctgagtggaggagcagtggagagcaggccggccggggctggggcagcccccccctgaccacccagctgagccccactggagccaagtgcaagtgcaagtttggccagaagagcggccaccaccctggagagaccccacccctcatcaccccaggcagcgcccagagctag

SEQ ID NO: 152991 - DNA, 291 bp, Artificial Sequence
  Description of Artificial Sequence: Synthetic coding sequence
atgcagaaggtgaccctgggcctgctggtgttcctggccggcttccctgtgctggatgccaatgacctggaggacaagaacagccccttctactatgactggcacagcctgcaggtgggcggcctcatctgtgccggcgtgctgtgtgccatgggcatcatcatcgtgatgtctgagtggaggagcagtggagagcaggccggccggggctggggcagcccccccctgaccacccagctgagccccactggagccaagtgcaagtgcaagtttggccagaagtctggatag

SEQ ID NO: 152992 - DNA, 264 bp, Artificial Sequence; identical to SEQ ID NO: 152989
  Description of Artificial Sequence: Synthetic coding sequence

SEQ ID NO: 152993 - DNA, 435 bp, Artificial Sequence
  Description of Artificial Sequence: Synthetic coding sequence
atgggccggggctacagcggggccctgcaggcccggggcggcctggaggagcccctggagcggggcctgcggggccccagcttcacccagagccccctgcacggggctgctgctgcctacctgagcgcccagagagatgccagcctgcctgtgcccggccagaggagtgacatgcagaaggtgaccctgggcctgctggtgttcctggccggcttccctgtgctggatgccaatgacctggaggacaagaacagccccttctactatgactggcacagcctgcaggtgggcggcctcatctgtgccggcgtgctgtgtgccatgggcatcatcatcgtgatgtctgccaagtgcaagtgcaagtttggccagaagagcggccaccaccctggagagaccccacccctcatcaccccaggcagcgcccagagctag

SEQ ID NO: 152994 - DNA, 186 bp, Artificial Sequence
  Description of Artificial Sequence: Synthetic coding sequence
atgcagaaggtgaccctgggcctgctggtgttcctggccggcttccctgtgctggatgccaatgacctggaggacaagaacagccccttctactacggggagagcccctgccccctgagccccccccacaaccccacctactgcctggtgccccgggtgcccatccagggctggggcctgacctag

SEQ ID NO: 152995 - DNA, 435 bp, Artificial Sequence; identical to SEQ ID NO: 152993
  Description of Artificial Sequence: Synthetic coding sequence

SEQ ID NO: 152996 - DNA, 288 bp, Artificial Sequence
  Description of Artificial Sequence: Synthetic coding sequence
atggagctggtgctggtgttcctgtgcagcctgctggcccccatggtgctggccagcgctgctgagaaggagaaggagatggaccccttccactatgactaccagaccctgagaattggaggcctggtgtttgctgtggtgctcttctctgtgggcatcctgctgatcctgagccgccgctgcaagtgcagcttcaaccagaagccccgggcccctggagatgaggaggcccaggtggagaacctgatcacagccaatgccacagagccccagaaggccgagaactag

SEQ ID NO: 152997 - DNA, 288 bp, Artificial Sequence; identical to SEQ ID NO: 152996
  Description of Artificial Sequence: Synthetic coding sequence

SEQ ID NO: 152998 - DNA, 288 bp, Artificial Sequence; identical to SEQ ID NO: 152996
  Description of Artificial Sequence: Synthetic coding sequence

SEQ ID NO: 152999 - DNA, 288 bp, Artificial Sequence; identical to SEQ ID NO: 152996
  Description of Artificial Sequence: Synthetic coding sequence

SEQ ID NO: 153000 - DNA, 288 bp, Artificial Sequence; identical to SEQ ID NO: 152996
  Description of Artificial Sequence: Synthetic coding sequence

SEQ ID NO: 153001 - DNA, 288 bp, Artificial Sequence; identical to SEQ ID NO: 152996
  Description of Artificial Sequence: Synthetic coding sequence

SEQ ID NO: 153002 - DNA, 243 bp, Artificial Sequence
  Description of Artificial Sequence: Synthetic coding sequence
atggccacccccacccagacccccaccaaggcccctgaggagccagaccccttctactatgactacaacacagtgcagacagtgggcatgaccctggccaccatcctcttcctgctgggcatcctgattgtcatcagcaagaaggtgaagtgcaggaaggctgacagccgctctgagagccccacctgcaagagctgcaagtctgagctgcccagcagcgcccctgggggcggcggcgtgtag

SEQ ID NO: 153003 - DNA, 402 bp, Artificial Sequence
  Description of Artificial Sequence: Synthetic coding sequence
atggtgtctgtgggctttggagaccgggccggcctgggcagcagctgccgctgcagccagatcaccccagacatggccagcgctgtggccaccaggtatgtgctgggccactggccccgggaccacatctgtggctgcggcagccaccagctgagctcctggagggctgagccagatggaggagtgggcatgccccacaccctgtctgagcccccatctggcctgaccggcatctgggccggggccctggtgtccccagagaagcagatgaaggagaacctgcggagcaatgattctgagccccggctgcccggctttgagagctgcctgatccacagcctggccgtgtggccctgggccagcaactttgccagcctgggccccagcgtgaacaagggctag

SEQ ID NO: 153004 - DNA, 882 bp, Artificial Sequence
  Description of Artificial Sequence: Synthetic coding sequence
atgtacttcctgacccccatcctggtggccatcctgtgcatcctggtggtgtggatcttcaagaatgctgaccgctccatggagaagaagaagggggagcccaggaccagggctgaggcccggccctgggtggatgaggacctgaaggacagcagtgacctgcaccaggccgaggaggatgctgatgagtggcaggagagtgaagaaaatgtggagcacatccccttcagccacaaccactacccagagaaggagatggtgaagaggagccaggagttctatgagctgctgaacaagagaagatctgtgcgcttcatcagcaatgagcaggtgcccatggaggtgattgacaacgtcatcagaacagctggaacagcccccagcggggcccacacagagccctggacctttgtggtggtgaaggaccctgatgtgaagcacaagatcaggaagatcatcgaggaggaggaggagatcaactacatgaagaggatgggccaccgctgggtgacagacctgaagaagctgcggaccaactggatcaaggagtacctggacacagcccccatcctgatcctgatcttcaagcaggtgcacggctttgctgccaacgggaagaagaaggtgcactactacaatgagatctctgtgtccatcgcctgtggcatcctgctggccgccctgcaggtgaacaacggcatcaccatgaggcaccagacagcccggcaccgccacctgattgagggccctggccgcagcagcgaggcctgcagcaagctgagcagccagggctgcccagaatgtcgcagcggggactgccactaccacagcagccagctgtggcccagcacagagggcgcccctggcccccccaggacatag

SEQ ID NO: 153005 - DNA, 1458 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaggagtggtactttgggaagctgggcaggaaggatgctgagcggcagctgctgagctttggaaacccccggggcaccttcctgatccgggagagcgagaccaccaagggggcctacagcctgagcatccgggactgggatgacatgaagggggaccacgtgaagcactacaagatcaggaagctggacaatggaggctactacatcaccacccgggcccagtttgagaccctgcagcagctggtgcagcactacagcgagaaggcagatggcctgtgcttcaacctgaccgtcatcgccagcagctgcaccccccagaccagcggcctggccaaggatgcctgggaggtggcccggcgcagcctgtgcctggagaagaagctgggccagggctgctttgctgaggtgtggctgggcacctggaatggaaacaccaaggtggccatcaagaccctgaagccaggcaccatgagccctgagagcttcctggaggaggcccagatcatgaagaagctgaagcatgacaagctggtgcagctgtatgctgtggtgtctgaggagcccatctacatcgtgacagagtacatgaacaagggcagcctgctggacttcctgaaggatggagagggccgggccctgaagctgcccaacctggtggacatggccgcccaggtggccgccggcatggcctacattgaaagaatgaactacatccaccgggacctgcggagcgccaacatcctggtgggcaatggcctcatctgcaagattgctgactttggcctggcccggctgattgaggacaatgagtacacagcccggcagggcgccaagttccccatcaagtggacagcccctgaggccgccctgtatggccgcttcaccatcaagagtgatgtgtggagctttggcatcctgctgacagagctggtgaccaagggccgggtgccctacccaggcatgaacaaccgggaggtgctggagcaggtggagcggggctacaggatgccctgcccccaggactgccccatcagcctgcacgagctgatgatccactgctggaagaaggaccctgaggagcggcccacctttgagtacctgcagagcttcctggaggactacttcaccgccacagagccccagtaccagcctggagagaacctgtag

SEQ ID NO: 153006 - DNA, 1614 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagctgggcaggaaggatgctgagcggcagctgctgagctttggaaacccccggggcaccttcctgatccgggagagcgagaccaccaagggggcctacagcctgagcatccgggactgggatgacatgaagggggaccacgtgaagcactacaagatcaggaagctggacaatggaggctactacatcaccacccgggcccagtttgagaccctgcagcagctggtgcagcactacagcgagagagctgctggcctgtgctgccgcctggtggtgccctgccacaagggcatgccccggctgacagacctgtctgtgaagaccaaggatgtgtgggagatcccccgggagagcctgcagctgatcaagaggctgggcaatggccagtttggagaggtgtggatgggcacctggaatggaaacaccaaggtggccatcaagaccctgaagccaggcaccatgagccctgagagcttcctggaggaggcccagatcatgaagaagctgaagcatgacaagctggtgcagctgtatgctgtggtgtctgaggagcccatctacatcgtgacagagtacatgaacaagggcagcctgctggacttcctgaaggatggagagggccgggccctgaagctgcccaacctggtggacatggccgcccaggtggccgccggcatggcctacattgaaagaatgaactacatccaccgggacctgcggagcgccaacatcctggtgggcaatggcctcatctgcaagattgctgactttggcctggcccggctgattgaggacaatgagtacacagcccggcagggcgccaagttccccatcaagtggacagcccctgaggccgccctgtatggccgcttcaccatcaagagtgatgtgtggagctttggcatcctgctgacagagctggtgaccaagggccgggtgccctacccaggcatgaacaaccgggaggtgctggagcaggtggagcggggctacaggatgccctgcccccaggactgccccatcagcctgcacgagctgatgatccactgctggaagaaggaccctgaggagcggcccacctttgagtacctgcagagcttcctggaggactacttcaccgccacagagccccagtaccagcctggagagaacctgtag

SEQ ID NO: 153007 - DNA, 1449 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagctgggcaggaaggatgctgagcggcagctgctgagctttggaaacccccggggcaccttcctgatccgggagagcgagaccaccaagggggcctacagcctgagcatccgggactgggatgacatgaagggggaccacgtgaagcactacaagatcaggaagctggacaatggaggctactacatcaccacccgggcccagtttgagaccctgcagcagctggtgcagcactacagcggcacctggaatggaaacaccaaggtggccatcaagaccctgaagccaggcaccatgagccctgagagcttcctggaggaggcccagatcatgaagaagctgaagcatgacaagctggtgcagctgtatgctgtggtgtctgaggagcccatctacatcgtgacagagtacatgaacaagggcagcctgctggacttcctgaaggatggagagggccgggccctgaagctgcccaacctggtggacatggccgcccaggtggccgccggcatggcctacatcgagaggatgaactacatccaccgggacctgcggagcgccaacatcctggtgggcaatggcctcatctgcaagattgctgactttggcctggcccggctgattgaagataatgagtacacagcccggcagggcgccaagttccccatcaagtggacagcccctgaggccgccctgtatggccgcttcaccatcaagagtgatgtgtggagctttggcatcctgctgacagagctggtgaccaagggccgggtgccctacccaggcatgaacaaccgggaggtgctggagcaggtggagcggggctacaggatgccctgcccccaggactgccccatcagcctgcacgagctgatgatccactgctggaagaaggaccctgaggagcggcccacctttgagtacctgcagagcttcctggaggactacttcaccgccacagagccccagtaccagcccggggagaacctgtag

SEQ ID NO: 153008 - DNA, 1614 bp, Artificial Sequence; identical to SEQ ID NO: 153006
  Description of Artificial Sequence: Synthetic coding sequence

SEQ ID NO: 153009 - DNA, 1605 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagctgggcaggaaggatgctgagcggcagctgctgagctttggaaacccccggggcaccttcctgatccgggagagcgagaccaccaagggggcctacagcctgagcatccgggactgggatgacatgaagggggaccacgtgaagcactacaagatcaggaagctggacaatggaggctactacatcaccacccgggcccagtttgagaccctgcagcagctggtgcagcactacagcgagaaggcagatggcctgtgcttcaacctgactgtgattgccagcagctgcaccccccagaccagcggcctggccaaggatgcctgggaggtggcccggcgcagcctgtgcctggagaagaagctgggccagggctgctttgctgaggtgtggctgggcacctggaatggaaacaccaaggtggccatcaagaccctgaagccaggcaccatgagccctgagagcttcctggaggaggcccagatcatgaagaagctgaagcatgacaagctggtgcagctgtatgctgtggtgtctgaggagcccatctacatcgtgacagagtacatgaacaagggcagcctgctggacttcctgaaggatggagagggccgggccctgaagctgcccaacctggtggacatggccgcccaggtggccgccggcatggcctacatcgagaggatgaactacatccaccgggacctgcggagcgccaacatcctggtgggcaatggcctcatctgcaagattgctgactttggcctggcccggctgattgaagataatgagtacacagcccggcagggcgccaagttccccatcaagtggacagcccctgaggccgccctgtatggccgcttcaccatcaagagtgatgtgtggagctttggcatcctgctgacagagctggtgaccaagggccgggtgccctacccaggcatgaacaaccgggaggtgctggagcaggtggagcggggctacaggatgccctgcccccaggactgccccatcagcctgcacgagctgatgatccactgctggaagaaggaccctgaggagcggcccacctttgagtacctgcagagcttcctggaggactacttcaccgccacagagccccagtaccagcccggggagaacctgtag

SEQ ID NO: 153010 - DNA, 1605 bp, Artificial Sequence; identical to SEQ ID NO: 153009
  Description of Artificial Sequence: Synthetic coding sequence

SEQ ID NO: 153011 - DNA, 363 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtggtag

SEQ ID NO: 153012 - DNA, 699 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagctgggcaggaaggatgctgagcggcagctgctgagctttggaaacccccggggcaccttcctgatccgggagagcgagaccaccaagggggcctacagcctgagcatccgggactgggatgacatgaagggggaccacgtgaagcactacaagatcaggaagctggacaatggaggctactacatcaccacccgggcccagtttgagaccctgcagcagctggtgcagcactacagctag

SEQ ID NO: 153013 - DNA, 321 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggctag

SEQ ID NO: 153014 - DNA, 198 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggatag

SEQ ID NO: 153015 - DNA, 528 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagctgggcaggaaggatgctgagcggcagctgctgagctttggaaacccccggggcaccttcctgatctag

SEQ ID NO: 153016 - DNA, 462 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagtag

SEQ ID NO: 153017 - DNA, 357 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactag

SEQ ID NO: 153018 - DNA, 561 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttgggaagctgggcaggaaggatgctgagcggcagctgctgagctttggaaacccccggggcaccttcctgatccgggagagcgagaccaccaagggggcctacagctag

SEQ ID NO: 153019 - DNA, 312 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttctag

SEQ ID NO: 153020 - DNA, 459 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccaggccgaggagtggtactttggatag

SEQ ID NO: 153021 - DNA, 351 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagtag

SEQ ID NO: 153022 - DNA, 423 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggccccctag

SEQ ID NO: 153023 - DNA, 438 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggccaggacagaagatgacctgtccttccacaagggggagaagttccagatcctgaacagcagcgagggggactggtgggaggcccggagcctgaccactggagagaccggctacatccccagcaactacgtggcccctgtggacagcatccagtag

SEQ ID NO: 153024 - DNA, 1605 bp, Artificial Sequence; identical to SEQ ID NO: 153009
  Description of Artificial Sequence: Synthetic coding sequence

SEQ ID NO: 153025 - DNA, 1458 bp, Artificial Sequence
  Description of Artificial Sequence: Synthetic coding sequence
atgggctgtgtgcagtgcaaggacaaggaggccaccaagctgacagaggagagagatggcagcctgaaccagagcagcggctaccgctatggaacagaccccaccccccagcactaccccagctttggagtgaccagcatccccaactacaacaacttccacgccgccggcggccagggcctgactgtgtttggaggagtgaacagcagcagccacacaggcaccctgcggacccggggcggcaccggggtgaccctgtttgtggccctgtatgactatgaggcccaggccgaggagtggtactttgggaagctgggcaggaaggatgctgagcggcagctgctgagctttggaaacccccggggcaccttcctgatccgggagagcgagaccaccaagggggcctacagcctgagcatccgggactgggatgacatgaagggggaccacgtgaagcactacaagatcaggaagctggacaatggaggctactacatcaccacccgggcccagtttgagaccctgcagcagctggtgcagcactacagcgagaaggcagatggcctgtgcttcaacctgaccgtcatcgccagcagctgcaccccccagaccagcggcctggccaaggatgcctgggaggtggcccggcgcagcctgtgcctggagaagaagctgggccagggctgctttgctgaggtgtggctgggcacctggaatggaaacaccaaggtggccatcaagaccctgaagccaggcaccatgagccctgagagcttcctggaggaggcccagatcatgaagaagctgaagcatgacaagctggtgcagctgtatgctgtggtgtctgaggagcccatctacatcgtgacagagtacatgaacaagggcagcctgctggacttcctgaaggatggagagggccgggccctgaagctgcccaacctggtggacatggccgcccaggtggccgccggcatggcctacattgaaagaatgaactacatccaccgggacctgcggagcgccaacatcctggtgggcaatggcctcatctgcaagattgctgactttggcctggcccggctgattgaggacaatgagtacacagcccggcagggcgccaagttccccatcaagtggacagcccctgaggccgccctgtatggccgcttcaccatcaagagtgatgtgtggagctttggcatcctgctgacagagctggtgaccaagggccgggtgccctacccaggcatgaacaaccgggaggtgctggagcaggtggagcggggctacaggatgccctgcccccaggactgccccatcagcctgcacgagctgatgatccactgctggaagaaggaccctgaggagcggcccacctttgagtacctgcagagcttcctggaggactacttcaccgccacagagccccagtaccagcctggagagaacctgtag

SEQ ID NO: 153026 - DNA, 4437 bp, Artificial Sequence
  Description of Artificial Sequence: Synthetic coding sequence
atggccagcaccaatgctgagagccagctgcagaggatcatccgggacctgcaggatgctgtgacagagctgagcaaggagttccaggaggccggggagcccatcacagatgacagcaccagcctgcacaagttctcctacaagctggagtacctgctgcagtttgaccagaaggagaaggccaccctgctgggcaacaagaaggactactgggactacttctgtgcctgcctggccaaggtgaagggggccaatgatggcatccgctttgtgaagagcatcagcgagctgcggaccagcctgggcaagggccgggccttcatccgctacagcctggtgcaccagaggctggccgacaccctgcagcagtgcttcatgaacaccaaggtgaccagtgactggtactatgcccggagccccttcctgcagcccaagctgagcagtgacatcgtgggccagctgtatgagctgacagaggtgcagtttgacctggccagccggggctttgacctggatgctgcctggcccacctttgcccggaggaccctgaccaccggcagcagcgcctacctgtggaagccacccagccgcagcagctccatgagcagcctggtgtcctcctacctgcagacccaggagatggtgagcaactttgacctgaacagccccctgaacaatgaggccctggagggctttgatgagatgaggctggagctggaccagctggaggtgcgggagaagcagctgcgggagaggatgcagcagctggaccgggagaaccaggagctgcgggctgctgtgtcccagcagggcgagcagctgcagacagagcgggagcggggccgcacagctgctgaggacaacgtgcggctgacctgcctggtggccgagctgcagaagcagtgggaggtgacccaggccacccagaacacagtgaaggagctgcagacctgcctgcagggcctggagctgggcgctgctgagaaggaggaggactaccacacagccctgcggcggctggagagcatgctgcagcccctggcccaggagctggaggccacccgggacagcctggacaagaagaaccagcacctggccagcttccctggctggctggccatggcccagcagaaggctgacacagccagtgacaccaagggccggcaggagcccatccccagtgatgctgcccaggagatgcaggagctgggggagaagctgcaggccctggagcgggagaggaccaaggtggaggaggtgaaccggcagcagagcgcccagctggagcagctggtgaaggagctgcagctgaaggaggatgcccgggccagcctggagcggctggtgaaggagatggcccccctgcaggaggagctgagcggcaagggccaggaggccgaccagctgtggaggcggctgcaggagctgctggcccacaccagctcctgggaggaggagctggccgagctgcggcgggagaagaagcagcagcaggaggagaaggagctgctggagcaggaggtgcgcagcctgacccggcagctgcagttcctggagacccagctggcccaggtgtcccagcacgtgtctgacctggaggagcagaagaagcagctgatccaggacaaggaccacctgagccagcaggtgggcatgctggagcggctggccggccccccaggccctgagctgcctgtggccggggagaagaatgaggccctggtgcctgtgaacagcagcctgcaggaggcctggggcaagccagaggaggagcagaggggcctgcaggaggcccagctggatgacaccaaggtgcaggagggcagccaggaggaggagctgcggcaggccaaccgggagctggagaaggagctgcagaatgtggtgggcaggaaccagctgctggagggcaagctgcaggccctgcaggccgactaccaggccctgcagcagcgggagagcgccatccagggcagcctggccagcctggaggccgagcaggccagcatccgccacctgggggaccagatggaggccagcctgctggccgtgaggaaggccaaggaggccatgaaggcccagatggccgagaaggaggccatcctgcagagcaaggagggggagtgccagcagctgcgggaggaggtggagcagtgccagcagctggccgaggcccggcaccgggagctgcgggccctggagagccagtgccagcagcagacccagctgattgaggtgctgacagctgagaagggccagcagggcgtgggccccccaacagacaatgaggcccgggagctggccgcccagctggccctgagccaggcccagctggaggtgcaccagggcgaggtgcagaggctgcaggcccaggtggtggacctgcaggccaagatgagagctgccctggatgaccaggacaaggtgcagagccagctgtccatggccgaggccgtgctgcgggagcacaagaccctggtgcagcagctgaaggagcagaatgaggccctgaacagagcccacgtgcaggagctgctgcagtgcagcgagcgggagggcgccctgcaggaggagcgggcagatgaggcccagcagcgggaggaggagctgcgggccctgcaggaggagctgagccaggccaagtgcagcagcgaggaggcccagctggagcacgccgagctgcaggagcagctgcaccgggccaacacagacacagctgagctgggcatccaggtgtgtgccctgactgtggagaaggagcgggtggaggaggccctggcctgtgctgtgcaggagctgcaggatgccaaggaggccgccagccgggagcgggagggcctggagcggcaggtggccggcctgcagcaggagaaggagagcctgcaggagaagctgaaggccgccaaggctgctgctggcagcctgcccggcctgcaggcccagctggcccaggccgagcagagggcccagagcctgcaggaggccgcccaccaggagctgaacaccctgaagttccagctgtctgctgagatcatggactaccagagccggctgaagaatgctggggaggagtgcaagagcctgcggggccagctggaggagcagggccggcagctgcaggccgctgaggaggccgtggagaagctgaaggccacccaggccgacatgggagagaagctgagctgcaccagcaaccacctggccgagtgccaggccgccatgctgaggaaggacaaggagggcgccgccctgcgggaggacctggagaggacccagaaggagctggagaaggccaccaccaagatccaggagtactacaacaagctgtgccaggaggtgaccaaccgggagagaaatgaccagaagatgctggccgacctggatgacctgaacagaaccaagaagtacctggaggagcggctcatcgagctgctgcgggacaaggatgccctgtggcagaagagtgatgccctggagttccagcagaagctgtctgctgaggagcgctggctgggggacacagaggccaaccactgcctggactgcaagcgggagttctcctggatggtgagaagacaccactgccgcatctgtggccgcatcttctgctactactgctgcaacaactacgtgctgagcaagcatggaggcaagaaggagcgctgctgccgggcctgcttccagaagctgtctgagggccctggcagcccagacagcagcggcagcggcaccagccagggcgagcccagccctgccctgagccctgccagccctggcccccaggccactggaggccagggcgccaacacagactaccggcccccagatgatgctgtgtttgacatcatcacagatgaggagctgtgccagatccaggagagcggcagcagcctgcctgagacccccacagaaacagacagcctggaccccaatgctgctgagcaggacaccaccagcaccagcctgaccccagaggacacagaggacatgcctgtgggccaggacagcgagatctgcctgctgaagtctggagagctgatgatcaaggtgcccctgactgtggatgaaattgccagctttggagagggcagccgggagctgtttgtgcgcagcagcacctacagcctcatccccatcaccgtggccgaggccggcctgaccatctcctgggtgttcagcagtgaccccaagagcatctccttctctgtggtgttccaggaggccgaggacacccccctggaccagtgcaaggtgctgatccccaccacccgctgcaacagccacaaggagaacatccagggccagctgaaggtgaggaccccaggcatctacatgctgatctttgacaacaccttcagcagatttgtgtccaagaaggtgttctaccacctgactgtggacaggcctgtgatctatgatggcagtgacttcctgtag

SEQ ID NO: 153027 - DNA, 804 bp, Artificial Sequence
  Description of Artificial Sequence: Synthetic coding sequence
tgaagcaagcacggcggcaagaaggagcgctgctgccgggcctgcttccagaagctgtctgagggccctggcagcccagacagcagcggcagcggcaccagccagggcgagcccagccctgccctgagccctgccagccctggcccccaggccaccggcggccagggcgccaacacagactacagacctccagatgatgctgtgtttgacatcatcacagatgaggagctgtgccagatccaggagagcggcagcagcctgcctgagacccccacagaaacagacagcctggaccccaatgctgctgagcaggacaccaccagcaccagcctgaccccagaggacacagaggacatgcctgtgggccaggacagcgagatctgcctgctgaagagcggggagctgatgatcaaggtgcccctgactgtggatgagatcgccagctttggagagggcagccgggagctgtttgtgcgcagcagcacctacagcctcatccccatcaccgtggccgaggccggcctgaccatctcctgggtgttcagcagtgaccccaagagcatctccttctctgtggtgttccaggaggccgaggacacccccctggaccagtgcaaggtgctgatccccaccacccgctgcaacagccacaaggagaacatccagggccagctgaaggtgaggaccccaggcatctacatgctgatctttgacaacaccttcagcagatttgtgtccaagaaggtgttctaccacctgactgtggacaggcctgtgatctatgatggcagtgacttcctgtag

SEQ ID NO: 153028 - DNA, 4497 bp, Artificial Sequence
  Description of Artificial Sequence: Synthetic coding sequence
atggccagcaccaatgctgagagccagctgcagaggatcatccgggacctgcaggatgctgtgacagagctgagcaaggagttccaggaggccggggagcccatcacagatgacagcaccagcctgcacaagttctcctacaagctggagtacctgctgcagtttgaccagaaggagaaggccaccctgctgggcaacaagaaggactactgggactacttctgtgcctgcctggccaaggtgaagggggccaatgatggcatccgctttgtgaagagcatcagcgagctgcggaccagcctgggcaagggccgggccttcatccgctacagcctggtgcaccagaggctggccgacaccctgcagcagtgcttcatgaacaccaaggtgaccagtgactggtactatgcccggagccccttcctgcagcccaagctgagcagtgacatcgtgggccagctgtatgagctgacagaggtgcagtttgacctggccagccggggctttgacctggatgctgcctggcccacctttgcccggaggaccctgaccaccggcagcagcgcctacctgtggaagccacccagccgcagcagctccatgagcagcctggtgtcctcctacctgcagacccaggagatggtgagcaactttgacctgaacagccccctgaacaatgaggccctggagggctttgatgagatgaggctggagctggaccagctggaggtgcgggagaagcagctgcgggagaggatgcagcagctggaccgggagaaccaggagctgcgggctgctgtgtcccagcagggcgagcagctgcagacagagcgggagcggggccgcacagctgctgaggacaacgtgcggctgacctgcctggtggccgagctgcagaagcagtgggaggtgacccaggccacccagaacacagtgaaggagctgcagacctgcctgcagggcctggagctgggcgctgctgagaaggaggaggactaccacacagccctgcggcggctggagagcatgctgcagcccctggcccaggagctggaggccacccgggacagcctggacaagaagaaccagcacctggccagcttccctggctggctggccatggcccagcagaaggctgacacagccagtgacaccaagggccggcaggagcccatccccagtgatgctgcccaggagatgcaggagctgggggagaagctgcaggccctggagcgggagaggaccaaggtggaggaggtgaaccggcagcagagcgcccagctggagcagctggtgaaggagctgcagctgaaggaggatgcccgggccagcctggagcggctggtgaaggagatggcccccctgcaggaggagctgagcggcaagggccaggaggccgaccagctgtggaggcggctgcaggagctgctggcccacaccagctcctgggaggaggagctggccgagctgcggcgggagaagaagcagcagcaggaggagaaggagctgctggagcaggaggtgcgcagcctgacccggcagctgcagttcctggagacccagctggcccaggtgtcccagcacgtgtctgacctggaggagcagaagaagcagctgatccaggacaaggaccacctgagccagcaggtgggcatgctggagcggctggccggccccccaggccctgagctgcctgtggccggggagaagaatgaggccctggtgcctgtgaacagcagcctgcaggaggcctggggcaagccagaggaggagcagaggggcctgcaggaggcccagctggatgacaccaaggtgcaggagggcagccaggaggaggagctgcggcaggccaaccgggagctggagaaggagctgcagaatgtggtgggcaggaaccagctgctggagggcaagctgcaggccctgcaggccgactaccaggccctgcagcagcgggagagcgccatccagggcagcctggccagcctggaggccgagcaggccagcatccgccacctgggggaccagatggaggccagcctgctggccgtgaggaaggccaaggaggccatgaaggcccagatggccgagaaggaggccatcctgcagagcaaggagggggagtgccagcagctgcgggaggaggtggagcagtgccagcagctggccgaggcccggcaccgggagctgcgggccctggagagccagtgccagcagcagacccagctgattgaggtgctgacagctgagaagggccagcagggcgtgggccccccaacagacaatgaggcccgggagctggccgcccagctggccctgagccaggcccagctggaggtgcaccagggcgaggtgcagaggctgcaggcccaggtggtggacctgcaggccaagatgagagctgccctggatgaccaggacaaggtgcagagccagctgtccatggccgaggccgtgctgcgggagcacaagaccctggtgcagcagctgaaggagcagaatgaggccctgaacagagcccacgtgcaggagctgctgcagtgcagcgagcgggagggcgccctgcaggaggagcgggcagatgaggcccagcagcgggaggaggagctgcgggccctgcaggaggagctgagccaggccaagtgcagcagcgaggaggcccagctggagcacgccgagctgcaggagcagctgcaccgggccaacacagacacagctgagctgggcatccaggtgtgtgccctgactgtggagaaggagcgggtggaggaggccctggcctgtgctgtgcaggagctgcaggatgccaaggaggccgccagccgggagcgggagggcctggagcggcaggtggccggcctgcagcaggagaaggagagcctgcaggagaagctgaaggccgccaaggctgctgctggcagcctgcccggcctgcaggcccagctggcccaggccgagcagagggcccagagcctgcaggaggccgcccaccaggagctgaacaccctgaagttccagctgtctgctgagatcatggactaccagagccggctgaagaatgctggggaggagtgcaagagcctgcggggccagctggaggagcagggccggcagctgcaggccgctgaggaggccgtggagaagctgaaggccacccaggccgacatgggagagaagctgagctgcaccagcaaccacctggccgagtgccaggccgccatgctgaggaaggacaaggagggcgccgccctgcgggaggacctggagaggacccagaaggagctggagaaggccaccaccaagatccaggagtactacaacaagctgtgccaggaggtgaccaaccgggagagaaatgaccagaagatgctggccgacctggatgacctgaacagaaccaagaagtacctggaggagcggctcatcgagctgctgcgggacaaggatgccctgtggcagaagagtgatgccctggagttccagcagaagctgtctgctgaggagcgctggctgggggacacagaggccaaccactgcctggactgcaagcgggagttctcctggatggtgagaagacaccactgccgcatctgtggccgcatcttctgctactactgctgcaacaactacgtgctgagcaagcatggaggcaagaaggagcgctgctgccgggcctgcttccagaagctgtctgagggccctggcagcccagacagcagcggcagcggcaccagccagggcgagcccagccctgccctgagccctgccagccctggcccccaggccactggaggccagggcgccaacacagactaccggcccccagatgatgctgtgtttgacatcatcacagatgaggagctgtgccagatccaggagagcggcagcagcctgcctgagacccccacagaaacagacagcctggaccccaatgctgctgagcaggcctctgtgggcgccagcaagggcctgggcaacctgctgtgtgagagcagcgcctgccgggacaccaccagcaccagcctgaccccagaggacacagaggacatgcctgtgggccaggacagcgagatctgcctgctgaagtctggagagctgatgatcaaggtgcccctgactgtggatgaaattgccagctttggagagggcagccgggagctgtttgtgcgcagcagcacctacagcctcatccccatcaccgtggccgaggccggcctgaccatctcctgggtgttcagcagtgaccccaagagcatctccttctctgtggtgttccaggaggccgaggacacccccctggaccagtgcaaggtgctgatccccaccacccgctgcaacagccacaaggagaacatccagggccagctgaaggtgaggaccccaggcatctacatgctgatctttgacaacaccttcagcagatttgtgtccaagaaggtgttctaccacctgactgtggacaggcctgtgatctatgatggcagtgacttcctgtag

SEQ ID NO: 153029 - DNA, 2886 bp, Artificial Sequence
  Description of Artificial Sequence: Synthetic coding sequence
atgcacggccaccgggcccctggaggagctggccccagcgagcctgagcacccagccaccaaccccccaggagctgcccccccagcctgtgccgacagcgaccccggggccagcgagcccggcctgctggcccggcggggcagcggcagcgccctgggcggccccctggacccccagtttgtgggccccagcgacaccagcctgggcgccgcccctggccaccgggtgctgccctgtggccccagcccccagcaccaccgggccctgcgcttctcctaccacctggagggcagccagccccggcccggcctgcaccagggcaaccgcatcctggtgaagagcctgagcctggaccccggccagagcctggagccccaccctgagggcccccagaggctgcggagtgaccccggccccccaacagagacccccagccagaggcccagccccctgaagagggcccctggccccaagccccaggtgccccccaagcccagctacctgcagatgcccaggatgcccccacccctggagcccatccccccaccacccagccggcccctgcctgctgacccccgggtggccaagggcctggcccccagggctgaggccagccccagcagcgctgctgtgagcagcctgattgagaagtttgagcgggagcccgtcatcgtggccagtgacaggcctgtgcccggccccagccctggccccccagagcctgtgatgctgccccagcccaccagccagccccctgtgccccagctgcctgagggggaggccagccgctgcctcttcctgctggcccctggccccagagatggagagaaggtgcccaacagagattctggaattgacagcatcagcagccccagcaacagcgaggagacctgctttgtgtctgatgatggcccccccagccacagcctgtgccccggccccccagccctggcctctgtgcctgtggccctggccgacccccaccggcccggcagccaggaggtggacagcgacctggaggaggaggatgatgaggaggaggaggaggagaaggaccgggagatccctgtgcccctgatggagcggcaggagagcgtggagctgactgtgcagcagaaggtgttccacatcgccaatgagctgctgcagacagagaaggcctacgtgtcccggctgcacctgctggaccaggtgttctgtgcccggctgctggaggaggccaggaacagaagcagcttcccagcagatgtggtgcacggcatcttcagcaacatctgcagcatctactgcttccaccagcagttcctgctgcctgagctggagaagaggatggaggagtgggaccgctaccccagaattggagacatcctgcagaagctggcccccttcctgaagatgtatggagaatatgtgaagaactttgacagagctgtggagctggtgaacacctggacagagaggagcacccagttcaaggtgatcatccacgaggtgcagaaggaggaggcctgtggcaacctgaccctgcagcaccacatgctggagcctgtgcagaggatccccaggtatgagctgctgctgaaggactacctgctgaagctgccccacggcagcccagacagcaaggatgcccagaagagcctggagctgattgccacagctgctgagcacagcaatgctgccatcaggaagatggagaggatgcacaagctgctgaaggtgtatgagctgctgggcggggaggaggacatcgtgagccccaccaaggagctgatcaaggagggccacatcctgaagctgagcgccaagaatggcaccacccaggaccgctacctgatcctcttcaatgaccggctgctgtactgtgtgccccggctgcggctgctgggccagaagttctctgtgcgggccagaattgatgtggatggcatggagctgaaggagagcagcaacctgaacctgcccaggaccttcctggtgtctgggaagcagaggagcctggagctgcaggccaggacagaggaggagaagaaggactgggtgcaggccatcaacagcaccctgctgaagcatgagcagaccctggagaccttcaagctgctgaacagcaccaacagagaagatgaggacaccccacccaacagccccaacgtggacctgggcaagagggcccccacccccatccgggagaaggaggtgaccatgtgcatgcgctgccaggagcccttcaacagcatcaccaagagaagacaccactgcaaggcctgtggccacgtggtgtgtgggaaatgttctgagttccgggcccggctggtgtatgacaacaacagaagcaacagagtgtgcacagactgctacgtggccctgcacggcgtgcccggcagcagccctgcctgcagccagcacaccccccagaggagaagaagcatcctggagaagcaggcctctgtggccgctgagaacagcgtcatctgcagcttcctgcactacatggagaagggcggcaagggctggcacaaggcctggtttgtggtgcctgaaaatgagcccctggtgctgtacatctacggggccccccaggatgtgaaggcccagaggagcctgcccctgattggatttgaggtgggccccccagaggccggggagaggccagaccggcggcacgtgttcaagatcacccagagccacctgtcctggtacttcagccctgagacagaggagctgcagaggcgctggatggctgtgctgggccgggccggccgcggggacaccttctgccccggccccaccctgtctgaagatcgggagatggaggaggcccctgtggccgccctgggcgccacagctgagcccccagagagcccccagacccgggacaagacctag

SEQ ID NO: 153030 - DNA, 1968 bp, Artificial Sequence
  Description of Artificial Sequence: Synthetic coding sequence
atgaagggggccagcgaggagaagctggcctctgtgagcaacctggtgacagtgtttgagaacagcaggaccccagaggccgccccccggggccagaggctggaggatgtgcaccacaggcctgagtgcaggcctcctgagagccctggcccccgggagaagaccaacgtgggggaggccgtgggcagcgagcccaggacagtgagccgccgctacctgaacagcctgaagaacaagctgagcagcgaggcctggaggaagagctgccagcctgtgaccctgagcggcagcggcacccaggagcctgagaagaagatcgtgcaggagctgctggagacagagcaggcctacgtggcccggctgcacctgctggaccaggtgttcttccaggagctgctgaagacagcccggagcagcaaggccttcccagaagatgtggtgcgggtcatcttcagcaacatcagcagcatctaccagttccacagccagttcttcctgcctgagctgcagaggcggctggatgactggacagccaaccccagaattggagatgtgatccagaagctggcccccttcctgaagatgtacagtgaatatgtgaagaactttgaaagagctgctgagctgctggccacctggacagacaagagccccctcttccaggaggtgctgacccgcatccagagcagcgaggccagcggcagcctgaccctgcagcaccacatgctggagcctgtgcagaggatccccaggtatgagctgctgctgaaggagtacatccagaagctgcctgcccaggccccagaccaggctgatgcccagaaggccctggacatgatcttctctgctgcccagcacagcaatgctgccatcacagagatggagcggctgcaggacctgtgggaggtgtaccagaggctgggcctggaggatgacatcgtggaccccagcaacaccctgctgcgggagggccctgtgctgaagatctccttcagaagaaatgaccccatggagcgctacctgttcctgttcaacaacatgctgctgtactgtgtgcccagggtcatccaggtgggcgcccagttccaggtgaggaccagaattgatgtggccggcatgaaggtgcgggagctgatggatgctgagttcccccacagcttcctggtgtctgggaagcagaggaccctggagctgcaggcccggagccaggaggagatgatctcctggatgcaggccttccaggccgccatcgaccagatcgagaagagaaatgagaccttcaaggccgccgcccagggccctgagggggacatccaggagcaggagctgcagagcgaggagctgggcctgcgggccccccagtgggtgcgggacaagatggtgaccatgtgcatgcgctgccaggagcccttcaatgccctgaccaggagaagacaccactgccgggcctgtggctacgtggtgtgtgcccgctgcagcgactacagagctgagctgaagtatgatgacaaccggcccaacagagtgtgcctgcactgctacgccttcctgactggaaatgtgctgcctgaggccaaggaggacaagaggcggggcatcctggagaagggcagcagcgccaccccagaccagagcctgatgtgcagcttcctgcagctgattggagacaagtggggcaagagcggcccccggggctggtgtgtgatccccagagatgaccccctggtgctgtatgtgtatgctgccccccaggacatgagggcccacaccagcatccccctgctgggctaccaggtgacagtgggcccccagggcgaccccagggtcttccagctgcagcagagcggccagctgtacaccttcaaggccgagacagaggagctgaagggccgctgggtgaaggccatggagagagctgccagcggctggagccccagctggcccaatgatggagacctgagtgactag

SEQ ID NO: 153031 - DNA, 852 bp, Artificial Sequence
  Description of Artificial Sequence: Synthetic coding sequence
atgaaggtgcgggagctgatggatgctgagttcccccacagcttcctggtgtctgggaagcagaggaccctggagctgcaggcccggagccaggaggagatgatctcctggatgcaggccttccaggccgccatcgaccagatcgagaagagaaatgagaccttcaaggccgccgcccagggccctgagggggacatccaggagcaggagctgcagagcgaggagctgggcctgcgggccccccagtgggtgcgggacaagatggtgaccatgtgcatgcgctgccaggagcccttcaatgccctgaccaggagaagacaccactgccgggcctgtggctacgtggtgtgtgcccgctgcagcgactacagagctgagctgaagtatgatgacaaccggcccaacagagtgtgcctgcactgctacgccttcctgactggaaatgtgctgcctgaggccaaggaggacaagaggcggggcatcctggagaagggcagcagcgccaccccagaccagagcctgatgtgcagcttcctgcagctgattggagacaagtggggcaagagcggcccccggggctggtgtgtgatccccagagatgaccccctggtgctgtatgtgtatgctgccccccaggacatgagggcccacaccagcatccccctgctgggctaccaggtgacagtgggcccccagggcgaccccagggtcttccagctgcagcagagcggccagctgtacaccttcaaggccgagacagaggagctgaagggccgctgggtgaaggccatggagagagctgccagcggctggagccccagctggcccaatgatggagacctgagtgactag

SEQ ID NO: 153032 - DNA, 2178 bp, Artificial Sequence
  Description of Artificial Sequence: Synthetic coding sequence
atggagagcggccggggcagcagcaccccacctggccccatcgccgccctgggcatgccagacaccggccctggcagcagcagcctgggcaagctgcaggccctgcctgtgggcccccgggcccactgtggggaccctgtgtccctggccgctgctggagatggcagcccagacatcggccccaccggggagctgagcggcagcctgaagatccccaacagagacagcggcatcgacagccccagcagctctgtggccggggagaacttcccctgtgaggagggcctggaggccggccccagccccaccgtgctgggcgcccatgctgagatggccctggacagccaggtgcccaaggtgaccccccaggaggaggccgacagtgatgtgggggaggagccagacagcgagaacaccccccagaaggctgacaaggatgctggcctggcccagcacagcggcccccagaagctgctgcacatcgcccaggagctgctgcacacagaggagacctacgtgaagaggctgcacctgctggaccaggtgttctgcacccggctgacagatgctggcatccccccagaggtgatcatgggcatcttcagcaacatcagcagcatccaccgcttccacggccagttcctgctgcctgagctgaagacccgcatcacagaggagtgggacaccaacccccggctgggggacatcctgcagaagctggcccccttcctgaagatgtatggagaatatgtgaagaactttgacagagctgtgggcctggtgtccacctggacccagaggagccccctcttcaaggatgtggtgcacagcatccagaagcaggaggtgtgtggcaacctgaccctgcagcaccacatgctggagcctgtgcagagggtgcccaggtatgagctgctgctgaaggactacctgaagaggctgccccaggatgccccagacaggaaggatgctgagaggagcctggagctgatcagcacagctgccaaccacagcaatgctgccatcaggaaggtggagaagatgcacaagctgctggaggtgtatgagcagctgggcggggaggaggacatcgtgaacccagccaatgaactcatcaaggagggccagatccagaagctgagcgccaagaatggcaccccccaggacagacacctgttcctgttcaacagcatgatcctgtactgtgtgcccaagctgcggctgatgggccagaagttctctgtgcgggagaagatggacatcagcggcctgcaggtgcaggacatcgtgaagcccaacacagcccacaccttcatcatcactggaaggaagaggagcctggagctgcagaccaggacagaggaggagaagaaggagtggatccagatcatccaggccaccatcgagaagcacaagcagaacagcgagaccttcaaggcctttggaggagccttcagccaggatgaggaccccagcctgagcccagacatgcccatcaccagcaccagccctgtggagcctgtggtgaccacagagggcagcagtggagctgctggcctggagcccaggaagctgagcagcaagacccggcgggacaaggagaagcagagctgcaagagctgtggggagaccttcaacagcatcaccaagagaagacaccactgcaagctgtgtggggccgtcatctgtgggaaatgttctgagttcaaggccgagaacagccggcagagccgggtgtgccgggactgcttcctgacccagcctgtggcccctgagagcacagagaagacccccacagctgacccccagcccagcctgctgtgtggccccctgcggctgtctgagagcggggagacctggagcgaggtgtgggccgccatccccatgtctgacccccaggtgctgcacctgcagggcggcagccaggacggccgcctgcccaggaccatccccctgcccagctgcaagctgtctgtgcctgaccctgaggagcggctggacagcggccacgtgtggaagctgcagtgggccaagcagagctggtacctgagcgccagcagcgctgagctgcagcagcagtggctggagaccctgagcacagctgcccatggagacacagcccaggacagccctggggccctgcagctgcaggtgcccatgggcgctgctgccccctag

SEQ ID NO: 153033 - DNA, 2178 bp, Artificial Sequence; identical to SEQ ID NO: 153032
  Description of Artificial Sequence: Synthetic coding sequence

SEQ ID NO: 153034 - DNA, 2175 bp, Artificial Sequence
  Description of Artificial Sequence: Synthetic coding sequence
atggagagcggccggggcagcagcaccccacctggccccatcgccgccctgggcatgccagacaccggccctggcagcagcagcctgggcaagctgcaggccctgcctgtgggcccccgggcccactgtggggaccctgtgtccctggccgctgctggagatggcagcccagacatcggccccaccggggagctgagcggcagcctgaagatccccaacagagacagcggcatcgacagccccagcagctctgtggccggggagaacttcccctgtgaggagggcctggaggccggccccagccccaccgtgctgggcgcccatgctgagatggccctggacagccaggtgcccaaggtgaccccccaggaggaggccgacagtgatgtgggggaggagccagacagcgagaacaccccccagaaggctgacaaggatgctggcctggcccagcacagcggcccccagaagctgctgcacatcgcccaggagctgctgcacacagaggagacctacgtgaagaggctgcacctgctggaccaggtgttctgcacccggctgacagatgctggcatccccccagaggtgatcatgggcatcttcagcaacatcagcagcatccaccgcttccacggccagttcctgctgcctgagctgaagacccgcatcacagaggagtgggacaccaacccccggctgggggacatcctgcagaagctggcccccttcctgaagatgtatggagaatatgtgaagaactttgacagagctgtgggcctggtgtccacctggacccagaggagccccctcttcaaggatgtggtgcacagcatccagaagcaggaggtgtgtggcaacctgaccctgcagcaccacatgctggagcctgtgcagagggtgcccaggtatgagctgctgctgaaggactacctgaagaggctgccccaggatgccccagacaggaaggatgctgagaggagcctggagctgatcagcacagctgccaaccacagcaatgctgccatcaggaaggtggagaagatgcacaagctgctggaggtgtatgagcagctgggcggggaggaggacatcgtgaacccagccaatgaactcatcaaggagggccagatccagaagctgagcgccaagaatggcaccccccaggacagacacctgttcctgttcaacagcatgatcctgtactgtgtgcccaagctgcggctgatgggccagaagttctctgtgcgggagaagatggacatcagcggcctgcaggtgcaggacatcgtgaagcccaacacagcccacaccttcatcatcactggaaggaagaggagcctggagctgcagaccaggacagaggaggagaagaaggagtggatccagatcatccaggccaccatcgagaagcacaagcagaacagcgagaccttcaaggcctttggaggagccttcagccaggatgaggaccccagcctgagcccagacatgcccatcaccagcaccagccctgtggagcctgtggtgaccacagagggcagcagtggagctgctggcctggagcccaggaagctgagcagcaagacccggcgggacaaggagaagcagagctgcaagagctgtggggagaccttcaacagcatcaccaagagaagacaccactgcaagctgtgtggggccgtcatctgtgggaaatgttctgagttcaaggccgagaacagccggcagagccgggtgtgccgggactgcttcctgacccagcctgtggcccctgagagcacagagacccccacagctgacccccagcccagcctgctgtgtggccccctgcggctgtctgagagcggggagacctggagcgaggtgtgggccgccatccccatgtctgacccccaggtgctgcacctgcagggcggcagccaggacggccgcctgcccaggaccatccccctgcccagctgcaagctgtctgtgcctgaccctgaggagcggctggacagcggccacgtgtggaagctgcagtgggccaagcagagctggtacctgagcgccagcagcgctgagctgcagcagcagtggctggagaccctgagcacagctgcccacggggacacagcccaggacagccctggggccctgcagctgcaggtgcccatgggcgccgccgccccctag

SEQ ID NO: 153035 - DNA, 987 bp, Artificial Sequence
  Description of Artificial Sequence: Synthetic coding sequence
atgatcctgtactgtgtgcccaagctgcggctgatgggccagaagttctctgtgcgggagaagatggacatcagcggcctgcaggtgcaggacatcgtgaagcccaacacagcccacaccttcatcatcaccggcaggaagaggagcctggagctgcagaccaggacagaggaggagaagaaggagtggatccagatcatccaggccaccatcgagaagcacaagcagaacagcgagaccttcaaggccttcggcggggccttcagccaggatgaggaccccagcctgagcccagacatgcccatcaccagcaccagccctgtggagcctgtggtgaccacagagggcagcagcggggctgctggcctggagcccaggaagctgagcagcaagacccggcgggacaaggagaagcagagctgcaagagctgtggggagaccttcaacagcatcaccaagaggaggcaccactgcaagctgtgtggggctgtgatctgtgggaagtgcagcgagttcaaggccgagaacagccggcagagccgggtgtgccgggactgcttcctgacccagcctgtggcccctgagagcacagagaagacccccacagctgacccccagcccagcctgctgtgtggccccctgcggctgtctgagagcggggagacctggagcgaggtgtgggccgccatccccatgtctgacccccaggtgctgcacctgcagggcggcagccaggacggccgcctgcccaggaccatccccctgcccagctgcaagctgtctgtgcctgaccctgaggagcggctggacagcggccacgtgtggaagctgcagtgggccaagcagagctggtacctgagcgccagcagcgctgagctgcagcagcagtggctggagaccctgagcacagctgcccacggggacacagcccaggacagccctggggccctgcagctgcaggtgcccatgggcgccgccgccccctag

SEQ ID NO: 153036 - DNA, 1416 bp, Artificial Sequence
  Description of Artificial Sequence: Synthetic coding sequence
atggtgaacaagatcttcagcaacatcagcagcatcaatgccttccacagcaagttcctgctgcctgagctggagaagaggatgcaggagtgggagaccaccccaagaattggagacatcctgcagaagctggcccccttcctgaagatgtatggagaatatgtgaagggctttgacaatgccatggagctggtgaagaacatgacagagcgcatcccccagttcaagtctgtggtggaggagatccagaagcagaagatctgtggcagcctgaccctgcagcaccacatgctggagcctgtgcagaggatccccaggtatgagatgctgctgaaggactacctgaggaagctgcccccagacagcctggactggaatgatgccaagaagagcctggagatcatcagcacagctgccagccacagcaacagcgccatcaggaagatggagaacctgaagaagctgctggagatctatgagatgctgggggaggaggaggacatcgtgaaccccagcaatgaactcatcaaggagggccagatcctgaagctggccgccaggaacaccagcgcccaggagcgctacctgttcctgttcaacaacatgctgctgtactgtgtgcccaagttcagcctggtgggcagcaagttcaccgtgaggaccagggtgggcattgatggcatgaagatcgtggagacccagaatgaggagtacccccacaccttccaggtgtctgggaaggagaggaccctggagctgcaggccagcagcgcccaggacaaggaggagtggatcaaggccctgcaggagaccattgatgccttccaccagagacatgagaccttcagaaatgccatcgccaaggacaatgacatccacagcgaggtgtccacagctgagctgggcaagagggccccccgctggatccgggacaatgaggtgaccatgtgcatgaagtgcaaggagcccttcaatgccctgacccggcggcggcaccactgccgggcctgtggctacgtggtgtgctggaagtgcagcgactacaaggcccagctggagtatgatggcggcaagctgagcaaggtgtgcaaggactgctaccagatcatcagcggcttcacagacagcgaggagaagaagaggaagggcatcctggagattgaatctgctgaggtgtctggcaacagcgtggtgtgcagcttcctgcagtacatggagaagagcaagccctggcagaaggcctggtgtgtgatccccaagcaggaccccctggtgctgtacatgtatggagccccccaggtgtccaagccccacctgtctgagggcacagatgccctgggcggcaagggcaagagggtggacagcggcctgaagatctgcaggaccagggtgcaggccgtgtccctcttccactag

SEQ ID NO: 153037 - DNA, 843 bp, Artificial Sequence
  Description of Artificial Sequence: Synthetic coding sequence
atggtgaacaagatcttcagcaacatcagcagcatcaatgccttccacagcaagttcctgctgcctgagctggagaagaggatgcaggagtgggagaccaccccaagaattggagacatcctgcagaagctggcccccttcctgaagatgtatggagaatatgtgaagggctttgacaatgccatggagctggtgaagaacatgacagagcgcatcccccagttcaagtctgtggtggaggagatccagaagcagaagatctgtggcagcctgaccctgcagcaccacatgctggagcctgtgcagaggatccccaggtatgagatgctgctgaaggactacctgaggaagctgcccccagacagcctggactggaatgatgccaagaagagcctggagatcatcagcacagctgccagccacagcaacagcgccatcaggaagatggagaacctgaagaagctgctggagatctatgagatgctgggggaggaggaggacatcgtgaaccccagcaatgaactcatcaaggagggccagatcctgaagctggccgccaggaacaccagcgcccaggagcgctacctgttcctgttcaacaacatgctgctgtactgtgtgcccaagttcagcctggtgggcagcaagttcaccgtgaggaccagggtgggcattgatggcatgaagatcgtggagacccagaatgaggagtacccccacaccttccaggtgtctgggaaggagaggaccctggagctgcaggccagcagcgcccaggacaaggaggagtggatcaagagaagaggatttgccatgctgcccaggctcatcagcaacagctag

SEQ ID NO: 153038 - DNA, 567 bp, Artificial Sequence
  Description of Artificial Sequence: Synthetic coding sequence
atgttcagctgcttcctgtgcatcctgtccttcagcagcctgagcaactacagcgacctgaagaaggagagcgctgtgaacctgaatgcccccaggaccccaggaagacatggcctgaccaccaccccccagcagaagctgctgagccagcacctgccccagaggcagggcaatgacacagacaagacccagggcgcccagacctgtgtggccaacggggtgatggccgcccagaaccagatggagtgtgaggaggagaaggccgccaccctgagcagtgacaccagcatccaggccagcgagcccctgctggacacccacatcgtgaatggagagagagatgaaacagccacagccccagccagccccaccacagacagctgtgatggaaatgccagtgacagcagctaccgcaccccaggcatcggccctgtgctgcccctggaggagagaggagctgagacagagaccaaggtgcaggagagagaaaatggagagagccccctggagctggagcagctggaccagcaccacgagatgaaggtggagcacgagaccagcagctag

SEQ ID NO: 153039 - DNA, 2301 bp, Artificial Sequence
  Description of Artificial Sequence: Synthetic coding sequence
atggaggagatcaagccagccagcgccagctgtgtgtccaaggagaagcccagcaaggtgtctgacctgatcagcagatttgaaggaggcagcagcctgagcaactacagcgacctgaagaaggagagcgctgtgaacctgaatgcccccaggaccccaggccgccacggcctgaccaccaccccccagcagaagctgctgagccagcacctgccccagaggcagggcaatgacacagacaagacccagggcgcccagacctgtgtggccaatggagtgatggccgcccagaaccagatggagtgtgaggaggagaaggccgccaccctgagcagtgacaccagcatccaggccagcgagcccctgctggacacccacatcgtgaatggagagagagatgaaacagccacagccccagccagccccaccacagacagctgtgatggaaatgccagtgacagcagctaccgcaccccaggcatcggccctgtgctgcccctggaggagagaggagctgagacagagaccaaggtgcaggagcgggagaatggagagagccccctggagctggagcagctggaccagcaccacgagatgaaggagaccaatgagcagaagctgcacaagatcgccaatgagctgctgctgacagagcgggcctacgtgaaccggctggacctgctggaccaggtgttctactgcaagctgctggaggaggccaacagaggcagcttccctgctgagatggtgaacaagatcttcagcaacatcagcagcatcaatgccttccacagcaagttcctgctgcctgagctggagaagaggatgcaggagtgggagaccaccccaagaattggagacatcctgcagaagctggcccccttcctgaagatgtatggagaatatgtgaagggctttgacaatgccatggagctggtgaagaacatgacagagcgcatcccccagttcaagtctgtggtggaggagatccagaagcagaagatctgtggcagcctgaccctgcagcaccacatgctggagcctgtgcagaggatccccaggtatgagatgctgctgaaggactacctgaggaagctgcccccagacagcctggactggaatgatgccaagaagagcctggagatcatcagcacagctgccagccacagcaacagcgccatcaggaagatggagaacctgaagaagctgctggagatctatgagatgctgggggaggaggaggacatcgtgaaccccagcaatgaactcatcaaggagggccagatcctgaagctggccgccaggaacaccagcgcccaggagcgctacctgttcctgttcaacaacatgctgctgtactgtgtgcccaagttcagcctggtgggcagcaagttcaccgtgaggaccagggtgggcattgatggcatgaagatcgtggagacccagaatgaggagtacccccacaccttccaggtgtctgggaaggagaggaccctggagctgcaggccagcagcgcccaggacaaggaggagtggatcaaggccctgcaggagaccattgatgccttccaccagagacatgagaccttcagaaatgccatcgccaaggacaatgacatccacagcgaggtgtccacagctgagctgggcaagagggccccccgctggatccgggacaatgaggtgaccatgtgcatgaagtgcaaggagcccttcaatgccctgacccggcggcggcaccactgccgggcctgtggctacgtggtgtgctggaagtgcagcgactacaaggcccagctggagtatgatggcggcaagctgagcaaggtgtgcaaggactgctaccagatcatcagcggcttcacagacagcgaggagaagaagaggaagggcatcctggagattgaatctgctgaggtgtctggcaacagcgtggtgtgcagcttcctgcagtacatggagaagagcaagccctggcagaaggcctggtgtgtgatccccaagcaggaccccctggtgctgtacatgtatggagccccccaggatgtgcgggcccaggccaccatccccctgctgggctacgtggtggatgagatgcccaggtctgctgacctgccccacagcttcaagctgacccagagcaagtctgtgcacagctttgctgctgacagcgaggagctgaagcagaagtggctgaaggtgatcctgctggccgtgactggagagacccctgggggccccaatgagcacccagccaccctggatgaccaccctgagcccaagaagaagtcagaatgttag

SEQ ID NO: 153040 - DNA, 624 bp, Artificial Sequence
  Description of Artificial Sequence: Synthetic coding sequence
atggaggagatcaagccagccagcgccagctgtgtgtccaaggagaagcccagcaaggtgtctgacctgatcagcagatttgaaggaggcagcagcctgagcaactacagcgacctgaagaaggagagcgctgtgaacctgaatgcccccaggaccccaggccgccacggcctgaccaccaccccccagcagaagctgctgagccagcacctgccccagaggcagggcaatgacacagacaagacccagggcgcccagacctgtgtggccaatggagtgatggccgcccagaaccagatggagtgtgaggaggagaaggccgccaccctgagcagtgacaccagcatccaggccagcgagcccctgctggacacccacatcgtgaatggagagagagatgaaacagccacagccccagccagccccaccacagacagctgtgatggaaatgccagtgacagcagctaccgcaccccaggcatcggccctgtgctgcccctggaggagagaggagctgagacagagaccaaggtgcaggagcgggagaatggagagagccccctggagctggagcagctggaccagcaccacgagatgaaggtggagcacgagaccagcagctag

SEQ ID NO: 153041 - DNA, 2637 bp, Artificial Sequence
  Description of Artificial Sequence: Synthetic coding sequence
atgaacttcaagagggtgaagcccaacatcttcctgctgaaccagagccgcctcatcatcagcatctgtgagatcatgagcacagaccagggcagcagcacctgccccaagatcgccctggtgcccccctgcagcaccagcagcaccaccaccctggtgggagaaaatgtgtctgaggaggaggcccagggcatcaatggaaacagacctgccaagcacagcgctgccagccccaagccccaggtgccccccaagcccctgcacctgcagaacagccccagcagcaacatccaccagacccccaggcacaaggccctgcccagcgccaagcccaggatggaggagatcaagccagccagcgccagctgtgtgtccaaggagaagcccagcaaggtgtctgacctgatcagcagatttgaaggaggcagcagcctgagcaactacagcgacctgaagaaggagagcgctgtgaacctgaatgcccccaggaccccaggccgccacggcctgaccaccaccccccagcagaagctgctgagccagcacctgccccagaggcagggcaatgacacagacaagacccagggcgcccagacctgtgtggccaatggagtgatggccgcccagaaccagatggagtgtgaggaggagaaggccgccaccctgagcagtgacaccagcatccaggccagcgagcccctgctggacacccacatcgtgaatggagagagagatgaaacagccacagccccagccagccccaccacagacagctgtgatggaaatgccagtgacagcagctaccgcaccccaggcatcggccctgtgctgcccctggaggagagaggagctgagacagagaccaaggtgcaggagcgggagaatggagagagccccctggagctggagcagctggaccagcaccacgagatgaaggagaccaatgagcagaagctgcacaagatcgccaatgagctgctgctgacagagcgggcctacgtgaaccggctggacctgctggaccaggtgttctactgcaagctgctggaggaggccaacagaggcagcttccctgctgagatggtgaacaagatcttcagcaacatcagcagcatcaatgccttccacagcaagttcctgctgcctgagctggagaagaggatgcaggagtgggagaccaccccaagaattggagacatcctgcagaagctggcccccttcctgaagatgtatggagaatatgtgaagggctttgacaatgccatggagctggtgaagaacatgacagagcgcatcccccagttcaagtctgtggtggaggagatccagaagcagaagatctgtggcagcctgaccctgcagcaccacatgctggagcctgtgcagaggatccccaggtatgagatgctgctgaaggactacctgaggaagctgcccccagacagcctggactggaatgatgccaagaagagcctggagatcatcagcacagctgccagccacagcaacagcgccatcaggaagatggagaacctgaagaagctgctggagatctatgagatgctgggggaggaggaggacatcgtgaaccccagcaatgaactcatcaaggagggccagatcctgaagctggccgccaggaacaccagcgcccaggagcgctacctgttcctgttcaacaacatgctgctgtactgtgtgcccaagttcagcctggtgggcagcaagttcaccgtgaggaccagggtgggcattgatggcatgaagatcgtggagacccagaatgaggagtacccccacaccttccaggtgtctgggaaggagaggaccctggagctgcaggccagcagcgcccaggacaaggaggagtggatcaaggccctgcaggagaccattgatgccttccaccagagacatgagaccttcagaaatgccatcgccaaggacaatgacatccacagcgaggtgtccacagctgagctgggcaagagggccccccgctggatccgggacaatgaggtgaccatgtgcatgaagtgcaaggagcccttcaatgccctgacccggcggcggcaccactgccgggcctgtggctacgtggtgtgctggaagtgcagcgactacaaggcccagctggagtatgatggcggcaagctgagcaaggtgtgcaaggactgctaccagatcatcagcggcttcacagacagcgaggagaagaagaggaagggcatcctggagattgaatctgctgaggtgtctggcaacagcgtggtgtgcagcttcctgcagtacatggagaagagcaagccctggcagaaggcctggtgtgtgatccccaagcaggaccccctggtgctgtacatgtatggagccccccaggatgtgcgggcccaggccaccatccccctgctgggctacgtggtggatgagatgcccaggtctgctgacctgccccacagcttcaagctgacccagagcaagtctgtgcacagctttgctgctgacagcgaggagctgaagcagaagtggctgaaggtgatcctgctggccgtgactggagagacccctgggggccccaatgagcacccagccaccctggatgaccaccctgagcccaagaagaagtcagaatgttag

SEQ ID NO: 153042 - DNA, 2556 bp, Artificial Sequence
  Description of Artificial Sequence: Synthetic coding sequence
atgggcggctgcagcagcacctgccccaagatcgccctggtgcccccctgcagcaccagcagcaccaccaccctggtgggggagaatgtgtctgaggaggaggcccagggcatcaatggaaacagacctgccaagcacagcgctgccagccccaagccccaggtgccccccaagcccctgcacctgcagaacagccccagcagcaacatccaccagacccccaggcacaaggccctgcccagcgccaagcccaggatggaggagatcaagccagccagcgccagctgtgtgtccaaggagaagcccagcaaggtgtctgacctgatcagcagatttgagggcggcagcagcctgagcaactacagcgacctgaagaaggagagcgctgtgaacctgaatgcccccaggaccccaggaagacatggcctgaccaccaccccccagcagaagctgctgagccagcacctgccccagaggcagggcaatgacacagacaagacccagggcgcccagacctgtgtggccaacggggtgatggccgcccagaaccagatggagtgtgaggaggagaaggccgccaccctgagcagtgacaccagcatccaggccagcgagcccctgctggacacccacatcgtgaatggagagagagatgaaacagccacagccccagccagccccaccacagacagctgtgatggaaatgccagtgacagcagctaccgcaccccaggcatcggccctgtgctgcccctggaggagagaggagctgagacagagaccaaggtgcaggagagagaaaatggagagagccccctggagctggagcagctggaccagcaccacgagatgaaggagaccaatgagcagaagctgcacaagatcgccaatgagctgctgctgacagagcgggcctacgtgaaccggctggacctgctggaccaggtgttctactgcaagctgctggaggaggccaacagaggcagcttccctgctgagatggtgaacaagatcttcagcaacatcagcagcatcaatgccttccacagcaagttcctgctgcctgagctggagaagaggatgcaggagtgggagaccaccccccgcatcggggacatcctgcagaagctggcccccttcctgaagatgtacggggagtatgtgaagggctttgacaatgccatggagctggtgaagaacatgacagagcgcatcccccagttcaagtctgtggtggaggagatccagaagcagaagatctgtggcagcctgaccctgcagcaccacatgctggagcctgtgcagaggatccccaggtatgagatgctgctgaaggactacctgaggaagctgcccccagacagcctggactggaatgatgccaagaagagcctggagatcatcagcacagctgccagccacagcaacagcgccatcaggaagatggagaacctgaagaagctgctggagatctatgagatgctgggggaggaggaggacatcgtgaaccccagcaatgagctgatcaaggagggccagatcctgaagctggccgccaggaacaccagcgcccaggagcgctacctgttcctgttcaacaacatgctgctgtactgtgtgcccaagttcagcctggtgggcagcaagttcaccgtgaggaccagggtgggcattgatggcatgaagatcgtggagacccagaatgaggagtacccccacaccttccaggtgtctgggaaggagaggaccctggagctgcaggccagcagcgcccaggacaaggaggagtggatcaaggccctgcaggagaccattgatgccttccaccagagacatgagaccttcagaaatgccatcgccaaggacaatgacatccacagcgaggtgtccacagctgagctgggcaagagggccccccgctggatccgggacaatgaggtgaccatgtgcatgaagtgcaaggagcccttcaatgccctgaccaggagaagacaccactgccgggcctgtggctacgtggtgtgctggaagtgcagcgactacaaggcccagctggagtatgatggcggcaagctgagcaaggtgtgcaaggactgctaccagatcatcagcggcttcacagattctgaggagaagaagaggaagggcatcctggagattgagagcgctgaggtgtctggcaacagcgtggtgtgcagcttcctgcagtacatggagaagagcaagccctggcagaaggcctggtgtgtgatccccaagcaggaccccctggtgctgtacatgtacggggccccccaggatgtgcgggcccaggccaccatccccctgctgggctacgtggtggatgagatgcccaggtctgctgacctgccccacagcttcaagctgacccagagcaagtctgtgcacagctttgctgctgacagcgaggagctgaagcagaagtggctgaaggtgatcctgctggccgtgactggagagaccccaggcggccccaatgagcacccagccaccctggatgaccaccctgagcccaagaagaagtctgagtgctag

SEQ ID NO: 153043 - DNA, 2712 bp, Artificial Sequence
  Description of Artificial Sequence: Synthetic coding sequence
atgtctgatgaaggaggcagcaacttccggcgggtggccatccggaggaagagcaaccccagctacctgcccccaggagtgccccggccctggagcaggcctgccagccacctgggccgggtgggcacagctgccttcaagggccaggtgcccagcggggccaccggcagcagcacctgccccaagatcgccctggtgcccccctgcagcaccagcagcaccaccaccctggtgggggagaatgtgtctgaggaggaggcccagggcatcaatggaaacagacctgccaagcacagcgctgccagccccaagccccaggtgccccccaagcccctgcacctgcagaacagccccagcagcaacatccaccagacccccaggcacaaggccctgcccagcgccaagcccaggatggaggagatcaagccagccagcgccagctgtgtgtccaaggagaagcccagcaaggtgtctgacctgatcagcagatttgagggcggcagcagcctgagcaactacagcgacctgaagaaggagagcgctgtgaacctgaatgcccccaggaccccaggaagacatggcctgaccaccaccccccagcagaagctgctgagccagcacctgccccagaggcagggcaatgacacagacaagacccagggcgcccagacctgtgtggccaacggggtgatggccgcccagaaccagatggagtgtgaggaggagaaggccgccaccctgagcagtgacaccagcatccaggccagcgagcccctgctggacacccacatcgtgaatggagagagagatgaaacagccacagccccagccagccccaccacagacagctgtgatggaaatgccagtgacagcagctaccgcaccccaggcatcggccctgtgctgcccctggaggagagaggagctgagacagagaccaaggtgcaggagagagaaaatggagagagccccctggagctggagcagctggaccagcaccacgagatgaaggagaccaatgagcagaagctgcacaagatcgccaatgagctgctgctgacagagcgggcctacgtgaaccggctggacctgctggaccaggtgttctactgcaagctgctggaggaggccaacagaggcagcttccctgctgagatggtgaacaagatcttcagcaacatcagcagcatcaatgccttccacagcaagttcctgctgcctgagctggagaagaggatgcaggagtgggagaccaccccccgcatcggggacatcctgcagaagctggcccccttcctgaagatgtacggggagtatgtgaagggctttgacaatgccatggagctggtgaagaacatgacagagcgcatcccccagttcaagtctgtggtggaggagatccagaagcagaagatctgtggcagcctgaccctgcagcaccacatgctggagcctgtgcagaggatccccaggtatgagatgctgctgaaggactacctgaggaagctgcccccagacagcctggactggaatgatgccaagaagagcctggagatcatcagcacagctgccagccacagcaacagcgccatcaggaagatggagaacctgaagaagctgctggagatctatgagatgctgggggaggaggaggacatcgtgaaccccagcaatgagctgatcaaggagggccagatcctgaagctggccgccaggaacaccagcgcccaggagcgctacctgttcctgttcaacaacatgctgctgtactgtgtgcccaagttcagcctggtgggcagcaagttcaccgtgaggaccagggtgggcattgatggcatgaagatcgtggagacccagaatgaggagtacccccacaccttccaggtgtctgggaaggagaggaccctggagctgcaggccagcagcgcccaggacaaggaggagtggatcaaggccctgcaggagaccattgatgccttccaccagagacatgagaccttcagaaatgccatcgccaaggacaatgacatccacagcgaggtgtccacagctgagctgggcaagagggccccccgctggatccgggacaatgaggtgaccatgtgcatgaagtgcaaggagcccttcaatgccctgaccaggagaagacaccactgccgggcctgtggctacgtggtgtgctggaagtgcagcgactacaaggcccagctggagtatgatggcggcaagctgagcaaggtgtgcaaggactgctaccagatcatcagcggcttcacagattctgaggagaagaagaggaagggcatcctggagattgagagcgctgaggtgtctggcaacagcgtggtgtgcagcttcctgcagtacatggagaagagcaagccctggcagaaggcctggtgtgtgatccccaagcaggaccccctggtgctgtacatgtacggggccccccaggatgtgcgggcccaggccaccatccccctgctgggctacgtggtggatgagatgcccaggtctgctgacctgccccacagcttcaagctgacccagagcaagtctgtgcacagctttgctgctgacagcgaggagctgaagcagaagtggctgaaggtgatcctgctggccgtgactggagagaccccaggcggccccaatgagcacccagccaccctggatgaccaccctgagcccaagaagaagtctgagtgctag

SEQ ID NO: 153044 - DNA, 420 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagaggcaggaccctgctgctgcccaggagggggaggatgaaggagccagcgctggccagggccccaagccagaggccgacagccaggagcagggccacccccagacaggctgtgaatgtgaagatggcccagatggccaggagatggacccccccaaccctgaggaggtgaagaccccagaggaggagatgaggagccactacgtggcccagacaggcatcctgtggctgctgatgaacaactgcttcctgaacctgagccccaggaagccctag

SEQ ID NO: 153045 - DNA, 351 bp, Artificial Sequence
  Description of Artificial Sequence: Synthetic coding sequence
atgtcctggaggggccgcagcacctaccgcagccggccccggctgtatgtggagcccccagagatgattggccccatgctgcctgagcagttcagtgatgaggtggagcccgccaccccagaggagggggagcccgccacccagaggcaggaccctgctgctgcccaggagggagaagatgagggcgccagcgctggccagggccccaagccagaggccgacagccaggagcaggtgcaccccaagacaggctgtgaatgtggagatggcccagatggccaggagatgggcctgcccaaccctgaggaggtgaagaggcctgaggagggggagaagcagagccagtgctag

SEQ ID NO: 153046 - DNA, 354 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagtgccaggaccctgctgctgcccaggagggggaggatgaaggagccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 153047 - DNA, 354 bp, Artificial Sequence; identical to SEQ ID NO: 153046
  Description of Artificial Sequence: Synthetic coding sequence

SEQ ID NO: 153048 - DNA, 354 bp, Artificial Sequence; identical to SEQ ID NO: 153046
  Description of Artificial Sequence: Synthetic coding sequence

SEQ ID NO: 153049 - DNA, 354 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagaggcaggaccctgctgctgcccaggagggggaggatgaaggagccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 153050 - DNA, 354 bp, Artificial Sequence; identical to SEQ ID NO: 153049
  Description of Artificial Sequence: Synthetic coding sequence

SEQ ID NO: 153051 - DNA, 354 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagtgccaggaccctgctgctgcccagaagggggaggatgaaggagccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 153052 - DNA, 354 bp, Artificial Sequence
  Description of Artificial Sequence: Synthetic coding sequence
atgtcctggaggggccgcagcacctactactggccccggccccggccctacgtgcagcccccagagatgattggccccatgaggcctgagcagttcagtgatgaggtggagcccgccaccccagaggagggggagcccgccacccagaggcaggaccctgctgctgcccaggagggggaggatgaaggagccagcgctggccagggccccaagccagaggccgacagccaggagcagggccacccccagacaggctgtgaatgtgaagatggcccagatggccaggagatggacccccccaaccctgaggaggtgaagaccccagaggagggcaagaagcagagccagtgctag

SEQ ID NO: 153053 - DNA, 354 bp, Artificial Sequence
  Description of Artificial Sequence: Synthetic coding sequence
atgtcctggaggggccgcagcacctactaccggccccggcccaggagatatgtggagcccccagagatgattggccccatgaggcctgagcagttcagtgatgaggtggagcccgccaccccagaggagggggagcccgccacccagtgccaggaccctgctgctgcccaggagggggaggatgaaggagccagcgctggccagggccccaagccagaggccgacagccaggagcagggccacccccagacaggctgtgaatgtgaagatggcccagatggccaggagatggacccccccaaccctgaggaggtgaagaccccagaggagggcaagaagcagagccagtgctag

SEQ ID NO: 153054 - DNA, 351 bp, Artificial Sequence
  Description of Artificial Sequence: Synthetic coding sequence
atgtcctggaggggccgcagcacctaccggccccggccccggcgctacgtggagcccccagagatgattggccccatgaggcctgagcagttcagtgatgaggtggagcccgccaccccagaggagggggagcccgccacccagaggcaggaccctgctgctgcccaggagggccaggatgagggcgccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 153055 - DNA, 351 bp, Artificial Sequence
  Description of Artificial Sequence: Synthetic coding sequence
atgtcctggaggggccgcagcacctaccggccccggccccggcgctacgtggagcccccagagatgattggccccatgaggcctgagcagttcagtgatgaggtggagcccgccaccccagaggagggggagcccgccacccagaggcaggaccctgctgctgcccaggagggagaagatgagggcgccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 153056 - DNA, 351 bp, Artificial Sequence; identical to SEQ ID NO: 153055
  Description of Artificial Sequence: Synthetic coding sequence

SEQ ID NO: 153057 - DNA, 351 bp, Artificial Sequence
  Description of Artificial Sequence: Synthetic coding sequence
atgtcctggaggggccgcagcacctaccggccccggccccggcgctacgtggagcccccagagatgattggccccatgaggcctgagcagttcagtgatgaggtggagcccgccaccccagaggagggggagcccgccacccagaggcaggaccctgctgctgcccaggagggagaagatgagggcgccagcgctggccagggccccaagccagaggccgacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 153058 - DNA, 351 bp, Artificial Sequence
  Description of Artificial Sequence: Synthetic coding sequence
atgtcctggaggggccgcagcacctaccggccccggccccggcgctacgtggagcccccagagatgattggccccatgaggcctgagcagttcagtgatgaggtggagcccgccaccccagaggagggggagcccgccacccagaggcaggaccctgctgctgcccaggagggagaagatgagggcgccagcgctggccagggccccaagccagaggccgacagccaggagcagggccacccccagacaggctgtgaatgtgaagatggcccagatggccaggagatggacccccccaaccctgaggaggtgaagaccccagaggagggcaagaagcagagccagtgctag

SEQ ID NO: 153059 - DNA, 435 bp, Artificial Sequence
  Description of Artificial Sequence: Synthetic coding sequence
atgttcctggaggagaagatccccagcatcagtgacctgaagctggccatccggcgggccaccctgaagaggagcttcacccctgtgttcctgggcagcgccctgaagaacaagggcgtgcagcccctgctggatgctgtgctggagtacctgcccaaccccagcgaggtgcagaactatgccatcctgaacaaggaggatgacagcaaggagaagaccaagatcctgatgaacagcagccgggacaacagccacccctttgtgggcctggccttcaagctggagttcctgagccgctccttcttccggctgacccggcagaaggaccacagaagacccatccagaggaccaccctgtacctgattgtgatgagcccctatgacctgctgggctgcaacagcttcctggacttcccctgcttcagccgggactag

SEQ ID NO: 153060 - DNA, 2256 bp, Artificial Sequence
  Description of Artificial Sequence: Synthetic coding sequence
atgaggctgctgggcgctgctgctgtggccgccctgggccggggccgggccccagccagcctgggctggcagaggaagcaggtgaactggaaggcctgccgctggagcagcagcggggtcatccccaatgagaagatcagaaatattggcatcagcgcccacattgattctgggaagaccaccctgacagagcgggtgctgtactacacaggaagaattgccaagatgcatgaggtgaagggcaaggatggagtgggcgctgtgatggacagcatggagctggagcggcagaggggcatcaccatccagagcgctgccacctacaccatgtggaaggatgtgaacatcaacatcatcgacaccccaggccacgtggacttcaccatcgaggtggagcgggccctgcgggtgctggatggagctgtgctggtgctgtgtgctgtgggcggcgtgcagtgccagaccatgacagtgaaccggcagatgaagcgctacaacgtgcccttcctgaccttcatcaacaagctggacaggatgggcagcaacccagcccgggccctgcagcagatgaggagcaagctgaaccacaatgctgccttcatgcagatccccatgggcctggagggcaacttcaagggcatcgtggacctgattgaggagcgggccatctactttgatggagactttggccagatcgtgcgctatggagagatcccagctgagctgcgggctgctgccacagaccaccggcaggagctgattgaatgtgtggccaacagtgatgagcagctgggggagatgttcctggaggagaagatccccagcatcagtgacctgaagctggccatccggcgggccaccctgaagaggagcttcacccctgtgttcctgggcagcgccctgaagaacaagggcgtgcagcccctgctggatgctgtgctggagtacctgcccaaccccagcgaggtgcagaactatgccatcctgaacaaggaggatgacagcaaggagaagaccaagatcctgatgaacagcagccgggacaacagccacccctttgtgggcctggccttcaagctggaggtgggccgcttcggccagctgacctacgtgcgcagctaccagggcgagctgaagaagggggacaccatctacaacaccaggaccaggaagaaggtgcggctgcagaggctggccaggatgcatgctgacatgatggaggatgtggaggaggtgtatgctggggacatctgtgccctgtttggaattgactgtgccagcggggacaccttcacagacaaggccaacagcggcctgtccatggagagcatccacgtgcctgaccctgtgatcagcatcgccatgaagcccagcaacaagaatgacctggagaagttcagcaagggcatcggccgcttcacccgggaggaccccaccttcaaggtgtactttgacacagagaacaaggagaccgtcatcagcggcatgggagagctgcacctggagatctatgcccagaggctggagcgggagtatggctgcccctgcatcaccgggaagcccaaggtggccttccgggagaccatcacagcccctgtgccctttgacttcacccacaagaagcagagcggcggggccggccagtatggcaaggtgattggagtgctggagcccctggaccctgaggactacaccaagctggagttcagtgatgagaccttcggcagcaacatccccaagcagtttgtgcctgctgtggagaagggcttcctggatgcctgtgagaagggccccctgagcggccacaagctgagcggcctgcgctttgtgctgcaggatggagcccaccacatggtggacagcaatgagatctccttcatccgggccggggagggcgccctgaagcaggccctggccaatgccaccctgtgcatcctggagcccatcatggctgtggaggtggtggccccaaatgagttccagggccaggtgattgctggcatcaacagaagacatggagtcatcaccggccaggatggagtggaggactacttcaccctgtatgcagatgtgcccctgaatgacatgtttggctacagcacagagctgcggagctgcacagagggcaagggggagtacaccatggagtacagccgctaccagccctgcctgcccagcacccaggaggatgtgatcaacaagtacctggaggccaccggccagctgcctgtgaagaagggcaaggccaagaactag

SEQ ID NO: 153061 - DNA, 459 bp, Artificial Sequence
  Description of Artificial Sequence: Synthetic coding sequence
atgagcctggtgattcctgagaagttccagcacatcctgcgggtgctgaacaccaacattgatggaagaaggaagatcgcctttgccatcacagccatcaagggcgtgggccgccgctatgcccacgtggtgctgaggaaggctgacatcgacctgaccaagagagctggggagctgacagaagatgaggtggagagggtcatcaccatcatgcagaacccccggcagtacaagatcccagactggttcctgaaccggcagaaggatgtgaaggatggcaagtacagccaggtgctggccaacggcctggacaacaagctgcgggaggacctggagcggctgaagaagatccgggcccaccggggcctgcggcacttctggggcctgcgggtgcggggccagcacaccaagaccactggaagaagaggccgcacagtgggcgtgtccaagaagaagtag

SEQ ID NO: 153062 - DNA, 1071 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggcagaggagctgcctgggtgggcgtgtgtgagctgagcggcagagatgctgcccagctggccgaggaggccggcttccctgaggtggccaggatggtgcgggagagccacggggagaccaggagcccagaaaatagaagccccacccccagcctgcagtactgtgagaactgtgacacccacttccaggacagcaaccacaggaccagcacagcccacctgctgagcctgagccagggcccccagccccccaacctgcccctgggcgtgcccatcagcagccctggcttcaagctgctgctgcggggcggctgggagcccggcatgggcctgggccccagaggagagggccgggccaaccccatccccaccgtgctgaagagggaccaggagggcctgggctaccgcagcgccccccagccccgggtgacccacttccctgcctgggacaccagggctgtggccggccgggagaggcctccccgggtggccaccctgtcctggagggaggagcggcggcgggaggagaaggaccgggcctgggagcgggacctgcggacctacatgaacctggagttctag

SEQ ID NO: 153063 - DNA, 1071 bp, Artificial Sequence; identical to SEQ ID NO: 153062
  Description of Artificial Sequence: Synthetic coding sequence

SEQ ID NO: 153064 - DNA, 1071 bp, Artificial Sequence; identical to SEQ ID NO: 153062
  Description of Artificial Sequence: Synthetic coding sequence

SEQ ID NO: 153065 - DNA, 1071 bp, Artificial Sequence; identical to SEQ ID NO: 153062
  Description of Artificial Sequence: Synthetic coding sequence

SEQ ID NO: 153066 - DNA, 1071 bp, Artificial Sequence; identical to SEQ ID NO: 153062
  Description of Artificial Sequence: Synthetic coding sequence

SEQ ID NO: 153067 - DNA, 1071 bp, Artificial Sequence; identical to SEQ ID NO: 144899
  Description of Artificial Sequence: Synthetic coding sequence

SEQ ID NO: 153068 - DNA, 1071 bp, Artificial Sequence; identical to SEQ ID NO: 144899
  Description of Artificial Sequence: Synthetic coding sequence

SEQ ID NO: 153069 - DNA, 1071 bp, Artificial Sequence; identical to SEQ ID NO: 144899
  Description of Artificial Sequence: Synthetic coding sequence

SEQ ID NO: 153070 - DNA, 1071 bp, Artificial Sequence; identical to SEQ ID NO: 144899
  Description of Artificial Sequence: Synthetic coding sequence

SEQ ID NO: 153071 - DNA, 1071 bp, Artificial Sequence; identical to SEQ ID NO: 144899
  Description of Artificial Sequence: Synthetic coding sequence

SEQ ID NO: 153072 - DNA, 498 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggccgctag

SEQ ID NO: 153073 - DNA, 459 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgccctggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgccaggtag

SEQ ID NO: 153074 - DNA, 1071 bp, Artificial Sequence; identical to SEQ ID NO: 144899
  Description of Artificial Sequence: Synthetic coding sequence

SEQ ID NO: 153075 - DNA, 459 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgccaggtag

SEQ ID NO: 153076 - DNA, 498 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgccctggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggccgctag

SEQ ID NO: 153077 - DNA, 273 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgccctggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggctag

SEQ ID NO: 153078 - DNA, 1071 bp, Artificial Sequence; identical to SEQ ID NO: 153062
  Description of Artificial Sequence: Synthetic coding sequence

SEQ ID NO: 153079 - DNA, 1071 bp, Artificial Sequence; identical to SEQ ID NO: 153062
  Description of Artificial Sequence: Synthetic coding sequence

SEQ ID NO: 153080 - DNA, 324 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccacaggtag

SEQ ID NO: 153081 - DNA, 324 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgccctggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccacaggtag

SEQ ID NO: 153082 - DNA, 1071 bp, Artificial Sequence; identical to SEQ ID NO: 153062
  Description of Artificial Sequence: Synthetic coding sequence

SEQ ID NO: 153083 - DNA, 1071 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggcagaggagctgcctgggtgggcgtgtgtgagctgagcggcagagatgctgcccagctggccgaggaggccggcttccctgaggtggccaggatggtgcgggagagccacggggagaccaggagcccagaaaatagaagccccacccccagcctgcagtactgtgagaactgtgacacccacttccaggacagcaaccacaggaccagcacagcccacctgctgagcctgagccagggcccccagccccccaacctgcccctgggcgtgcccatcagcagccctggcttcaagctgctgctgcggcggggctgggagcccggcatgggcctgggccccagaggagagggccgggccaaccccatccccaccgtgctgaagagggaccaggagggcctgggctaccgcagcgccccccagccccgggtgacccacttccctgcctgggacaccagggctgtggccggccgggagaggcctccccgggtggccaccctgtcctggagggaggagcggcggcgggaggagaaggaccgggcctgggagcgggacctgcggacctacatgaacctggagttctag

SEQ ID NO: 153084 - DNA, 1071 bp, Artificial Sequence; identical to SEQ ID NO: 153083
  Description of Artificial Sequence: Synthetic coding sequence

SEQ ID NO: 153085 - DNA, 498 bp, Artificial Sequence; identical to SEQ ID NO: 153072
  Description of Artificial Sequence: Synthetic coding sequence

SEQ ID NO: 153086 - DNA, 1071 bp, Artificial Sequence; identical to SEQ ID NO: 153062
  Description of Artificial Sequence: Synthetic coding sequence

SEQ ID NO: 153087 - DNA, 597 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggcagaggagctgcctgggtgggcgtgtgtgagctgagcggcagagatgctgcccagctggccgaggaggccggcttccctgaggtggccaggatggtgcgggagtag

SEQ ID NO: 153088 - DNA, 1071 bp, Artificial Sequence; identical to SEQ ID NO: 153083
  Description of Artificial Sequence: Synthetic coding sequence

SEQ ID NO: 153089 - DNA, 498 bp, Artificial Sequence; identical to SEQ ID NO: 153076
  Description of Artificial Sequence: Synthetic coding sequence

SEQ ID NO: 153090 - DNA, 459 bp, Artificial Sequence; identical to SEQ ID NO: 153073
  Description of Artificial Sequence: Synthetic coding sequence

SEQ ID NO: 153091 - DNA, 459 bp, Artificial Sequence; identical to SEQ ID NO: 153073
  Description of Artificial Sequence: Synthetic coding sequence

SEQ ID NO: 153092 - DNA, 597 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgccctggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggcagaggagctgcctgggtgggcgtgtgtgagctgagcggcagagatgctgcccagctggccgaggaggccggcttccctgaggtggccaggatggtgcgggagtag

SEQ ID NO: 153093 - DNA, 597 bp, Artificial Sequence; identical to SEQ ID NO: 153092
  Description of Artificial Sequence: Synthetic coding sequence

SEQ ID NO: 153094 - DNA, 1071 bp, Artificial Sequence; identical to SEQ ID NO: 153083
  Description of Artificial Sequence: Synthetic coding sequence

SEQ ID NO: 153095 - DNA, 1071 bp, Artificial Sequence; identical to SEQ ID NO: 144899
  Description of Artificial Sequence: Synthetic coding sequence

SEQ ID NO: 153096 - DNA, 597 bp, Artificial Sequence; identical to SEQ ID NO: 153092
  Description of Artificial Sequence: Synthetic coding sequence

SEQ ID NO: 153097 - DNA, 1071 bp, Artificial Sequence; identical to SEQ ID NO: 144899
  Description of Artificial Sequence: Synthetic coding sequence

SEQ ID NO: 153098 - DNA, 597 bp, Artificial Sequence; identical to SEQ ID NO: 153087
  Description of Artificial Sequence: Synthetic coding sequence

SEQ ID NO: 153099 - DNA, 1071 bp, Artificial Sequence; identical to SEQ ID NO: 153062
  Description of Artificial Sequence: Synthetic coding sequence

SEQ ID NO: 153100 - DNA, 324 bp, Artificial Sequence; identical to SEQ ID NO: 153080
  Description of Artificial Sequence: Synthetic coding sequence

SEQ ID NO: 153101 - DNA, 1071 bp, Artificial Sequence; identical to SEQ ID NO: 153083
  Description of Artificial Sequence: Synthetic coding sequence

SEQ ID NO: 153102 - DNA, 324 bp, Artificial Sequence; identical to SEQ ID NO: 153080
  Description of Artificial Sequence: Synthetic coding sequence

SEQ ID NO: 153103 - DNA, 459 bp, Artificial Sequence; identical to SEQ ID NO: 153075
  Description of Artificial Sequence: Synthetic coding sequence

SEQ ID NO: 153104 - DNA, 1071 bp, Artificial Sequence; identical to SEQ ID NO: 144899
  Description of Artificial Sequence: Synthetic coding sequence

SEQ ID NO: 153105 - DNA, 1071 bp, Artificial Sequence; identical to SEQ ID NO: 144899
  Description of Artificial Sequence: Synthetic coding sequence

SEQ ID NO: 153106 - DNA, 498 bp, Artificial Sequence; identical to SEQ ID NO: 153072
  Description of Artificial Sequence: Synthetic coding sequence

SEQ ID NO: 153107 - DNA, 273 bp, Artificial Sequence; identical to SEQ ID NO: 153077
  Description of Artificial Sequence: Synthetic coding sequence

SEQ ID NO: 153108 - DNA, 1071 bp, Artificial Sequence; identical to SEQ ID NO: 153062
  Description of Artificial Sequence: Synthetic coding sequence

SEQ ID NO: 153109 - DNA, 273 bp, Artificial Sequence; identical to SEQ ID NO: 153077
  Description of Artificial Sequence: Synthetic coding sequence

SEQ ID NO: 153110 - DNA, 1071 bp, Artificial Sequence; identical to SEQ ID NO: 153062
  Description of Artificial Sequence: Synthetic coding sequence

SEQ ID NO: 153111 - DNA, 597 bp, Artificial Sequence; identical to SEQ ID NO: 153087
  Description of Artificial Sequence: Synthetic coding sequence

SEQ ID NO: 153112 - DNA, 324 bp, Artificial Sequence; identical to SEQ ID NO: 153081
  Description of Artificial Sequence: Synthetic coding sequence

SEQ ID NO: 153113 - DNA, 324 bp, Artificial Sequence; identical to SEQ ID NO: 153081
  Description of Artificial Sequence: Synthetic coding sequence

SEQ ID NO: 153114 - DNA, 273 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgcccgggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggctag

SEQ ID NO: 153115 - DNA, 273 bp, Artificial Sequence; identical to SEQ ID NO: 153114
  Description of Artificial Sequence: Synthetic coding sequence

SEQ ID NO: 153116 - DNA, 459 bp, Artificial Sequence; identical to SEQ ID NO: 153075
  Description of Artificial Sequence: Synthetic coding sequence

SEQ ID NO: 153117 - DNA, 597 bp, Artificial Sequence; identical to SEQ ID NO: 153087
  Description of Artificial Sequence: Synthetic coding sequence

SEQ ID NO: 153118 - DNA, 1071 bp, Artificial Sequence; identical to SEQ ID NO: 144899
  Description of Artificial Sequence: Synthetic coding sequence

SEQ ID NO: 153119 - DNA, 1071 bp, Artificial Sequence; identical to SEQ ID NO: 153062
  Description of Artificial Sequence: Synthetic coding sequence

SEQ ID NO: 153120 - DNA, 1071 bp, Artificial Sequence; identical to SEQ ID NO: 153062
  Description of Artificial Sequence: Synthetic coding sequence

SEQ ID NO: 153121 - DNA, 498 bp, Artificial Sequence; identical to SEQ ID NO: 153076
  Description of Artificial Sequence: Synthetic coding sequence

SEQ ID NO: 153122 - DNA, 273 bp, Artificial Sequence; identical to SEQ ID NO: 153114
  Description of Artificial Sequence: Synthetic coding sequence

SEQ ID NO: 153123 - DNA, 324 bp, Artificial Sequence; identical to SEQ ID NO: 153080
  Description of Artificial Sequence: Synthetic coding sequence

SEQ ID NO: 153124 - DNA, 1071 bp, Artificial Sequence; identical to SEQ ID NO: 153062
  Description of Artificial Sequence: Synthetic coding sequence

SEQ ID NO: 153125 - DNA, 1071 bp, Artificial Sequence; identical to SEQ ID NO: 144899
  Description of Artificial Sequence: Synthetic coding sequence

SEQ ID NO: 153126 - DNA, 1071 bp, Artificial Sequence; identical to SEQ ID NO: 144899
  Description of Artificial Sequence: Synthetic coding sequence

SEQ ID NO: 153127 - DNA, 273 bp, Artificial Sequence; identical to SEQ ID NO: 153114
  Description of Artificial Sequence: Synthetic coding sequence

SEQ ID NO: 153128 - DNA, 1071 bp, Artificial Sequence; identical to SEQ ID NO: 144899
  Description of Artificial Sequence: Synthetic coding sequence

SEQ ID NO: 153129 - DNA, 498 bp, Artificial Sequence; identical to SEQ ID NO: 153072
  Description of Artificial Sequence: Synthetic coding sequence

SEQ ID NO: 153130 - DNA, 459 bp, Artificial Sequence; identical to SEQ ID NO: 153075
  Description of Artificial Sequence: Synthetic coding sequence

SEQ ID NO: 153131 - DNA, 4509 bp, Artificial Sequence
  Description of Artificial Sequence: Synthetic coding sequence
atggctgaccgcttcagccgcttcaatgaagatcgggacttccagggcaaccactttgaccagtatgaggagggccacctggagattgagcaggccagcctggacaagcccatcgagagtgacaacatcggccaccggctgctgcagaagcacggctggaagctgggccagggcctgggcaagagcctgcagggccgcacagaccccatccccatcgtggtgaagtatgatgtgatgggcatgggccgcatggagatggagctggactatgcagaagatgccacagaaagaagaagagtgctggaggtggagaaggaggacacagaggagctgcggcagaagtacaaggactatgtggacaaggagaaggccatcgccaaggccctggaggacctgcgggccaacttctactgtgagctgtgtgacaagcagtaccagaagcaccaggagtttgacaaccacatcaacagctatgaccacgcccacaagcagaggctgaaggacctgaagcagcgggagtttgccagaaatgtgagcagccgcagcaggaaggatgagaagaagcaggagaaggccctgcggcggctgcacgagctggccgagcagaggaagcaggctgaatgtgcccctggcagcggccccatgttcaagcccaccaccgtggccgtggatgaggagggcggagaagatgacaaggatgaaagtgccaccaacagcggcactggagccacagccagctgtggcctgggcagcgagttcagcacagacaagggcggccccttcaccgctgtgcagatcaccaacaccaccggcctggcccaggcccctggcctggccagccagggcatcagctttggcatcaagaacaacctgggcacccccctgcagaagctgggcgtgtccttctcctttgccaagaaggcccctgtgaagctggagagcatcgcctctgtgttcaaggaccatgctgaggagggcaccagtgaagatggcaccaagccagatgagaagagcagtgaccagggcctgcagaaggtgggggacagtgatggcagcagcaacctggatggcaagaaggaggatgaggacccccaggacggcggcagcctggccagcaccctgagcaagctgaagaggatgaagcgggaggagggcgctggggccacagagcctgagtactaccactacatccccccagcccactgcaaggtgaagcccaacttccccttcctgctcttcatgagggccagcgagcagatggatggagacaacaccacccaccccaagaatgcccctgagagcaagaagggcagcagccccaagcccaagagctgcatcaaggctgctgccagccagggcgctgagaagacagtgtctgaggtgtctgagcagcccaaggagacctccatgacagagcccagcgagcccggcagcaaggccgaggccaagaaggccctgggcggagatgtgtctgaccagagcctggagagccacagccagaaggtgtctgagacccagatgtgtgagagcaacagcagcaaggagaccagcctggccaccccagctgggaaggagagccaggagggccccaagcaccccaccggccccttcttccctgtgctgagcaaggatgagagcacagccctgcagtggcccagcgagctgctgatcttcaccaaggccgagcccagcatctcctacagctgcaaccccctgtactttgacttcaagctgagcaggaacaaggatgcccggaccaagggcacagagaagcccaaggacatcggcagcagcagcaaggaccacctgcagggcctggaccccggggagcccaacaagagcaaggaggtgggcggggagaagatcgtgcgcagcagcggcggccgcatggatgccccagccagcggcagcgcctgcagcggcctgaacaagcaggagcccggcggcagccacggcagcgagacagaggacaccggccgcagcctgcccagcaagaaggagaggtctgggaagagccaccgccacaagaagaagaagaagcacaagaagagcagcaagcacaagaggaagcacaaggctgacacagaggagaagagcagcaaggccgagagcggggagaagagcaagaagaggaagaagaggaagaggaagaagaacaagagcagcgccccagctgacagcgagcggggccccaagccagagcccccaggcagcggcagccctgcccccccaagaagaagaagaagagcccaggatgacagccagaggaggagcctgcctgctgaggagggcagcagcggcaagaaggatgagggcggcggcggcagcagcagccaggaccatggaggcaggaagcacaagggggagctgccccccagcagctgccagaggagagctggcaccaagaggagcagccgcagcagccacaggagccagcccagcagtggagatgaggacagtgatgatgccagcagccaccggctgcaccagaagagccccagccagtacagcgaggaggaggaggaggaggacagcggcagcgagcacagccgcagccgcagccgcagcggccgccgccacagcagccacaggagcagcagaagaagctacagcagcagcagtgatgccagcagtgaccagagctgctacagccggcagaggagctacagtgatgacagctacagcgactacagcgacaggagccgccgccacagcaagaggagccatgacagtgatgacagcgactatgccagcagcaagcacaggagcaagaggcacaagtacagcagcagtgatgatgactacagcctgagctgcagccagagccgcagccgcagccgcagccacacccgggagaggagccgcagccggggccgcagccgcagcagcagctgcagccgcagccgcagcaagaggaggagccgcagcaccacagcccacagctggcagaggagccgcagctacagccgggacaggagccgcagcaccaggagccccagccagaggagcggcagcaggaagaggtcctggggccacgagagccctgaggagcggcacagcggccggcgggacttcatccgcagcaagatctaccgcagccagagcccccactacttccgcagcggccgcggggagggccctgggaagaaggatgatggaagaggagatgacagcaaggccactggaccacccagccagaacagcaacatcggcaccggccggggcagcgagggggactgcagccctgaggacaagaacagcgtgacagccaagctgctgctggagaagatccagagcaggaaggtggagaggaagcccagcgtgtctgaggaggtgcaggccacccccaacaaggccggccccaagctgaaggaccccccccagggctacttcggccccaagctgccccccagcctgggcaacaagcctgtgctgcccctcatcggcaagctgcctgccaccaggaagcccaacaagaagtgtgaggagagcggcctggagcggggggaggagcaggagcagagcgagacagaggagggccccccaggcagcagtgatgccctgtttggccaccagttccccagcgaggagaccaccggccccctgctggaccccccacctgaggagagcaagagcggggaggccacagctgaccaccctgtggcccccctgggcaccccagcccacagcgactgctacccaggggaccccaccatcagccacaactacctgcctgaccccagtgatggagacaccctggagagcctggacagcagcagccagcccggccctgtggagagcagcctgctgcccatcgccccagacctggagcacttccccagctatgccccacccagcggggaccccagcattgagagcacagatggagcagaagatgccagcctggcccccctggagagccagcccatcaccttcaccccagaggagatggagaagtacagcaagctgcagcaggccgcccagcagcacatccagcagcagctgctggccaagcaggtgaaggccttccctgccagcgctgccctggccccagccaccccagccctgcagcccatccacatccagcagcctgccacagccagcgccaccagcatcaccaccgtgcagcacgccatcctgcagcaccacgccgctgctgctgctgctgccatcggcatccacccccacccccacccccagcccctggcccaggtgcaccacatcccccagccccacctgacccccatcagcctgagccacctgacccacagcatcatccctggccacccagccaccttcctggccagccaccccatccacatcatcccagccagcgccatccaccctggccccttcaccttccaccctgtgccccacgccgccctgtaccccaccctgctggcccccaggcctgctgctgctgctgccacagccctgcacctgcaccccctgctgcaccccatcttcagcggccaggacctgcagcacccccccagccacggcacctag

SEQ ID NO: 153132 - DNA, 4275 bp, Artificial Sequence
  Description of Artificial Sequence: Synthetic coding sequence
atgggcatgggccgcatggagatggagctggactatgcagaagatgccacagaaagaagaagagtgctggaggtggagaaggaggacacagaggagctgcggcagaagtacaaggactatgtggacaaggagaaggccatcgccaaggccctggaggacctgcgggccaacttctactgtgagctgtgtgacaagcagtaccagaagcaccaggagtttgacaaccacatcaacagctatgaccacgcccacaagcagaggctgaaggacctgaagcagcgggagtttgccagaaatgtgagcagccgcagcaggaaggatgagaagaagcaggagaaggccctgcggcggctgcacgagctggccgagcagaggaagcaggctgaatgtgcccctggcagcggccccatgttcaagcccaccaccgtggccgtggatgaggagggcggagaagatgacaaggatgaaagtgccaccaacagcggcactggagccacagccagctgtggcctgggcagcgagttcagcacagacaagggcggccccttcaccgctgtgcagatcaccaacaccaccggcctggcccaggcccctggcctggccagccagggcatcagctttggcatcaagaacaacctgggcacccccctgcagaagctgggcgtgtccttctcctttgccaagaaggcccctgtgaagctggagagcatcgcctctgtgttcaaggaccatgctgaggagggcaccagtgaagatggcaccaagccagatgagaagagcagtgaccagggcctgcagaaggtgggggacagtgatggcagcagcaacctggatggcaagaaggaggatgaggacccccaggacggcggcagcctggccagcaccctgagcaagctgaagaggatgaagcgggaggagggcgctggggccacagagcctgagtactaccactacatccccccagcccactgcaaggtgaagcccaacttccccttcctgctcttcatgagggccagcgagcagatggatggagacaacaccacccaccccaagaatgcccctgagagcaagaagggcagcagccccaagcccaagagctgcatcaaggctgctgccagccagggcgctgagaagacagtgtctgaggtgtctgagcagcccaaggagacctccatgacagagcccagcgagcccggcagcaaggccgaggccaagaaggccctgggcggagatgtgtctgaccagagcctggagagccacagccagaaggtgtctgagacccagatgtgtgagagcaacagcagcaaggagaccagcctggccaccccagctgggaaggagagccaggagggccccaagcaccccaccggccccttcttccctgtgctgagcaaggatgagagcacagccctgcagtggcccagcgagctgctgatcttcaccaaggccgagcccagcatctcctacagctgcaaccccctgtactttgacttcaagctgagcaggaacaaggatgcccggaccaagggcacagagaagcccaaggacatcggcagcagcagcaaggaccacctgcagggcctggaccccggggagcccaacaagagcaaggaggtgggcggggagaagatcgtgcgcagcagcggcggccgcatggatgccccagccagcggcagcgcctgcagcggcctgaacaagcaggagcccggcggcagccacggcagcgagacagaggacaccggccgcagcctgcccagcaagaaggagaggtctgggaagagccaccgccacaagaagaagaagaagcacaagaagagcagcaagcacaagaggaagcacaaggctgacacagaggagaagagcagcaaggccgagagcggggagaagagcaagaagaggaagaagaggaagaggaagaagaacaagagcagcgccccagctgacagcgagcggggccccaagccagagcccccaggcagcggcagccctgcccccccaagaagaagaagaagagcccaggatgacagccagaggaggagcctgcctgctgaggagggcagcagcggcaagaaggatgagggcggcggcggcagcagcagccaggaccatggaggcaggaagcacaagggggagctgccccccagcagctgccagaggagagctggcaccaagaggagcagccgcagcagccacaggagccagcccagcagtggagatgaggacagtgatgatgccagcagccaccggctgcaccagaagagccccagccagtacagcgaggaggaggaggaggaggacagcggcagcgagcacagccgcagccgcagccgcagcggccgccgccacagcagccacaggagcagcagaagaagctacagcagcagcagtgatgccagcagtgaccagagctgctacagccggcagaggagctacagtgatgacagctacagcgactacagcgacaggagccgccgccacagcaagaggagccatgacagtgatgacagcgactatgccagcagcaagcacaggagcaagaggcacaagtacagcagcagtgatgatgactacagcctgagctgcagccagagccgcagccgcagccgcagccacacccgggagaggagccgcagccggggccgcagccgcagcagcagctgcagccgcagccgcagcaagaggaggagccgcagcaccacagcccacagctggcagaggagccgcagctacagccgggacaggagccgcagcaccaggagccccagccagaggagcggcagcaggaagaggtcctggggccacgagagccctgaggagcggcacagcggccggcgggacttcatccgcagcaagatctaccgcagccagagcccccactacttccgcagcggccgcggggagggccctgggaagaaggatgatggaagaggagatgacagcaaggccactggaccacccagccagaacagcaacatcggcaccggccggggcagcgagggggactgcagccctgaggacaagaacagcgtgacagccaagctgctgctggagaagatccagagcaggaaggtggagaggaagcccagcgtgtctgaggaggtgcaggccacccccaacaaggccggccccaagctgaaggaccccccccagggctacttcggccccaagctgccccccagcctgggcaacaagcctgtgctgcccctcatcggcaagctgcctgccaccaggaagcccaacaagaagtgtgaggagagcggcctggagcggggggaggagcaggagcagagcgagacagaggagggccccccaggcagcagtgatgccctgtttggccaccagttccccagcgaggagaccaccggccccctgctggaccccccacctgaggagagcaagagcggggaggccacagctgaccaccctgtggcccccctgggcaccccagcccacagcgactgctacccaggggaccccaccatcagccacaactacctgcctgaccccagtgatggagacaccctggagagcctggacagcagcagccagcccggccctgtggagagcagcctgctgcccatcgccccagacctggagcacttccccagctatgccccacccagcggggaccccagcattgagagcacagatggagcagaagatgccagcctggcccccctggagagccagcccatcaccttcaccccagaggagatggagaagtacagcaagctgcagcaggccgcccagcagcacatccagcagcagctgctggccaagcaggtgaaggccttccctgccagcgctgccctggccccagccaccccagccctgcagcccatccacatccagcagcctgccacagccagcgccaccagcatcaccaccgtgcagcacgccatcctgcagcaccacgccgctgctgctgctgctgccatcggcatccacccccacccccacccccagcccctggcccaggtgcaccacatcccccagccccacctgacccccatcagcctgagccacctgacccacagcatcatccctggccacccagccaccttcctggccagccaccccatccacatcatcccagccagcgccatccaccctggccccttcaccttccaccctgtgccccacgccgccctgtaccccaccctgctggcccccaggcctgctgctgctgctgccacagccctgcacctgcaccccctgctgcaccccatcttcagcggccaggacctgcagcacccccccagccacggcacctag

SEQ ID NO: 153133 - DNA, 132 bp, Artificial Sequence
  Description of Artificial Sequence: Synthetic coding sequence
atggctgaccgcttcagccgcttcaatgaagatcgggacttccagggcaaccactttgaccagtatgaggagggccacctggagattgagcaggccagcctggacaagcccatcgagagcagctgcttctag

SEQ ID NO: 153134 - DNA, 4509 bp, Artificial Sequence; identical to SEQ ID NO: 153131
  Description of Artificial Sequence: Synthetic coding sequence

SEQ ID NO: 153135 - DNA, 1476 bp, Artificial Sequence
  Description of Artificial Sequence: Synthetic coding sequence
atgcccctgcctgtgcaggtgttcaacctgcagggcgctgtggagcccatgcagattgatgtggacccccaggaggacccccagaatgccccagatgtgaactacgtggtggagaaccccagcctggacctggagcagtatgctgccagctacagcggcctgatgagaattgagcggctgcagttcatcgctgaccactgccccaccctgcgggtggaggccctgaagatggccctgagctttgtgcagaggaccttcaacgtggacatgtatgaggagatccacaggaagctgtctgaggccaccaggagcagcctgcgggagctgcagaatgccccagatgccatccctgagagcggcgtggagcccccagccctggacacagcctgggtggaggccaccaggaagaaggccctgctgaagctggagaagctggacacagacctgaagaactacaagggcaacagcatcaaggagagcatccggcggggccatgatgacctgggggaccactacctggactgtggggacctgagcaatgccctgaagtgctacagccgggcccgggactactgcaccagcgccaagcacgtgatcaacatgtgcctgaatgtcatcaaggtgtctgtgtacctgcagaactggagccacgtgctgtcctatgtgtccaaggccgagagcaccccagaaattgctgagcagagaggagagcgggacagccagacccaggccatcctgaccaagctgaagtgtgccgccggcctggccgagctggccgccaggaagtacaagcaggccgccaagtgcctgctgctggccagctttgaccactgtgacttccctgagctgctgagccccagcaatgtggccatctacggcggcctgtgtgccctggccacctttgaccggcaggagctgcagagaaatgtcatcagcagcagcagcttcaagctgttcctggagctggagccccaggtgcgggacatcatcttcaagttctatgagagcaaatatgccagctgcctgaagatgctggatgagatgaaggacaacctgctgctggacatgtacctggcccctcatgtgaggaccctgtacacccagatccggaacagagccctgatccagtacttcagcccctacgtgtctgctgacatgcacaggatggctgctgccttcaacaccaccgtggccgccctggaggatgagctgacccagctgatcctggagggcctcatcagcgcccgggtggacagccacagcaagatcctgtatgccagagatgtggaccagaggagcaccacctttgagaagagcctgctgatgggcaaggagttccagaggcgggccaaggccatgatgctgcgggctgctgtgctgaggaaccagatccacgtgaagagccccccccgggagggcagccagggcgagctgaccccagccaacagccagagcaggatgagcaccaacatgtag

SEQ ID NO: 153136 - DNA, 1653 bp, Artificial Sequence
  Description of Artificial Sequence: Synthetic coding sequence
atgcccctgcctgtgcaggtgttcaacctgcagcagcctgccagctctgtgtctggcagcggcggcgctgagagccaggacaggatgagggacagcagcgcccccagcagcgccagcagctctgtgacagacctgtactgcaccccccacagcagcagaagtgacctggtgctgcctggaacagctggggacttcagcctgagcgccagcctgagcgcctgcaccctgctgtatgagggcgctgtggagcccatgcagattgatgtggacccccaggaggacccccagaatgccccagatgccatccctgagagcggcgtggagcccccagccctggacacagcctgggtggaggccaccaggaagaaggccctgctgaagctggagaagctggacacagacctgaagaactacaagggcaacagcatcaaggagagcatccggcggggccatgatgacctgggggaccactacctggactgtggggacctgagcaatgccctgaagtgctacagccgggcccgggactactgcaccagcgccaagcacgtgatcaacatgtgcctgaatgtcatcaaggtgtctgtgtacctgcagaactggagccacgtgctgtcctatgtgtccaaggccgagagcaccccagaaattgctgagcagagaggagagcgggacagccagacccaggccatcctgaccaagctgaagtgtgccgccggcctggccgagctggccgccaggaagtacaagcaggccgccaagtgcctgctgctggccagctttgaccactgtgacttccctgagctgctgagccccagcaatgtggccatctacggcggcctgtgtgccctggccacctttgaccggcaggagctgcagagaaatgtcatcagcagcagcagcttcaagctgttcctggagctggagccccaggtgcgggacatcatcttcaagttctatgagagcaaatatgccagctgcctgaagatgctggatgagatgaaggacaacctgctgctggacatgtacctggcccctcatgtgaggaccctgtacacccagatccggaacagagccctgatccagtacttcagcccctacgtgtctgctgacatgcacaggatggctgctgccttcaacaccaccgtggccgccctggaggatgagctgacccagctgatcctggagggcctcatcagcgcccgggtggacagccacagcaagatcctgtatgccagagatgtggaccagaggagcaccacctttgagaagagcctgctgatgggcaaggagttccagaggcgggccaaggccatgatgctgcgggctgctgtgctgaggaaccagatccacgtgaagcccctgcccaccagcacagacctgggccccccaggcggctctgtgctgcctgctgcccagctgcggggcctggccaccggctgccacccagcctgtgtgcccagcctgggcctgcggcggcaggccgccgccagctgtggccccagctggaaggagaggcctgctggcctggaccctgtgggcttctgcccccagggcgctgactgtgccgccccccggcccagcggcaccatcagccagaccccacctgtgcctgcctctgtgcgctgccggcaggtgggcggcgtgcactag

SEQ ID NO: 153137 - DNA, 1584 bp, Artificial Sequence
  Description of Artificial Sequence: Synthetic coding sequence
atgagggacagcagcgcccccagcagcgccagcagctctgtgacagacctgtactgcaccccccacagcagcagaagtgacctggtgctgcctggaacagctggggacttcagcctgagcgccagcctgagcgcctgcaccctgctgtatgagggcgctgtggagcccatgcagattgatgtggacccccaggaggacccccagaatgccccagatgtgaactacgtggtggagaaccccagcctggacctggagcagtatgctgccagctacagcggcctgatgagaattgagcggctgcagttcatcgctgaccactgccccaccctgcgggtggaggccctgaagatggccctgagctttgtgcagaggaccttcaacgtggacatgtatgaggagatccacaggaagctgtctgaggccacccgggagctgcagaatgccccagatgccatccctgagagcggcgtggagcccccagccctggacacagcctgggtggaggccaccaggaagaaggccctgctgaagctggagaagctggacacagacctgaagaactacaagggcaacagcatcaaggagagcatccggcggggccatgatgacctgggggaccactacctggactgtggggacctgagcaatgccctgaagtgctacagccgggcccgggactactgcaccagcgccaagcacgtgatcaacatgtgcctgaatgtcatcaaggtgtctgtgtacctgcagaactggagccacgtgctgtcctatgtgtccaaggccgagagcaccccagaaattgctgagcagagaggagagcgggacagccagacccaggccatcctgaccaagctgaagtgtgccgccggcctggccgagctggccgccaggaagtacaagcaggccgccaagtgcctgctgctggccagctttgaccactgtgacttccctgagctgctgagccccagcaatgtggccatctacggcggcctgtgtgccctggccacctttgaccggcaggagctgcagagaaatgtcatcagcagcagcagcttcaagctgttcctggagctggagccccaggtgcgggacatcatcttcaagttctatgagagcaaatatgccagctgcctgaagatgctggatgagatgaaggacaacctgctgctggacatgtacctggcccctcatgtgaggaccctgtacacccagatccggaacagagccctgatccagtacttcagcccctacgtgtctgctgacatgcacaggatggctgctgccttcaacaccaccgtggccgccctggaggatgagctgacccagctgatcctggagggcctcatcagcgcccgggtggacagccacagcaagatcctgtatgccagagatgtggaccagaggagcaccacctttgagaagagcctgctgatgggcaaggagttccagaggcgggccaaggccatgatgctgcgggctgctgtgctgaggaaccagatccacgtgaagagccccccccgggagggcagccagggcgagctgaccccagccaacagccagagcaggatgagcaccaacatgtag

SEQ ID NO: 153138 - DNA, 855 bp, Artificial Sequence
  Description of Artificial Sequence: Synthetic coding sequence
ggccagcctgagattggaggcttcctgcccagcagcctggcccctgtgacagctgccatcctgatggcccggagcagcctgcgggagctgcagaatgccccagatgccatccctgagagcggcgtggagcccccagccctggacacagcctgggtggaggccaccaggaagaaggccctgctgaagctggagaagctggacacagacctgaagaactacaagggcaacagcatcaaggagagcatcagaagaggacatgatgacctgggggaccactacctggactgtggggacctgagcaatgccctgaagtgctacagccgggcccgggactactgcaccagcgccaagcacgtgatcaacatgtgcctgaatgtcatcaaggtgtctgtgtacctgcagaactggagccacgtgctgtcctatgtgtccaaggccgagagcaccccagaaattgctgaggtgcgggccaccagcagcgagaccctgcccccaggcttcctgaccacagctggccccagctgccccccaccaccccacagccccccagacctgaacctgcccagcagccccctgagcctgggcgccggccaccgggccctgggcaatgtggagcacggcccccacgcctgtggcttcctgctgcagcagagaggagagcgggacagccagacccaggccatcctgaccaagctgaagtgtgccgccggggagggcctgggccacgcccagctgacccccaggagccctgtggccaagagcagccagcccagggctgtgggctggagcctgccccagcccgggaagaccagcctggccggccgcaggatgctgtgggcccacgtgcaggtgtag

SEQ ID NO: 153139 - DNA, 1584 bp, Artificial Sequence; identical to SEQ ID NO: 153137
  Description of Artificial Sequence: Synthetic coding sequence

SEQ ID NO: 153140 - DNA, 993 bp, Artificial Sequence
  Description of Artificial Sequence: Synthetic coding sequence
atgacccccaacagcactggagaggtgcccagccccatccccaagggggccctgggcctgagcctggccctggccagcctcatcatcacagccaacctgctgctggccctgggcatcgcctgggaccggcggctgcggagccccccagctggctgcttcttcctgagcctgctgctggccggcctgctgaccggcctggccctgcccaccctgcccggcctgtggaaccagagcagaagaggctactggagctgcctgctggtgtacctggcccccaacttctccttcctgagcctgctggccaacctgctgctggtgcatggagagcgctacatggctgtgctgcggcccctgcagcccccaggcagcatccggctggccctgctgctgacctgggccggccccctgctgtttgccagcctgcctgccctgggctggaaccactggacccctggggccaactgcagcagccaggccatcttccctgccccctacctgtacctggaggtgtatggcctgctgctgcctgctgtgggcgctgctgccttcctgtctgtgcgggtgctggccacagcccaccggcagctgcaggacatctgccgcctggagagagctgtgtgcagagatgagcccagcgccctggcccgggccctgacctggaggcaggcccgggcccaggccggggccatgctgctgtttggcctgtgctggggcccctacgtggccaccctgctgctgtctgtgctggcctatgagcagaggcctcccctgggccctggcaccctgctgagcctgctgagcctgggcagcgccagcgctgctgctgtgcctgtggccatgggcctgggggaccagcgctacacagccccctggagggctgctgcccagcgctgcctgcagggcctgtggggccgggccagccgggacagccctggccccagcatcgcctaccaccccagcagccagagctctgtggacctggacctgaactag

SEQ ID NO: 153141 - DNA, 993 bp, Artificial Sequence; identical to SEQ ID NO: 153140
  Description of Artificial Sequence: Synthetic coding sequence

SEQ ID NO: 153142 - DNA, 993 bp, Artificial Sequence; identical to SEQ ID NO: 153140
  Description of Artificial Sequence: Synthetic coding sequence

SEQ ID NO: 153143 - DNA, 993 bp, Artificial Sequence; identical to SEQ ID NO: 153140
  Description of Artificial Sequence: Synthetic coding sequence

SEQ ID NO: 153144 - DNA, 1128 bp, Artificial Sequence
  Description of Artificial Sequence: Synthetic coding sequence
atggatgtgaccagccaggcccggggcgtgggcctggagatgtacccaggcacagcccagcctgctgcccccaacaccaccagccctgagctgaacctgagccaccccctgctgggcacagccctggccaacggcaccggggagctgtctgagcaccagcagtatgtgattggcctcttcctgagctgcctgtacaccatcttcctgttccccatcggctttgtgggcaacatcctgatcctggtggtgaacatctccttccgggagaagatgaccatcccagacctgtacttcatcaacctggccgtggccgacctgatcctggtggccgacagcctcatcgaggtgttcaacctgcacgagcgctactatgacattgctgtgctgtgcaccttcatgagcctcttcctgcaggtgaacatgtacagcagcgtcttcttcctgacctggatgagctttgaccgctacatcgccctggcccgggccatgcgctgcagcctcttccgcaccaagcaccacgcccggctgagctgtggcctcatctggatggcctctgtgtctgccaccctggtgcccttcaccgctgtgcacctgcagcacacagatgaggcctgcttctgctttgctgatgtgcgggaggtgcagtggctggaggtgaccctgggcttcatcgtgccctttgccatcatcggcctgtgctacagcctgattgtgcgggtgctggtgcgggcccaccgccaccggggcctgcggccccggcggcagaaggccctgaggatgatcctggccgtggtgctggtgttctttgtgtgctggctgcctgaaaatgtgttcatctctgtgcacctgctgcagaggacccagcctggagctgccccctgcaagcagagcttcagacatgcccaccccctgaccggccacatcgtgaacctggccgccttcagcaacagctgcctgaaccccctcatctacagcttcctgggggagaccttccgggacaagctgcggctgtacatcgagcagaagaccaacctgcctgccctgaaccgcttctgccacgccgccctgaaggccgtcatcccagacagcacagagcagagtgatgtgcgcttcagcagcgctgtgtag

SEQ ID NO: 153145 - DNA, 531 bp, Artificial Sequence
  Description of Artificial Sequence: Synthetic coding sequence
atgagcctgaactgtggccagatgtggctgctggccccccggggcctggcccgggtgaccctggcctggagcccctggggctgcctgggcaacctgaccaccggccacctggccctgctgacccagaactgctacaaccccaaggccctggccccccagggccccaaggccagcggggaccagcctgtgacccagctgctgcctgccaacccagcctgccgctgcacctgcctgcccctgcaggagaccttcctgtctgtgctgcacctgcccggctggcagcagtggaggtgtgccgccagccctggccccagaggagctgctgccctgggccctgagcagcaggagggccccagcgtggagaggcctccttctgcccctggctggttcagccactgcctgctgaccagcacctggcagctgcacagctgtggcctgggcccctgtgagctgccctgtggcctggtgggctgccaggacaatgagatcctgcagcacctgtggctgaccaacctcttcctgcagaagtag

SEQ ID NO: 153146 - DNA, 1128 bp, Artificial Sequence; identical to SEQ ID NO: 153144
  Description of Artificial Sequence: Synthetic coding sequence

SEQ ID NO: 153147 - DNA, 1128 bp, Artificial Sequence; identical to SEQ ID NO: 153144
  Description of Artificial Sequence: Synthetic coding sequence

SEQ ID NO: 153148 - DNA, 1128 bp, Artificial Sequence; identical to SEQ ID NO: 153144
  Description of Artificial Sequence: Synthetic coding sequence

SEQ ID NO: 153149 - DNA, 222 bp, Artificial Sequence
  Description of Artificial Sequence: Synthetic coding sequence
atggatgtgaccagccaggcccggggcgtgggcctggagatgtacccaggcacagcccagcctgctgcccccaacaccaccagccctgagctgaacctgagccaccccctgctgggcacagccctggccaacggcaccggggagctgtctgagcaccagcagtatgtgattggcctcttcctgagctgcctgtacaccatcttcctgttccccatcggctag

SEQ ID NO: 153150 - DNA, 1227 bp, Artificial Sequence
  Description of Artificial Sequence: Synthetic coding sequence
atggatgtgaccagccaggcccggggcgtgggcctggagatgtacccaggcacagcccagcctgctgcccccaacaccaccagccctgagctgaacctgagccaccccctgctgggcacagccctggccaacggcaccggggagctgtctgagcaccagcagtatgtgattggcctcttcctgagctgcctgtacaccatcttcctgttccccatcggctttgtgggcaacatcctgatcctggtggtgaacatctccttccgggagaagatgaccatcccagacctgtacttcatcaacctggccgtggccgacctgatcctggtggccgacagcctcatcgaggtgttcaacctgcacgagcgctactatgacattgctgtgctgtgcaccttcatgagcctcttcctgcaggtgaacatgtacagcagcgtcttcttcctgacctggatgagctttgaccgctacatcgccctggcccgggccatgcgctgcagcctcttccgcaccaagcaccacgcccggctgagctgtggcctcatctggatggcctctgtgtctgccaccctggtgcccttcaccgctgtgcacctgcagcacacagatgaggcctgcttctgctttgctgatgtgcgggaggtgcagtggctggaggtgaccctgggcttcatcgtgccctttgccatcatcggcctgtgctacagcctgattgtgcgggtgctggtgcgggcccaccgccaccggggcctgcggccccggcggcagaaggccctgaggatgatcctggccgtggtgctggtgttctttgtgtgctggctgcctgaaaatgtgttcatctctgtgcacctgctgcagaggacccagcctggagctgccccctgcaagcagagcttcagacatgcccaccccctgacccacggccacgtgatgagcctgaactgtggccagatgtggctgctggccccccggggcctggcccgggtgaccctggcctggagcccctggggctgcctgggcaacctgaccaccggccacctggccctgctgacccagaactgctacaaccccaaggccctggccccccagggccccaaggccagcggggaccagcctgtgacccagctgctgcctgccaacccagcctgccgctgcacctgcctgcccctgcaggagaccttcctgacccccagcaccaggaaggccacccggcggggccactgcggctag

SEQ ID NO: 153151 - DNA, 1068 bp, Artificial Sequence
  Description of Artificial Sequence: Synthetic coding sequence
atggaggacctggaggagaccctgtttgaggagtttgagaactacagctatgacctggactactacagcctggagagtgacctggaggagaaggtgcagctgggcgtggtgcactgggtgtccctggtgctgtactgcctggcctttgtgctgggcatccctggaaatgccatcgtcatctggttcaccggcttcaagtggaagaagacagtgaccaccctgtggttcctgaacctggccatcgctgacttcatcttcctgctcttcctgcccctgtacatctcctatgtggccatgaacttccactggcccttcggcatctggctgtgcaaggccaacagcttcaccgcccagctgaacatgtttgccagcgtcttcttcctgaccgtcatcagcctggaccactacatccacctgatccaccctgtgctgagccaccgccacaggaccctgaagaacagcctcatcgtcatcatcttcatctggctgctggccagcctcatcggcggccctgccctgtacttccgggacacagtggagttcaacaaccacaccctgtgctacaacaacttccagaagcatgaccctgacctgaccctcatccgccaccacgtgctgacctgggtgaagttcatcatcggctacctgttccccctgctgaccatgagcatctgctacctgtgcctgatcttcaaggtgaagaagaggagcatcctgatcagcagccgccacttctggaccatcctggtggtggtggtggcctttgtggtgtgctggaccccctaccacctgttcagcatctgggagctgaccatccaccacaacagctacagccaccacgtgatgcaggccggcatccccctgagcacaggcctggccttcctgaacagctgcctgaaccccatcctgtatgtgctgatcagcaagaagttccaggcccgcttccgcagctctgtggccgagatcctgaagtacaccctgtgggaggtgtcctgcagcggcaccgtgtctgagcagctgagaaattctgagaccaagaacctgtgcctgctggagacagcccagtag

SEQ ID NO: 153152 - DNA, 225 bp, Artificial Sequence
  Description of Artificial Sequence: Synthetic coding sequence
atggaggacctggaggagaccctgtttgaggagtttgagaactacagctatgacctggactactacagcctggagagtgacctggaggagaaggtgcagctgggcgtggtgcactgggtgtccctggtgctgtactgcctggcctttgtgctgggcatccctggaaatgccatcgtcatctggttcaccggcttcaagtggaagaagacagtgaccaccctgtag

SEQ ID NO: 153153 - DNA, 1068 bp, Artificial Sequence; identical to SEQ ID NO: 153151
  Description of Artificial Sequence: Synthetic coding sequence

SEQ ID NO: 153154 - DNA, 249 bp, Artificial Sequence
  Description of Artificial Sequence: Synthetic coding sequence
atggaggacctggaggagaccctgtttgaggagtttgagaactacagctatgacctggactactacagcctggagagtgacctggaggagaaggtgcagctgggcgtggtgcactgggtgtccctggtgctgtactgcctggcctttgtgctgggcatccctggaaatgccatcgtcatctggttcaccggcttcaagtggaagaagacagtgaccaccctgtggttcctgaacctggccatcgcctag

SEQ ID NO: 153155 - DNA, 684 bp, Artificial Sequence
  Description of Artificial Sequence: Synthetic coding sequence
atggaggacctggaggagaccctgtttgaggagtttgagaactacagctatgacctggactactacagcctggagagtgacctggaggagaaggtgcagctgggcgtggtgcactgggtgtccctggtgctgtactgcctggcctttgtgctgggcatccctggaaatgccatcgtcatctggttcaccggcttcaagtggaagaagacagtgaccaccctgtggttcctgaacctggccatcgctgacttcatcttcctgctcttcctgcccctgtacatctcctatgtggccatgaacttccactggcccttcggcatctggctgtgcaaggccaacagcttcaccgcccagctgaacatgtttgccagcgtcttcttcctgaccgtcatcagcctggaccactacatccacctgatccaccctgtgctgagccaccgccacaggaccctgaagaacagcctcatcgtcatcatcttcatctggctgctggccagcctcatcggcggccctgccctgtacttccgggacacagtggagttcaacaaccacaccctgtgctacaacaacttccagaagcatgaccctgacctgaccctcatccgccaccacgtgctgacctgggtgaagttcatcatcggctacctgttccccctgctgaccatgagcatctgctacctgtag

SEQ ID NO: 153156 - DNA, 414 bp, Artificial Sequence
  Description of Artificial Sequence: Synthetic coding sequence
atggaggacctggaggagaccctgtttgaggagtttgagaactacagctatgacctggactactacagcctggagagtgacctggaggagaaggtgcagctgggcgtggtgcactgggtgtccctggtgctgtactgcctggcctttgtgctgggcatccctggaaatgccatcgtcatctggttcaccggcttcaagtggaagaagacagtgaccaccctgtggttcctgaacctggccatcgctgacttcatcttcctgctcttcctgcccctgtacatctcctatgtggccatgaacttccactggcccttcggcatctggctgtgcaaggccaacagcttcaccgcccagctgaacatgtttgccagcgtcttcttcctgaccgtcatcagcctggaccactacatctag

SEQ ID NO: 153157 - DNA, 537 bp, Artificial Sequence
  Description of Artificial Sequence: Synthetic coding sequence
atggaggacctggaggagaccctgtttgaggagtttgagaactacagctatgacctggactactacagcctggagagtgacctggaggagaaggtgcagctgggcgtggtgcactgggtgtccctggtgctgtactgcctggcctttgtgctgggcatccctggaaatgccatcgtcatctggttcaccggcttcaagtggaagaagacagtgaccaccctgtggttcctgaacctggccatcgctgacttcatcttcctgctcttcctgcccctgtacatctcctatgtggccatgaacttccactggcccttcggcatctggctgtgcaaggccaacagcttcaccgcccagctgaacatgtttgccagcgtcttcttcctgaccgtcatcagcctggaccactacatccacctgatccaccctgtgctgagccaccgccacaggaccctgaagaacagcctcatcgtcatcatcttcatctggctgctggccagcctcatcggcggccctgccctgtacttccgggacacctag

SEQ ID NO: 153158 - DNA, 60 bp, Artificial Sequence
  Description of Artificial Sequence: Synthetic coding sequence
atggaggacctggaggagaccctgtttgaggagtttgagaactacagctatgacctgtag

SEQ ID NO: 153159 - DNA, 1527 bp, Artificial Sequence
  Description of Artificial Sequence: Synthetic coding sequence
atgaccagcacctgcaccaacagcacccgggagagcaacagcagccacacctgcatgcccctgagcaagatgcccatcagcctggcccacggcatcatccgcagcacagtgctggtgatcttcctggccgccagctttgtgggcaacatcgtgctggccctggtgctgcagaggaagccccagctgctgcaggtgaccaaccgcttcatcttcaacctgctggtgacagacctgctgcagatcagcctggtggccccctgggtggtggccacctctgtgcccctcttctggcccctgaacagccacttctgcacagccctggtgtccctgacccacctgtttgcctttgcctctgtgaacaccatcgtggtggtgtctgtggaccgctacctgagcatcatccaccccctgagctaccccagcaagatgacccagaggcggggctacctgctgctgtatggcacctggatcgtggccatcctgcagagcaccccacccctgtatggctggggccaggccgcctttgatgaaagaaatgccctgtgcagcatgatctggggcgccagccccagctacaccatcctgtctgtggtgtccttcatcgtcatccccctcatcgtgatgattgcctgctacagcgtggtgttctgtgccgcccggcggcagcacgccctgctgtacaacgtgaagaggcacagcctggaggtgcgggtgaaggactgtgtggagaatgaagatgaggagggcgctgagaagaaggaggagttccaggatgagagcgagttccggcggcagcacgagggggaggtgaaggccaaggagggccgcatggaggccaaggatggcagcctgaaggccaaggagggcagcacaggcaccagcgagagctctgtggaggcccggggcagcgaggaggtgcgggagagcagcacagtggccagtgatggctccatggagggcaaggagggcagcaccaaggtggaggagaacagcatgaaggctgacaagggccgcacagaggtgaaccagtgcagcattgacctgggggaggatgacatggagtttggagaagatgacatcaacttctctgaagatgatgtggaggccgtgaacatccctgagagcctgccccccagcagaagaaacagcaacagcaacccccccctgccccgctgctaccagtgcaaggccgccaaggtgatcttcatcatcatcttctcctatgtgctgagcctgggcccctactgcttcctggccgtgctggccgtgtgggtggatgtggagacccaggtgccccagtgggtgatcaccatcatcatctggctgttcttcctgcagtgctgcatccacccctacgtgtatggctacatgcacaagaccatcaagaaggagatccaggacatgctgaagaagttcttctgcaaggagaagccacccaaggaggacagccacccagacctgcccggcacagagggcggcacagagggcaagatcgtgcccagctatgacagcgccaccttcccctag

SEQ ID NO: 153160 - DNA, 2088 bp, Artificial Sequence
  Description of Artificial Sequence: Synthetic coding sequence
atgaagatgaagagccaggccaccatgatctgctgcctggtgttcttcctgagcacagagtgcagccactaccgcagcaagatccacctgaaggccggggacaagctgcagagccctgagggcaagcccaagacaggccgcatccaggagaagtgtgagggcccctgcatcagcagcagcaactgcagccagccctgtgccaaggacttccatggagagatcggcttcacctgcaaccagaagaagtggcagaagtctgctgagacctgcaccagcctgtctgtggagaagctgttcaaggacagcactggagccagccggctgtctgtggccgcccccagcatccccctgcacatcctggacttccgggcccctgagaccatcgagagcgtggcccagggcatcaggaagaactgcccctttgattatgcctgcatcacagacatggtgaagagcagcgagaccaccagcggcaacatcgccttcatcgtggagctgctgaagaacatcagcacagacctgagtgacaacgtgacccgggagaagatgaagagctacagcgaggtggccaaccacatcctggacacagctgccatcagcaactgggccttcatccccaacaagaatgccagcagtgacctgctgcagagcgtgaacctgtttgcccggcagctgcacatccacaacaacagcgagaacatcgtgaatgagctgttcatccagaccaagggcttccacatcaaccacaacaccagcgagaagagcctgaacttctccatgtccatgaacaacaccacagaggacatcctgggcatggtgcagatcccccggcaggagctgaggaagctgtggcccaatgccagccaggccatcagcatcgccttccccaccctgggcgccatcctgcgggaggcccacctgcagaatgtgtccctgccccggcaggtgaatggcctggtgctgtctgtggtgctgcctgagcggctgcaggagatcatcctgacctttgagaagatcaacaagaccagaaatgcccgggcccagtgtgtgggctggcacagcaagaagaggcgctgggatgagaaggcctgccagatgatgctggacatcagaaatgaggtgaagtgccgctgcaactacacctctgtggtgatgtccttcagcatcctgatgagcagcaagtccatgacagacaaggtgctggactacatcacctgcatcggcctgtctgtgtccatcctgagcctggtgctgtgcctgatcatcgaggccaccgtgtggagccgggtggtggtgacagagatctcctacatgagacatgtgtgcatcgtgaacattgctgtgtccctgctgacagccaacgtgtggttcatcatcggcagccacttcaacatcaaggcccaggactacaacatgtgtgtggccgtgaccttcttcagccacttcttctacctgagcctcttcttctggatgctgttcaaggccctgctgatcatctacggcatcctggtgatcttccggaggatgatgaagagcaggatgatggtgattggatttgccatcggctacggctgccccctcatcatcgctgtgaccaccgtggccatcacagagcctgagaagggctacatgaggcctgaggcctgctggctgaactgggacaacaccaaggccctgctggcctttgccatcccagcctttgtgattgtggccgtgaacctgattgtggtgctggtggtggccgtgaacacccagaggcccagcatcggcagcagcaagagccaggatgtggtgatcatcatgaggatcagcaagaatgtggccatcctgacccccctgctgggcctgacctggggcttcggcatcgccaccctcatcgagggcaccagcctgaccttccacatcatctttgccctgctgaatgccttccagggcttcttcatcctgctgtttggcaccatcatggaccacaagatcagagatgccctgaggatgaggatgagcagcctgaagggcaagagcagagctgctgaaaatgccagcctgggccccaccaacggcagcaagctgatgaaccggcagggctag

SEQ ID NO: 153161 - DNA, 2088 bp, Artificial Sequence; identical to SEQ ID NO: 153160
  Description of Artificial Sequence: Synthetic coding sequence

SEQ ID NO: 153162 - DNA, 2259 bp, Artificial Sequence
  Description of Artificial Sequence: Synthetic coding sequence
atgtacacaggcccctgcaaggtgctgcacctgagcagcggcctgctgcccaacagcggccgcttcggcatcgtgctgagtgatgagtaccaggtggtgaccagcctgtggtgccagctgtacaccacccacgccccccagcaggccagcggcatgctgctgctgaactacctggtgatccccagcaaggcccaggtgaacaagccaggctacatccccaacctgggagaatgtagccactaccgcagcaagatccacctgaaggccggggacaagctgcagagccctgagggcaagcccaagacaggccgcatccaggagaagtgtgagggcccctgcatcagcagcagcaactgcagccagccctgtgccaaggacttccacggggagatcggcttcacctgcaaccagaagaagtggcagaagtctgctgagacctgcaccagcctgtctgtggagaagctgttcaaggacagcactggagccagccggctgtctgtggccgcccccagcatccccctgcacatcctggacttccgggcccctgagaccattgaatctgtggcccagggcatcaggaagaactgcccctttgattatgcctgcatcacagacatggtgaagagcagcgagaccaccagcggcaacatcgccttcatcgtggagctgctgaagaacatcagcacagacctgagtgacaacgtgacccgggagaagatgaagagctacagcgaggtggccaaccacatcctggacacagctgccatcagcaactgggccttcatccccaacaagaatgccagcagtgacctgctgcagagcgtgaacctgtttgcccggcagctgcacatccacaacaacagtgaaaatattgtgaatgaactcttcatccagaccaagggcttccacatcaaccacaacaccagcgagaagagcctgaacttctccatgtccatgaacaacaccacagaggacatcctgggcatggtgcagatcccccggcaggagctgaggaagctgtggcccaatgccagccaggccatcagcatcgccttccccaccctgggcgccatcctgcgggaggcccacctgcagaatgtgtccctgccccggcaggtgaatggcctggtgctgtctgtggtgctgcctgagcggctgcaggagatcatcctgacctttgagaagatcaacaagaccagaaatgcccgggcccagtgtgtgggctggcacagcaagaagaggcgctgggatgagaaggcctgccagatgatgctggacatcagaaatgaggtgaagtgccgctgcaactacacctctgtggtgatgtccttcagcatcctgatgagcagcaagtccatgacagacaaggtgctggactacatcacctgcatcggcctgtctgtgtccatcctgagcctggtgctgtgcctgatcatcgaggccaccgtgtggagccgggtggtggtgacagagatctcctacatgagacatgtgtgcatcgtgaacattgctgtgtccctgctgacagccaacgtgtggttcatcatcggcagccacttcaacatcaaggcccaggactacaacatgtgtgtggccgtgaccttcttcagccacttcttctacctgagcctcttcttctggatgctgttcaaggccctgctgatcatctacggcatcctggtgatcttccggaggatgatgaagagcaggatgatggtgattggatttgccatcggctacggctgccccctcatcatcgctgtgaccaccgtggccatcacagagcctgagaagggctacatgaggcctgaggcctgctggctgaactgggacaacaccaaggccctgctggcctttgccatcccagccttcgtcatcgtggccgtgaacctgattgtggtgctggtggtggccgtgaacacccagaggcccagcatcggcagcagcaagagccaggatgtggtgatcatcatgaggatcagcaagaatgtggccatcctgacccccctgctgggcctgacctggggctttggaattgccaccctgattgagggcaccagcctgaccttccacatcatctttgccctgctgaatgccttccagggcttcttcatcctgctgtttggcaccatcatggaccacaagatcagagatgccctgaggatgaggatgagcagcctgaagggcaagagcagagctgctgaaaatgccagcctgggccccaccaacggcagcaagctgatgaaccggcagggctag

SEQ ID NO: 153163 - DNA, 1005 bp, Artificial Sequence
  Description of Artificial Sequence: Synthetic coding sequence
atgaatgaagacctgaaggtgaacctgagcggcctgccccgggactacctggatgctgctgctgctgagaacatctctgctgctgtgagcagccgggtgcctgctgtggagcctgagcctgagctggtggtgaacccctgggacatcgtgctgtgcaccagcggcaccctcatcagctgtgaaaatgccatcgtggtgctgatcatcttccacaaccccagcctgcgggcccccatgttcctgctgattggcagcctggccctggccgacctgctggccggcatcggcctcatcaccaactttgtgtttgcctacctgctgcagagcgaggccaccaagctggtgaccatcggcctcatcgtggccagcttcagcgcctctgtgtgcagcctgctggccatcaccgtggaccgctacctgagcctgtactatgccctgacctaccacagcgagaggacagtgaccttcacctacgtgatgctggtgatgctgtggggcaccagcatctgcctgggcctgctgcctgtgatgggctggaactgcctgagagatgagagcacctgcagcgtggtgcggcccctgaccaagaacaatgctgccatcctgtctgtgtccttcctgttcatgtttgccctgatgctgcagctgtacatccagatctgcaagatcgtgatgagacatgcccaccagatcgccctgcagcaccacttcctggccaccagccactacgtgaccaccaggaagggcgtgtccaccctggccatcatcctgggcacctttgctgcctgctggatgcccttcaccctgtacagcctgattgctgactacacctaccccagcatctacacctacgccaccctgctgcctgccacctacaacagcatcatcaaccctgtgatctatgccttcaggaaccaggagatccagaaggccctgtgcctgatctgctgcggctgcatccccagcagcctggcccagagggcccggagccccagtgatgtgtag

SEQ ID NO: 153164 - DNA, 1005 bp, Artificial Sequence; identical to SEQ ID NO: 153163
  Description of Artificial Sequence: Synthetic coding sequence

SEQ ID NO: 153165 - DNA, 3840 bp, Artificial Sequence
  Description of Artificial Sequence: Synthetic coding sequence
atgaggggccacggcaaccacagccggctgaagagccgctgtgccagcctgggcaatgtgcaccaccaccaggcccagatggcccatggagcccactgccggggcggccgcaccccccagagcccagacagccggggccccacagctgggggccacacccggggccgctggacctaccggcccatcgaggccctgatcaacgtgtccttccctggggccaagggcggccgcacagctgagggggagcccagctgggcctgggtgttccgcagcggctacctgcagaggcaggccctgcccggcctgcctgtgtccaccagggtggccgcctgctggtggcagcaccaccctggccgggacagcggcttcctgggccctggcttcatcgacctgctgcgggaggagcccagcggccgggcagatggcaaggctgctgcccagaagacaggccgcctgtacctgttccccaccttcctgggcaacaagctgcctgaggccgctgacagctttggagaaattgccagcggcaacagcgtcatcttcacctctgtgctgcagagcagccaccccccaggcaccccacctccttctgccaggaagcccagccctggagctgccatgctggtgtgtgaggagaccctggagctgggcgcccagggctgctggggcagcaccagcccccggggccaggccgtgtccctggtgggcggccccacagctgggggcagccggctgggcggggccggctgcaccatgggcctgctgatggccctgcaggcccggcggcccagagatggcacctgggccgacccccggcgctgcagcagagctgtggagggcagcggcctgacccgggccgccctggtgtccccaggccccagcggcgtggaggaggacacccggcgggagggctgtgtgctggtgggctcctggaggagcagcacccacaggagccgggtgctgatcatcaacaccccatctggccgcaccccctggagccagggcagcctgggcagcacaggccgctacaaccagacccgggcccctggcagccagcagcagggcctgtgcagtgatgctgccctgcacgaggactttgtgcctgagcccaccccagccttcttccagtacccaccccaggccttcagcaagaccaaggtgcgggacctgggccggggcggcctgtatgccttcagcaaggaggagaaggtgtctgaggcccagagggtggaggcctatgagacccacggcctgggcctgagcacaggccggcagaaccctgtgcccagcccctgcaagccaggctgtgtgtgccagggcctggccctggatgctgaggcctggcccaggcaccctggccggcggccctgtgccgccaaggaggcctgcctgggccccccaggctgcagcggggagctgagcctgcctgaggaggagggcatcgcccctggagctgccacagctgccccagcctgggtgccccacggccgggtgagccgcttcctgactgtgaagctgttcacctacgtgaccatgtaccagtgcaagcaggagcgcatcctgcggctgtgcatcagcggggagagcggccgctacgtgcggcgcagccgcttcaggaactttgctgccctgatggtgtccactggagtgcctggggtgctgcagctgggcgcccggcccctgcggggcggcggccacccctacggggacagccaggccggcaaggtggtggagtggagggctggggaccgggccagcggcctgtctgctggggagcggcgcttcctgagccagagcgagctgcagacctggcccaggaccccccactgtgtgggcaagaaggtgccccagcctgtgggcgctgctgacctggccccagacaccagcctgtgcaggaaggagggcagcagcgccagccgcagctgccggcccggccctggccacctgacccggcgggaggaggacagcttccggcagctggccttccccaggtttgaggaggtgaccttcccccccctgacagctgctgagcgggcccccagcgtgcatggaggccacagcctggccagccagggcctggtgctggccggccgcaccaggtctgtggccagcggcggcaagcaggagctgagcggccccctggccgcctgcatccccacccaggacctgaagacagtgctgagcctgccccgctacccaggagagttcctgcaccctgtggtgtatgcctgcacagctgtgatgctgctgtgcctgctggccagctttgtgacctacatcgtgcaccagagcgccatccgcatcagcaggaagggccgccacaccctgctgaacttctgcttccacgccgccctgaccttcaccgtgtttgctgggggcatcaacagaaccaagtaccccatcctgtgccaggccgtgggcatcgtgctgcactacagcaccctgagcaccatgctgtggattggagtgacagccaggaacatctacaagcaggtgaccaagaaggcccccctgtgcctggacacagaccagcccccctacccccggcagcccctgctgcgcttctacctggtgtctggaggagtgcccttcatcatctgtggggtgacagctgccaccaacatccggaactacggcacagaagatgaggacacagcctgctggatggcctgggagcccagcctgggcgccttctacggccctgctgccatcatcaccctggtgacctgtgtgtacttcctgggcacctacgtgcagctgcggcggcaccctggccgccgctatgagctgcggacccagcctgaggagcagaggcggctggccaccccagagggcggccggggcatccggcccggcaccccaccagcccatgatgcccctggggcctctgtgctgcagaatgagcacagcttccaggcccagctgcgggccgccgccttcaccctcttcctgttcaccgccacctgggcctttggagccctggccgtgtcccagggccacttcctggacatggtgttcagctgcctgtatggagccttctgtgtgaccctgggcctgtttgtgctgatccaccactgtgccaagcgggaggatgtgtggcagtgctggtgggcctgctgcccccccaggaaggatgcccacccagccctggatgccaatggagctgccctgggccgggccgcctgcctgcacagccctggcctgggccagccccggggctttgcccaccccccaggcccctgcaagatgaccaacctgcaggccgcccagggccacgccagctgcctgagccctgccaccccctgctgtgccaagatgcactgtgagcccctgacagcagatgaggcccacgtgcacctgcaggaggagggcgccttcggccatgacccccacctgcacggctgcctgcagggccgcaccaagccaccctacttcagccgccaccctgctgaggagccagaatatgcctaccacatccccagcagcctggatggcagccccaggagcagcaggacagacagcccccccagcagcctggatggccctgctggcacccacaccctggcctgctgcacccagggcgaccccttccccatggtgacccagcctgagggcagtgatggcagccctgccctgtacagctgccccacccagcccggccgggaggccgccctgggccctggccacctggagatgctgcggaggacccagagcctgccctttggaggccccagccagaatggcctgcccaagggcaagctgctggagggcctgcccttcggcacagatggcactggaaacatcagaacaggcccctggaagaatgagaccaccgtgtag

SEQ ID NO: 153166 - DNA, 1395 bp, Artificial Sequence
  Description of Artificial Sequence: Synthetic coding sequence
atgctgtggattggagtgacagccaggaacatctacaagcaggtgaccaagaaggcccccctgtgcctggacacagaccagcccccctacccccggcagcccctgctgagccgcttctacctggtgtctggaggagtgcccttcatcatctgtggggtgacagctgccaccaacatccggaactacggcacagaagatgaggacacagcctactgctggatggcctgggagcccagcctgggcgccttctacggccctgctgccatcatcaccctggtgacctgtgtgtacttcctgggcacctacgtgcagctgcggcggcaccctggaagaagatatgagctgcggacccagcctgaggagcagaggcggctggccaccccagagggcggccggggcatccggcccggcaccccaccagcccatgatgcccctggggcctctgtgctgcagaatgagcacagcttccaggcccagctgcgggctgctgccttcaccctcttcctgttcaccgccacctgggccttcggggccctggccgtgtcccagggccacttcctggacatggtgttcagctgcctgtatggagccttctgtgtgaccctgggcctgtttgtgctgatccaccactgtgccaagagagaagatgtgtggcagtgctggtgggcctgctgcccccccaggaaggatgcccacccagccctggatgccaacggggccgccctgggccgggccgcctgcctgcacagccctggcctgggccagccccggggctttgcccaccccccaggcccctgcaagatgaccaacctgcaggccgcccagggccacgccagctgcctgagccctgccaccccctgctgtgccaagatgcactgtgagcccctgacagcagatgaggcccacgtgcacctgcaggaggagggcgcctttggacatgacccccacctgcacggctgcctgcagggccgcaccaagccaccctacttcagccgccaccctgctgaggagccagaatatgcctaccacatccccagcagcctggatggcagccccaggagcagcaggacagacagcccccccagcagcctggatggccctgctggcacccacaccctggcctgctgcacccagggcgaccccttccccatggtgacccagcctgagggcagtgatggcagccctgccctgtacagctgccccacccagcccggccgggaggccgccctgggccctggccacctggagatgctgcggaggacccagagcctgccctttggaggccccagccagaatggcctgcccaagggcaagctgctggagggcctgccctttggaacagatggcaccggcaacatcagaacaggcccctggaagaatgagaccaccgtgtag

SEQ ID NO: 153167 - DNA, 1683 bp, Artificial Sequence
  Description of Artificial Sequence: Synthetic coding sequence
atggacctgaagacagtgctgagcctgccccgctacccaggagagttcctgcaccctgtggtgtatgcctgcacagctgtgatgctgctgtgcctgctggccagctttgtgacctacatcgtgcaccagagcgccatccgcatcagcaggaagggccgccacaccctgctgaacttctgcttccacgccgccctgaccttcaccgtgtttgctgggggcatcaacagaaccaagtaccccatcctgtgccaggccgtgggcatcgtgctgcactacagcaccctgagcaccatgctgtggattggagtgacagccaggaacatctacaagcaggtgaccaagaaggcccccctgtgcctggacacagaccagcccccctacccccggcagcccctgctgcgcttctacctggtgtctggaggagtgcccttcatcatctgtggggtgacagctgccaccaacatccggaactacggcacagaagatgaggacacagcctactgctggatggcctgggagcccagcctgggcgccttctacggccctgctgccatcatcaccctggtgacctgtgtgtacttcctgggcacctacgtgcagctgcggcggcaccctggaagaagatatgagctgcggacccagcctgaggagcagaggcggctggccaccccagagggcggccggggcatccggcccggcaccccaccagcccatgatgcccctggggcctctgtgctgcagaatgagcacagcttccaggcccagctgcgggctgctgccttcaccctcttcctgttcaccgccacctgggccttcggggccctggccgtgtcccagggccacttcctggacatggtgttcagctgcctgtatggagccttctgtgtgaccctgggcctgtttgtgctgatccaccactgtgccaagagagaagatgtgtggcagtgctggtgggcctgctgcccccccaggaaggatgcccacccagccctggatgccaacggggccgccctgggccgggccgcctgcctgcacagccctggcctgggccagccccggggctttgcccaccccccaggcccctgcaagatgaccaacctgcaggccgcccagggccacgccagctgcctgagccctgccaccccctgctgtgccaagatgcactgtgagcccctgacagcagatgaggcccacgtgcacctgcaggaggagggcgcctttggacatgacccccacctgcacggctgcctgcagggccgcaccaagccaccctacttcagccgccaccctgctgaggagccagaatatgcctaccacatccccagcagcctggatggcagccccaggagcagcaggacagacagcccccccagcagcctggatggccctgctggcacccacaccctggcctgctgcacccagggcgaccccttccccatggtgacccagcctgagggcagtgatggcagccctgccctgtacagctgccccacccagcccggccgggaggccgccctgggccctggccacctggagatgctgcggaggacccagagcctgccctttggaggccccagccagaatggcctgcccaagggcaagctgctggagggcctgccctttggaacagatggcaccggcaacatcagaacaggcccctggaagaatgagaccaccgtgtag

SEQ ID NO: 153168 - DNA, 2562 bp, Artificial Sequence
  Description of Artificial Sequence: Synthetic coding sequence
atgaggggccacggcaaccacagccggctgaagagccgctgtgccagcctgggcaatgtgcaccaccaccaggcccagatggcccatggagcccactgccggggcggccgcaccccccagagcccagacagccggggccccacagctgggggccacacccggggccgctggacctaccggcccatcgaggccctgatcaacgtgtccttccctggggccaagggcggccgcacagctgagggggagcccagctgggcctgggtgttccgcagcggctacctgcagaggcaggccctgcccggcctgcctgtgtccaccagggtggccgcctgctggtggcagcaccaccctggccgggacagcggcttcctgggccctggcttcatcgacctgctgcgggaggagcccagcggccgggcagatggcaaggctgctgcccagaagacaggccgcctgtacctgttccccaccttcctgggcaacaagctgcctgaggccgctgacagctttggagaaattgccagcggcaacagcgtcatcttcacctctgtgctgcagagcagccaccccccaggcaccccacctccttctgccaggaagcccagccctggagctgccatgctggtgtgtgaggagaccctggagctgggcgcccagggctgctggggcagcaccagcccccggggccaggccgtgtccctggtgggcggccccacagctgggggcagccggctgggcggggccggctgcaccatgggcctgctgatggccctgcaggcccggcggcccagagatggcacctgggccgacccccggcgctgcagcagagctgtggagggcagcggcctgacccgggccgccctggtgtccccaggccccagcggcgtggaggaggacacccggcgggagggctgtgtgctggtgggctcctggaggagcagcacccacaggagccgggtgctgatcatcaacaccccatctggccgcaccccctggagccagggcagcctgggcagcacaggccgctacaaccagacccgggcccctggcagccagcagcagggcctgtgcagtgatgctgccctgcacgaggactttgtgcctgagcccaccccagccttcttccagtacccaccccaggccttcagcaagaccaaggtgcgggacctgggccggggcggcctgtatgccttcagcaaggaggagaaggtgtctgaggcccagagggtggaggcctatgagacccacggcctgggcctgagcacaggccggcagaaccctgtgcccagcccctgcaagccaggctgtgtgtgccagggcctggccctggatgctgaggcctggcccaggcaccctggccggcggccctgtgccgccaaggaggcctgcctgggccccccaggctgcagcggggagctgagcctgcctgaggaggagggcatcgcccctggagctgccacagctgccccagcctgggtgccccacggccgggtgagccgcttcctgactgtgaagctgttcacctacgtgaccatgtaccagtgcaagcaggagcgcatcctgcggctgtgcatcagcggggagagcggccgctacgtgcggcgcagccgcttcaggaactttgctgccctgatggtgtccactggagtgcctggggtgctgcagctgggcgcccggcccctgcggggcggcggccacccctacggggacagccaggccggcaaggtggtggagtggagggctggggaccgggccagcggcctgtctgctggggagcggcgcttcctgagccagagcgagctgcagacctggcccaggaccccccactgtgtgggcaagaaggtgccccagcctgtgggcgctgctgacctggccccagacaccagcctgtgcaggaaggagggcagcagcgccagccgcagctgccggcccggccctggccacctgacccggcgggaggaggacagcttccggcagctggccttccccaggtttgaggaggtgaccttcccccccctgacagctgctgagcgggcccccagcgtgcatggaggccacagcctggccagccagggcctggtgctggccggccgcaccaggtctgtggccagcggcggcaagcaggagctgagcggccccctggccgcctgcatccccacccaggacctgaagacagtgctgagcctgccccgctacccaggagagttcctgcaccctgtggtgtatgcctgcacagctgtgatgctgctgtgcctgctggccagctttgtgacctacatcgtgcaccagagcgccatccgcatcagcaggaagggccgccacaccctgctgaacttctgcttccacgccgctgagcaccctggggtgacccccctgcggaccagcccccccctgccctggtggacccccatccaggtgggcatcgtgctgcactacagcaccctgagcaccatgctgtggattggagtgacagccaggaacatctacaagcaggtgaccaagaaggcccccctgtgcctggacacagaccagcccccctacccccggcagcccctgctgtag

SEQ ID NO: 153169 - DNA, 3366 bp, Artificial Sequence
  Description of Artificial Sequence: Synthetic coding sequence
atgggcgccggcggccgcaggatgagaggagccccagcccggctgctgctgcccctgctgccctggctgctgctgctgctggcccctgaggcccggggggcccctggctgccccctgagcatccgcagctgcaagtgcagcggggagcggcccaagggcctgtctggaggagtgcccggccctgcccggcggcgggtggtgtgcagcggcggggacctgcctgagcccccagagcccggcctgctgcccaacggcaccgtgaccctgctgctgagcaacaacaagatcaccggcctgagaaatggcagcttcctgggcctgagcctgctggagaagctggacctgaggaacaacatcatcagcacagtgcagcccggggccttcctgggcctgggggagctgaagaggctggacctgagcaacaaccgcatcggctgcctgaccagcgagaccttccagggcctgccccggctgctgcggctgaacatcagcggcaacatcttcagcagcctgcagcccggggtgtttgatgagctgcctgccctgaaggtggtggacctgggcacagagttcctgacctgtgactgccacctgcgctggctgctgccctgggcccagaacagaagcctgcagctgtctgagcacaccctgtgtgcctaccccagcgccctgcacgcccaggccctgggcagcctgcaggaggcccagctgtgctgtgagggcgccctggagctgcacacccaccacctgatccccagcctgcggcaggtggtgttccagggcgaccggctgcccttccagtgcagcgccagctacctgggcaatgacacccgcatccgctggtaccacaacagagcccctgtggagggagatgagcaggccggcatcctgctggccgagagcctcatccatgactgcaccttcatcaccagcgagctgaccctgagccacatcggcgtgtgggccagcggggagtgggagtgcaccgtgtccatggcccagggcaatgccagcaagaaggtggagatcgtggtgctggagaccagcgccagctactgcccagctgagcgggtggccaacaacagaggagacttccgctggcccaggaccctggccggcatcacagcctaccagagctgcctgcagtaccccttcacctctgtgcccctgggcggcggggcccctggcacccgggccagcagaagatgtgaccgggccggccgctgggagcccggggactacagccactgcctgtacaccaatgacatcaccagggtgctgtacacctttgtgctgatgcccatcaatgccagcaatgccctgaccctggcccaccagctgcgggtgtacacagctgaggccgccagcttcagtgacatgatggatgtggtgtatgtggcccagatgatccagaagttcctgggctacgtggaccagatcaaggagctggtggaggtgatggtggacatggccagcaacctgatgctggtggatgagcacctgctgtggctggcccagcgggaggacaaggcctgcagcagaattgtgggcgccctggagcgcatcggcggggccgccctgagcccccacgcccagcacatctctgtggagctgagcgccttcccccgggaggtgggcggggccggggccggcctgcaccctgtggtgtacccctgcacagccctgctgctgctgtgcctgtttgccaccatcatcacctacatcctgaaccacagcagcatccgggtgtccaggaagggctggcacatgctgctgaacctgtgcttccacatcgccatgaccagcgctgtgtttgctgggggcatcaccctgaccaactaccagatggtgtgccaggccgtgggcatcaccctgcactacagcagcctgagcaccctgctgtggatgggcgtgaaggcccgggtgctgcacaaggagctgacctggagggcccccccaccccaggagggggaccctgccctgcccacccccagccccatgctgcgcttctacctgattgctgggggcatccccctcatcatctgtggcatcacagctgctgtgaacatccacaactacagagaccacagcccctactgctggctggtgtggaggcccagcctgggcgccttctacatccctgtggccctgatcctgctgatcacctggatctacttcctgtgtgccggcctgcggctgcggggccccctggcccagaaccccaaggccggcaacagccgggccagcctggaggccggggaggagctgcggggcagcacccggctgcggggcagcggccccctgctgagtgacagcggcagcctgctggccaccggcagcgcccgggtgggcaccccaggccccccagaagatggagacagcctgtacagccctggggtgcagctgggcgccctggtgaccacccacttcctgtacctggccatgtgggcctgtggggccctggccgtgtcccagcgctggctgccccgggtggtgtgcagctgcctgtatggagtggccgccagcgccctgggcctgtttgtgttcacccaccactgtgcccggaggagagatgtgcgggcctcctggagggcctgctgccccccagccagccctgctgccccccacgccccaccccgggccctgcctgctgctgctgaagatggcagccctgtgtttggagagggcccccccagcctgaagagcagccccagcggcagcagcggccaccccctggccctgggcccctgcaagctgaccaacctgcagctggcccagagccaggtgtgtgaggccggggctgctgctggaggagagggggagcctgagcctgctggcacccggggcaacctggcccaccgccaccccaacaacgtgcaccacggcagaagagcccacaagagccgggccaagggccacagagctggggaggcctgtgggaagaaccggctgaaggccctgcggggcggggccgccggggccctggagctgctgagcagcgagagcggcagcctgcacaacagccccacagacagctacctgggcagcagcaggaacagccctggagctggcctgcagctggagggggagcccatgctgacccccagcgagggcagtgacaccagcgctgcccccctgtctgaggccggccgggccggccagaggagaagtgccagccgggacagcctgaagggcggcggggccctggagaaggagagccacagaagaagctaccccctgaatgctgccagcctgaatggagcccccaagggcggcaagtatgatgatgtgaccctgatgggcgctgaggtggccagcggcggctgcatgaagacaggcctgtggaagtctgagaccaccgtgtag

SEQ ID NO: 153170 - DNA, 4017 bp, Artificial Sequence
  Description of Artificial Sequence: Synthetic coding sequence
atgggcgccggcggccgcaggatgagaggagccccagcccggctgctgctgcccctgctgccctggctgctgctgctgctggcccctgaggcccggggggcccctggctgccccctgagcatccgcagctgcaagtgcagcggggagcggcccaagggcctgtctggaggagtgcccggccctgcccggcggcgggtggtgtgcagcggcggggacctgcctgagcccccagagcccggcctgctgcccaacggcaccgtgaccctgctgctgagcaacaacaagatcaccggcctgagaaatggcagcttcctgggcctgagcctgctggagaagctggacctgaggaacaacatcatcagcacagtgcagcccggggccttcctgggcctgggggagctgaagaggctggacctgagcaacaaccgcatcggctgcctgaccagcgagaccttccagggcctgccccggctgctgcggctgaacatcagcggcaacatcttcagcagcctgcagcccggggtgtttgatgagctgcctgccctgaaggtggtggacctgggcacagagttcctgacctgtgactgccacctgcgctggctgctgccctgggcccagaacagaagcctgcagctgtctgagcacaccctgtgtgcctaccccagcgccctgcacgcccaggccctgggcagcctgcaggaggcccagctgtgctgtgagggcgccctggagctgcacacccaccacctgatccccagcctgcggcaggtggtgttccagggcgaccggctgcccttccagtgcagcgccagctacctgggcaatgacacccgcatccgctggtaccacaacagagcccctgtggagggagatgagcaggccggcatcctgctggccgagagcctcatccatgactgcaccttcatcaccagcgagctgaccctgagccacatcggcgtgtgggccagcggggagtgggagtgcaccgtgtccatggcccagggcaatgccagcaagaaggtggagatcgtggtgctggagaccagcgccagctactgcccagctgagcgggtggccaacaacagaggagacttccgctggcccaggaccctggccggcatcacagcctaccagagctgcctgcagtaccccttcacctctgtgcccctgggcggcggggcccctggcacccgggccagcagaagatgtgaccgggccggccgctgggagcccggggactacagccactgcctgtacaccaatgacatcaccagggtgctgtacacctttgtgctgatgcccatcaatgccagcaatgccctgaccctggcccaccagctgcgggtgtacacagctgaggccgccagcttcagtgacatgatggatgtggtgtatgtggcccagatgatccagaagttcctgggctacgtggaccagatcaaggagctggtggaggtgatggtggacatggccagcaacctgatgctggtggatgagcacctgctgtggctggcccagcgggaggacaaggcctgcagcagaattgtgggcgccctggagcgcatcggcggggccgccctgagcccccacgcccagcacatctctgtgaatgccagaaatgtggccctggaggcctacctgatcaagccccacagctatgtgggcctgacctgcacagccttccagaggcgggagggcggcgtgcccggcaccaggcctggcagccctggccagaaccccccacctgagcctgagcccccagctgaccagcagctgcgcttccgctgcaccaccggccggcccaacgtgtccctgagcagcttccacatcaagaacagcgtggccctggccagcatccagctgccccccagcctcttcagcagcctgcctgctgccctggcccctcctgtgcccccagactgcaccctgcagctgctggtgttcagaaatggccgcctcttccacagccacagcaacaccagcaggcctggagctgctggccctgggaagagaagaggagtggccacccctgtgatctttgctggcaccagcggctgcggcgtgggcaacctgacagagcctgtggccgtgtccctgcggcactgggccgagggcgctgagcctgtggccgcctggtggagccaggagggccctggagaggccggcggctggaccagcgagggctgccagctgcggagcagccagcccaacgtgtctgccctgcactgccagcacctgggcaatgtggccgtgctgatggagctgagcgccttcccccgggaggtgggcggggccggggccggcctgcaccctgtggtgtacccctgcacagccctgctgctgctgtgcctgtttgccaccatcatcacctacatcctgaaccacagcagcatccgggtgtccaggaagggctggcacatgctgctgaacctgtgcttccacatcgccatgaccagcgctgtgtttgctgggggcatcaccctgaccaactaccagatggtgtgccaggccgtgggcatcaccctgcactacagcagcctgagcaccctgctgtggatgggcgtgaaggcccgggtgctgcacaaggagctgacctggagggcccccccaccccaggagggggaccctgccctgcccacccccagccccatgctgcgcttctacctgattgctgggggcatccccctcatcatctgtggcatcacagctgctgtgaacatccacaactacagagaccacagcccctactgctggctggtgtggaggcccagcctgggcgccttctacatccctgtggccctgatcctgctgatcacctggatctacttcctgtgtgccggcctgcggctgcggggccccctggcccagaaccccaaggccggcaacagccgggccagcctggaggccggggaggagctgcggggcagcacccggctgcggggcagcggccccctgctgagtgacagcggcagcctgctggccactggaagtgcccgggtgggcaccccaggccccccagaagatggagacagcctgtacagccctggggtgcagctgggcgccctggtgaccacccacttcctgtacctggccatgtgggcctgtggggccctggccgtgtcccagcgctggctgccccgggtggtgtgcagctgcctgtatggagtggccgccagcgccctgggcctgtttgtgttcacccaccactgtgccaggagaagagatgtgcgggcctcctggagggcctgctgccccccagccagccctgctgcccctcatgccccaccccgggccctgcctgctgctgctgaagatggcagccctgtgtttggagagggcccccccagcctgaagagcagccccagcggcagcagcggccaccccctggccctgggcccctgcaagctgaccaacctgcagctggcccagagccaggtgtgtgaggccggggctgctgctggaggagagggggagcctgagcccgccggcacccggggcaacctggcccaccgccaccccaacaacgtgcaccacggccggcgggcccacaagagccgggccaagggccaccgggccggggaggcctgtgggaagaaccggctgaaggccctgcggggcggcgctgctggggccctggagctgctgagcagcgagagcggcagcctgcacaacagccccacagacagctacctgggcagcagcaggaacagccctggggccggcctgcagctggagggggagcccatgctgaccccatctgagggcagtgacaccagcgctgcccccctgtctgaggccggccgggccggccagaggagaagtgccagccgggacagcctgaagggcggcggggccctggagaaggagagccaccggcgcagctaccccctgaatgctgccagcctgaatggagcccccaagggcggcaagtatgatgatgtgaccctgatgggcgctgaggtggccagcggcggctgcatgaagacaggcctgtggaagtctgagaccaccgtgtag

SEQ ID NO: 153171 - DNA, 3771 bp, Artificial Sequence
  Description of Artificial Sequence: Synthetic coding sequence
atgagaggagccccagcccggctgctgctgcccctgctgccctggctgctgctgctgctggcccctgaggcccggggggcccctggctgccccctgagcatccgcagctgcaagtgcagcggggagcggcccaagggcctgagcggcggcgtgcccggccctgccaggagaagagtggtgtgcagcggcggggacctgcctgagcccccagagcccggcctgctgcccaatggaacagtgaccctgctgctgagcaacaacaagatcaccggcctgagaaatggcagcttcctgggcctgagcctgctggagaagctggacctgaggaacaacatcatcagcacagtgcagcccggggccttcctgggcctgggggagctgaagaggctggacctgagcaacaacagaattggctgcctgaccagcgagaccttccagggcctgccccggctgctgcggctgaacatcagcggcaacatcttcagcagcctgcagcccggggtgtttgatgagctgcctgccctgaaggtggtggacctgggcacagagttcctgacctgtgactgccacctgcgctggctgctgccctgggcccagaacagaagcctgcagctgtctgagcacaccctgtgtgcctaccccagcgccctgcacgcccaggccctgggcagcctgcaggaggcccagctgtgctgtgagggcgccctggagctgcacacccaccacctgatccccagcctgcggcaggtggtgttccagggcgaccggctgcccttccagtgcagcgccagctacctgggcaatgacacccgcatccgctggtaccacaacagagcccctgtggagggagatgagcaggccggcatcctgctggccgagagcctcatccatgactgcaccttcatcaccagcgagctgaccctgagccacatcggcgtgtgggccagcggggagtgggagtgcaccgtgtccatggcccagggcaatgccagcaagaaggtggagatcgtggtgctggagaccagcgccagctactgcccagctgagcgggtggccaacaacagaggagacttccgctggcccaggaccctggccggcatcacagcctaccagagctgcctgcagtaccccttcacctctgtgcccctgggcggcggggcccctggcacccgggccagccgccgctgtgacagagctggccgctgggagcccggggactacagccactgcctgtacaccaatgacatcaccagggtgctgtacacctttgtgctgatgcccatcaatgccagcaatgccctgaccctggcccaccagctgcgggtgtacacagctgaggccgccagcttcagtgacatgatggatgtggtgtatgtggcccagatgatccagaagttcctgggctacgtggaccagatcaaggagctggtggaggtgatggtggacatggccagcaacctgatgctggtggatgagcacctgctgtggctggcccagcgggaggacaaggcctgcagccgcatcgtgggcgccctggagagaattggaggagctgccctgagcccccacgcccagcacatctctgtgaatgccagaaatgtggccctggaggcctacctgatcaagccccacagctatgtgggcctgacctgcacagccttccagaggcgggagggcggcgtgcccggcacccggcccggcagccctggccagaaccccccacctgagcctgagcccccagctgaccagcagctgcgcttccgctgcaccaccggccggcccaacgtgtccctgagcagcttccacatcaagaacagcgtggccctggccagcatccagctgccccccagcctcttcagcagcctgcctgctgccctggcccctcctgtgcccccagactgcaccctgcagctgctggtgttcagaaatggccgcctcttccacagccacagcaacaccagcaggcctggagctgctggccctgggaagaggcggggcgtggccacccctgtgatctttgctggcaccagcggctgcggcgtgggcaacctgacagagcctgtggccgtgtccctgcggcactgggccgagggcgctgagcctgtggccgcctggtggagccaggagggccctggagaggccggcggctggaccagcgagggctgccagctgcggagcagccagcccaacgtgtctgccctgcactgccagcacctgggcaatgtggccgtgctgatggagctgagcgccttcccccgggaggtgggcggggccggggccggcctgcaccctgtggtgtacccctgcacagccctgctgctgctgtgcctgtttgccaccatcatcacctacatcctgaaccacagcagcatccgggtgtccaggaagggctggcacatgctgctgaacctgtgcttccacatcgccatgaccagcgctgtgtttgctgggggcatcaccctgaccaactaccagatggtgtgccaggccgtgggcatcaccctgcactacagcagcctgagcaccctgctgtggatgggcgtgaaggcccgggtgctgcacaaggagctgacctggagggcccccccaccccaggagggggaccctgccctgcccacccccagccccatgctgcgcttctacctgattgctgggggcatccccctcatcatctgtggcatcacagctgctgtgaacatccacaactacagagaccacagcccctactgctggctggtgtggaggcccagcctgggcgccttctacatccctgtggccctgatcctgctgatcacctggatctacttcctgtgtgccggcctgcggctgcggggccccctggcccagaaccccaaggccggcaacagccgggccagcctggaggccggggaggagctgcggggcagcacccggctgcggggcagcggccccctgctgagtgacagcggcagcctgctggccaccggcagcgcccgggtgggcaccccaggccccccagaagatggagacagcctgtacagccctggggtgcagagaggagctggggaccacgccctgcctgtgctgggccacgtgggcctgcggggcagcggctctgtgcctgccctggccgcccctggaggagtgcagctgctggtgcggggcggcagcctgcggcccggccccctgcggctgcacagccccctgtgccaggccgagggccgggagagcctggtggcccggctgctgcccccctgcctgagccggggccccccctgcccagcccctggccctgccaggagaagaagaggccgcttccctggggtgcggggcggcccccccctgccccaggtgctgcccaagaggcagcagaggcccagcgctggcagcggccccctgcaggcccaccagcctgctgctggccctgagagcggcgtgcggggcggcggcggcggccggcggggcagaagagctggagctgggggccaccctgggaagccccggcccccaccaccccagcagagggccccccgggccagcggggcccaggagcccggccagggcaccccccggggcggcggcctgcggcaggagcccgcccagggccctgcccggggccggggcggcggggccggggctgctgtgcagcgggagcggcagagcgcccagcagccccaccggcagctgcccggccagcagccccagcagcccggccggcggcctgctgctggccggcgggcccacgcccatgctgtgcggggccagaggcaccagaggcgggccgccttctag

SEQ ID NO: 153172 - DNA, 3966 bp, Artificial Sequence
  Description of Artificial Sequence: Synthetic coding sequence
atggagcccccaggaagaagaagaggccgggcccagccccccctgctgctgcccctgagcctgctggccctgctggccctgctgggcggcggcggcggcggcggcgctgctgccctgcctgctggctgcaagcatgatggccggcccaggggggccggccgggccgccggggctgctgagggcaaggtggtgtgcagcagcctggagctggcccaggtgctgcccccagacaccctgcccaacagaacagtgaccctcatcctgagcaacaacaagatcagcgagctgaagaatggcagcttcagcggcctgagcctgctggagcggctggacctgaggaacaacctgatcagcagcattgaccccggggccttctggggcctgagcagcctgaagaggctggacctgaccaacaacagaattggctgcctgaatgctgacatcttccggggcctgaccaacctggtgcggctgaacctgagcggcaacctcttcagcagcctgagccagggcacctttgactacctggccagcctgcggagcctggagttccagacagagtacctgctgtgtgactgcaacatcctgtggatgcaccgctgggtgaaggagaagaacatcaccgtgcgggacacccgctgtgtgtaccccaagagcctgcaggcccagcctgtgactggagtgaagcaggagctgctgacctgtgacccccccctggagctgcccagcttctacatgacccccagccaccggcaggtggtgtttgaaggagacagcctgcccttccagtgcatggccagctacatcgaccaggacatgcaggtgctgtggtaccaggacggcagaattgtggagacagatgagagccagggcatctttgtggagaagaacatgatccacaactgcagcctgattgccagcgccctgaccatcagcaacatccaggccggcagcactggaaactggggctgccacgtgcagaccaagaggggcaacaacaccaggacagtggacatcgtggtgctggagagcagcgcccagtactgccccccagagcgggtggtgaacaacaagggggacttccgctggcccaggaccctggccggcatcacagcctacctgcagtgcaccaggaacacccacggcagcggcatctacccaggcaacccccaggatgagaggaaggcctggaggcgctgtgacagaggaggcttctgggcagatgatgactacagccgctgccagtatgccaatgatgtgaccagggtgctgtacatgttcaaccagatgcccctgaacctgaccaatgctgtggccacagcccggcagctgctggcctacacagtggaggccgccaacttcagtgacaagatggatgtgatctttgtggccgagatgattgagaagtttggccgcttcaccaaggaggagaagagcaaggagctgggagatgtgatggtggacatcgccagcaacatcatgctggctgatgagcgggtgctgtggctggcccagcgggaggccaaggcctgcagccgcatcgtgcagtgcctgcagagaattgccacctaccgcctggccggcggggcccacgtgtacagcacctacagccccaacatcgccctggaggcctacgtgatcaagagcacaggcttcaccggcatgacctgcaccgtcttccagaaggtggccgccagtgacagaacaggcctgagtgactatggccggcgggaccctgagggcaacctggacaagcagctgtccttcaagtgcaatgtgagcaacaccttcagcagcctggccctgaagaacaccatcgtggaggccagcatccagctgccccccagcctcttcagccccaagcagaagcgggagctgcggcccacagatgacagcctgtacaagctgcagctgattgccttcagaaatggcaagctgtttcctgccaccggcaacagcaccaacctggctgatgatggcaagagaagaacagtggtgacccctgtgatcctgaccaagattgatggagtgaatgtggacacccaccacatccctgtgaatgtgaccctgcggagaattgcccatggagcagatgctgtggccgcccgctgggactttgacctgctgaatggccagggcggctggaagagtgatggctgccacatcctgtacagtgatgagaacatcaccaccatccagtgctacagcctgagcaactatgctgtgctgatggacctgactggaagtgagctgtacacccaggccgccagcctgctgcaccctgtggtgtacaccacagccatcatcctgctgctgtgcctgctggccgtcatcgtgtcctacatctaccaccacagcctcatccgcatcagcctgaagtcctggcacatgctggtgaacctgtgcttccacatcttcctgacctgtgtggtgtttgtgggcggcatcacccagaccagaaatgccagcatctgccaggccgtgggcatcatcctgcactacagcaccctggccaccgtgctgtgggtgggcgtgacagccaggaacatctacaagcaggtgaccaagaaggccaagcgctgccaggaccctgatgagcccccacctccaccccggcccatgctgcgcttctacctgattggaggcggcatccccatcatcgtgtgtggcatcacagctgctgccaacatcaagaactacggcagccggcccaatgccccctactgctggatggcctgggagcccagcctgggcgccttctacggccctgccagcttcatcacctttgtgaactgcatgtacttcctgagcatcttcatccagctgaagaggcaccctgagaggaaatatgagctgaaggagcccacagaggagcagcagaggctggccgccaatgaaaatggagagatcaaccaccaggacagcatgagcctgagcctcatcagcaccagcgccctggagaatgagcacaccttccacagccagctgctgggcgccagcctgaccctgctgctgtatgtggccctgtggatgtttggagccctggccgtgtccctgtactaccccctggacctggtgttctcctttgtgtttggagccaccagcctgtccttcagcgccttctttgtggtgcaccactgtgtgaacagagaagatgtgcggctggcctggatcatgacctgctgccccggccgcagcagctacagcgtgcaggtgaatgtgcagccccccaacagcaatggcaccaatggagaggcccccaagtgccccaacagcagcgctgagagcagctgcaccaacaagagcgccagcagcttcaagaacagcagccagggctgcaagctgaccaacctgcaggccgccgccgcccagtgccacgccaacagcctgcccctgaacagcaccccccagctggacaacagcctgacagagcacagcatggacaatgacatcaagatgcacgtggcccccctggaggtgcagttccgcaccaacgtgcacagcagccgccaccacaagaacagaagcaagggccaccgggccagccggctgactgtgctgcgggagtatgcctatgatgtgcccacctctgtggagggctctgtgcagaatggcctgcccaagagccggctgggcaacaatgaaggccacagccgcagcagaagagcctacctggcctaccgggagcggcagtacaaccccccccagcaggacagcagtgatgcctgcagcaccctgcccaagagcagcaggaactttgagaagcctgtgtccaccaccagcaagaaggatgccctgaggaagccagctgtggtggagctggagaaccagcagaagagctatggcctgaacctggccatccagaatggccccatcaagagcaatggccaggagggccccctgctgggcacagacagcactggaaatgtgaggacaggcctgtggaagcatgagaccaccgtgtag

SEQ ID NO: 153173 - DNA, 1851 bp, Artificial Sequence
  Description of Artificial Sequence: Synthetic coding sequence
atggagcccccaggaagaagaagaggccgggcccagccccccctgctgctgcccctgagcctgctggccctgctggccctgctgggcggcggcggcggcggcggcgctgctgccctgcctgctggctgcaagcatgatggccggcccaggggggccggccgggccgccggggctgctgagggcaaggtggtgtgcagcagcctggagctggcccaggtgctgcccccagacaccctgcccaacagaacagtgaccctcatcctgagcaacaacaagatcagcgagctgaagaatggcagcttcagcggcctgagcctgctggagcggctggacctgaggaacaacctgatcagcagcattgaccccggggccttctggggcctgagcagcctgaagaggctggacctgaccaacaacagaattggctgcctgaatgctgacatcttccggggcctgaccaacctggtgcggctgaacctgagcggcaacctcttcagcagcctgagccagggcacctttgactacctggccagcctgcggagcctggagttccagacagagtacctgctgtgtgactgcaacatcctgtggatgcaccgctgggtgaaggagaagaacatcaccgtgcgggacacccgctgtgtgtaccccaagagcctgcaggcccagcctgtgactggagtgaagcaggagctgctgacctgtgacccccccctggagctgcccagcttctacatgacccccagccaccggcaggtggtgtttgaaggagacagcctgcccttccagtgcatggccagctacatcgaccaggacatgcaggtgctgtggtaccaggacggcagaattgtggagacagatgagagccagggcatctttgtggagaagaacatgatccacaactgcagcctgattgccagcgccctgaccatcagcaacatccaggccggcagcactggaaactggggctgccacgtgcagaccaagaggggcaacaacaccaggacagtggacatcgtggtgctggagagcagcgcccagtactgccccccagagcgggtggtgaacaacaagggggacttccgctggcccaggaccctggccggcatcacagcctacctgcagtgcaccaggaacacccacggcagcggcatctacccaggcaacccccaggatgagaggaaggcctggaggcgctgtgacagaggaggcttctgggcagatgatgactacagccgctgccagtatgccaatgatgtgaccagggtgctgtacatgttcaaccagatgcccctgaacctgaccaatgctgtggccacagcccggcagctgctggcctacacagtggaggccgccaacttcagtgacaagatggatgtgatctttgtggccgagatgattgagaagtttggccgcttcaccaaggaggagaagagcaaggagctgggagatgtgatggtggacatcgccagcaacatcatgctggctgatgagcgggtgctgtggctggcccagcgggaggccaaggcctgcagccgcatcgtgcagtgcctgcagagaattgccacctaccgcctggccggcggggcccacgtgtacagcacctacagccccaacatcgccctggaggcctacgtgatcaagagcacaggcttcaccggcatgacctgcaccgtcttccagaaggtggccgccagtgacagaacaggcctgagtgactatggccggcgggaccctgagggcaacctggacaagcagctgtccttcaagtgcaatgtgagcaacaccttcagcagcctggccctgaaggtgtgctacatcctgcagagcttcaagaccatctacagctag

SEQ ID NO: 153174 - DNA, 1146 bp, Artificial Sequence
  Description of Artificial Sequence: Synthetic coding sequence
atgcccctgaagaggaacaacagcaagtacccacccctggagctgcccagcttctacatgacccccagccaccggcaggtggtgtttgaaggagacagcctgcccttccagtgcatggccagctacatcgaccaggacatgcaggtgctgtggtaccaggacggcagaattgtggagacagatgagagccagggcatctttgtggagaagaacatgatccacaactgcagcctgattgccagcgccctgaccatcagcaacatccaggccggcagcactggaaactggggctgccacgtgcagaccaagaggggcaacaacaccaggacagtggacatcgtggtgctggagagcagcgcccagtactgccccccagagcgggtggtgaacaacaagggggacttccgctggcccaggaccctggccggcatcacagcctacctgcagtgcaccaggaacacccacggcagcggcatctacccaggcaacccccaggatgagaggaaggcctggaggcgctgtgacagaggaggcttctgggcagatgatgactacagccgctgccagtatgccaatgatgtgaccagggtgctgtacatgttcaaccagatgcccctgaacctgaccaatgctgtggccacagcccggcagctgctggcctacacagtggaggccgccaacttcagtgacaagatggatgtgatctttgtggccgagatgattgagaagtttggccgcttcaccaaggaggagaagagcaaggagctgggagatgtgatggtggacatcgccagcaacatcatgctggctgatgagcgggtgctgtggctggcccagcgggaggccaaggcctgcagccgcatcgtgcagtgcctgcagagaattgccacctaccgcctggccggcggggcccacgtgtacagcacctacagccccaacatcgccctggaggcctacgtgatcaagagcacaggcttcaccggcatgacctgcaccgtcttccagaaggtggccgccagtgacagaacaggcctgagtgactatggccggcgggaccctgagggcaacctggacaagcagctgtccttcaagtgcaatgtgagcaacaccttcagcagcctggccctgaagggcaagttcagatag

SEQ ID NO: 153175 - DNA, 2724 bp, Artificial Sequence
  Description of Artificial Sequence: Synthetic coding sequence
atgcccacagctgctgcccccatcatcagctctgtgcagaagctggtgctgtatgagacccgggcccgctacttcctggtgggcagcaacaatgctgagaccaagtacagagtgctgaagattgacagaacagagcccaaggacctggtgatcattgatgacagacatgtgtacacccagcaggaggtgcgggagctgctgggccgcctggacctgggcaacagaaccaagatgggccagaagggcagcagcggcctcttccgggctgtgtctgcctttggagtggtgggctttgtgcgcttcctggagggctactacatcgtgctgatcaccaagaggaggaagatggctgacattggaggccacgccatctacaaggtggaggacaccaacatgatctacatccccaatgattctgtgcgggtgacccacccagatgaggcccgctacctgcgcatcttccagaatgtggacctgagcagcaacttctacttctcctacagctatgacctgagccacagcctgcagtacaacctgactgtgctgaggatgcccctggagatgctgaagtctgagatgacccagaaccggcaggagagctttgacatctttgaagatgagggcctcatcacccagggcggcagcggcgtgtttggcatctgcagcgagccctacatgaagtatgtgtggaatggagagctgctggacatcatcaagagcacagtgcaccgggactggctgctgtacatcatccacggcttctgtggccagagcaagctgctgatctacggccggcctgtgtatgtgaccctcatcgcccggcgcagcagcaagtttgctggcacccgcttcctgaagagaggagccaactgtgaaggagatgtggccaatgaggtggagacagagcagatcctgtgtgatgcctctgtgatgtccttcaccgctggcagctacagcagctatgtgcaggtgcggggctctgtgcccctgtactggagccaggacatcagcaccatgatgcccaagccacccatcaccctggaccaggccgacccctttgcccacgtggccgccctgcactttgaccagatgttccagcgcttcggcagccccatcatcatcctgaacctggtgaaggagcgggagaagaggaagcatgagcgcatcctgtctgaggagctggtggccgctgtgacctacctgaaccagttcctgcccccagagcacaccatcgtgtacatcccctgggacatggccaagtacaccaagagcaagctgtgcaatgtgctggaccggctgaatgtgattgctgagagcgtggtgaagaagacaggcttctttgtgaacagaccagacagctactgcagcatcctgcggccagatgagaagtggaatgagctgggcggctgcgtcatccccaccggccgcctgcagacaggcatcctgcggaccaactgtgtggactgcctggacaggaccaacacagcccagttcatggtgggcaaatgtgccctggcctaccagctgtacagcctgggcctgattgacaagcccaacctgcagtttgacacagatgctgtgcggctgtttgaggagctgtatgaagatcatggagacaccctgagcctgcagtatggaggcagccagctggtgcaccgggtgaagacctacaggaagatcgccccctggacccagcacagcaaggacatcatgcagaccctgagccgctactacagcaatgccttcagtgatgctgaccggcaggacagcatcaacctcttcctgggcgtcttccaccccacagagggcaagccccacctgtgggagctgcccacagacttctacctgcaccacaagaacaccatgaggctgctgcccacccggcgcagctacacctactggtggaccccagaggtgatcaagcacctgcccctgccctatgatgaggtgatctgtgctgtgaacctgaagaagctgattgtgaagaagttccacaagtatgaggaggagattgacatccacaatgagttcttccggccctatgagctgagcagctttgatgacaccttctgcctggccatgaccagcagcgcccgggacttcatgcccaagacagtgggcatcgaccccagccccttcaccgtgaggaagccagatgaaacaggcaagtctgtgctgggcaacaagagcaaccgggaggaggccgtgctgcagaggaagacagctgccagcgcccctcctccacccagcgaggaggccgtgagcagcagcagtgaagatgacagcggcacagaccgggaggaggagggctctgtgtcccagaggagcacccctgtgaagatgacagatgctggggacagcgccaaggtgacagaaaatgtggtgcagcccatgaaggagctgtatggcatcaacctgagtgatggcctgtctgaggaggacttcagcatctacagcagatttgtgcagctgggccagagccagcacaagcaggacaagaacagccagcagccctgcagccgctgcagtgatggagtcatcaagctgacccccatcagcgccttcagccaggacaacatctatgaggtgcagcccccccgggtggacaggaagagcacagagatcttccaggcccacatccaggccagccagggcatcatgcagcccctgggcaaggaggacagctccatgtaccgggagtacatccggaaccgctacctgtag

SEQ ID NO: 153176 - DNA, 3582 bp, Artificial Sequence
  Description of Artificial Sequence: Synthetic coding sequence
atgatgttcagaagtgacaggatgtggagctgccactggaagtggaagcccagccccctgctcttcctgtttgccctgtacatcatgtgtgtgccccacagcgtgtggggctgtgccaactgccgggtggtgctgagcaaccccagcggcaccttcaccagcccctgctacccaaatgactaccccaacagccaggcctgcatgtggaccctgcgggcccccaccggctacatcatccagatcaccttcaatgactttgacatcgaggaggcccccaactgcatctatgacagcctgagcctggacaatggagagagccagaccaagttctgtggggccacagccaagggcctgtccttcaacagcagcgccaatgagatgcacgtgtccttcagcagtgacttcagcatccagaagaagggcttcaatgccagctacatccgggtggccgtgtccctgaggaaccagaaggtgatcctgccccagaccagtgatgcctaccaggtgtctgtggccaagagcatcagcatccctgagctgagcgccttcaccctgtgctttgaggccaccaaggtgggccatgaagattctgactggacagccttctcctacagcaatgccagcttcacccagctgctgagctttgggaaggccaagagcggctacttcctgagcatcagtgacagcaagtgcctgctgaacaatgccctgcctgtgaaggagaaggaggacatctttgctgagagctttgagcagctgtgcctggtgtggaacaacagcctgggcagcattggagtgaacttcaagaggaactatgagaccgtgccctgtgacagcaccatcagcaaggtgattcctggaaatggcaagctgctgctgggcagcaaccagaatgagatcgtgtccctgaagggggacatctacaacttccggctgtggaacttcaccatgaatgccaagatcctgagcaacctgagctgcaatgtgaagggaaatgtggtggactggcagaatgacttctggaacatccccaacctggccctgaaggccgagagcaacctgagctgtggcagctacctgatccccctgcctgctgctgagctggccagctgtgccgacctgggcaccctgtgccaggacggcatcatctaccgcatctctgtggtgatccagaacatcctgcggcaccctgaggtgaaggtgcagagcaaggtggccgagtggctgaacagcaccttccagaactggaactacacagtgtatgtggtgaacatctccttccacctgtctgctggggaggacaagatcaaggtgaagaggagcctggaggatgagccccggctggtgctgtgggccctgctggtgtacaatgccaccaacaacaccaacctggagggcaagatcatccagcagaagctgctgaagaacaatgaaagcctggatgagggcctgcggctgcacacagtgaatgtgcggcagctgggccactgcctggccatggaggagcccaagggctactactggcccagcatccagcccagtgaatatgtgctgccctgcccagacaagccaggcttcagcgccagccgcatctgcttctacaatgccaccaaccccctggtgacctactggggccctgtggacatcagcaactgcctgaaggaggccaatgaggtggccaaccagatcctgaacctgacagcagatggccagaacctgaccagcgccaacatcaccaacatcgtggagcaggtgaagagaattgtgaacaaggaggagaacatcgacatcaccctgggcagcaccctgatgaacatcttcagcaacatcctgagcagcagtgacagcgacctgctggagagcagcagcgaggccctgaagaccattgatgagctggccttcaagattgacctgaacagcaccagccacgtgaacatcaccaccaggaacctggccctgtctgtgagcagcctgctgcccggcaccaatgccatcagcaacttcagcatcggcctgcccagcaacaatgaaagctacttccagatggactttgagagcggccaggtggaccccctggccagcgtcatcctgccccccaacctgctggagaacctgagccctgaggacagcgtgctggtgcggcgggcccagttcaccttcttcaacaagacaggcctcttccaggatgtgggcccccagaggaagaccctggtgtcctatgtgatggcctgcagcatcggcaacatcaccatccagaacctgaaggaccctgtgcagatcaagatcaagcacaccaggacccaggaggtgcaccaccccatctgtgccttctgggacctgaacaagaacaagagctttggaggctggaacaccagcggctgtgtggcccaccgggacagtgatgccagcgagaccgtgtgcctgtgcaaccacttcacccactttggagtgctgatggacctgcccaggtctgccagccagctggatgccaggaacaccaaggtgctgaccttcatctcctacatcggctgcggcatcagcgccatcttctctgctgccaccctgctgacctacgtggcctttgagaagctgcggcgggactaccccagcaagatcctgatgaacctgagcacagccctgctcttcctgaacctgctcttcctgctggatggctggatcaccagcttcaacgtggatggcctgtgcatcgctgtggccgtgctgctgcacttcttcctgctggccaccttcacctggatgggcctggaggccatccacatgtacatcgccctggtgaaggtgttcaacacctacatccgccgctacatcctgaagttctgcatcatcggctggggcctgcctgccctggtggtgtctgtggtgctggccagcaggaacaacaatgaggtgtatggcaaggagagctatggcaaggagaagggagatgagttctgctggatccaggaccccgtcatcttctacgtgacctgtgccggctactttggagtgatgttcttcctgaacatcgccatgtttattgtggtgatggtgcagatctgtggcagaaatggcaagaggagcaacagaaccctgcgggaggaggtgctgaggaacctgcggtctgtggtgtccctgaccttcctgctgggcatgacctggggctttgccttctttgcctggggccccctgaacatccccttcatgtacctgttcagcatcttcaacagcctgcagggcctcttcatcttcatcttccactgtgccatgaaggaaaatgtgcagaagcagtggaggcagcacctgtgctgcggccgcttccggctggccgacaacagcgactggagcaagacagccaccaacatcatcaagaagagcagtgacaacctgggcaagagcctgagcagcagcagcatcggcagcaacagcacctacctgaccagcaagagcaagagcagcagcaccacctacttcaagaggaacagccacacagacaacgtgtcctatgagcacagcttcaacaagagcggcagcctgcggcagtgcttccacggccaggtgctggtgaagacaggcccctgctag

SEQ ID NO: 153177 - DNA, 3669 bp, Artificial Sequence
  Description of Artificial Sequence: Synthetic coding sequence
atgatgttcagaagtgacaggatgtggagctgccactggaagtggaagcccagccccctgctcttcctgtttgccctgtacatcatgtgtgtgccccacagcgtgtggggctgtgccaactgccgggtggtgctgagcaaccccagcggcaccttcaccagcccctgctacccaaatgactaccccaacagccaggcctgcatgtggaccctgcgggcccccaccggctacatcatccagatcaccttcaatgactttgacatcgaggaggcccccaactgcatctatgacagcctgagcctggacaatggagagagccagaccaagttctgtggggccacagccaagggcctgtccttcaacagcagcgccaatgagatgcacgtgtccttcagcagtgacttcagcatccagaagaagggcttcaatgccagctacatccgggtggccgtgtccctgaggaaccagaaggtgatcctgccccagaccagtgatgcctaccaggtgtctgtggccaagagcatcagcatccctgagctgagcgccttcaccctgtgctttgaggccaccaaggtgggccatgaagattctgactggacagccttctcctacagcaatgccagcttcacccagctgctgagctttgggaaggccaagagcggctacttcctgagcatcagtgacagcaagtgcctgctgaacaatgccctgcctgtgaaggagaaggaggacatctttgctgagagctttgagcagctgtgcctggtgtggaacaacagcctgggcagcattggagtgaacttcaagaggaactatgagaccgtgccctgtgacagcaccatcagcaaggtgattcctggaaatggcaagctgctgctgggcagcaaccagaatgagatcgtgtccctgaagggggacatctacaacttccggctgtggaacttcaccatgaatgccaagatcctgagcaacctgagctgcaatgtgaagggaaatgtggtggactggcagaatgacttctggaacatccccaacctggccctgaaggccgagagcaacctgagctgtggcagctacctgatccccctgcctgctgctgagctggccagctgtgccgacctgggcaccctgtgccaggacggcatcatctaccgcatctctgtggtgatccagaacatcctgcggcaccctgaggtgaaggtgcagagcaaggtggccgagtggctgaacagcaccttccagaactggaactacacagtgtatgtggtgaacatctccttccacctgtctgctggggaggacaagatcaaggtgaagaggagcctggaggatgagccccggctggtgctgtgggccctgctggtgtacaatgccaccaacaacaccaacctggagggcaagatcatccagcagaagctgctgaagaacaatgaaagcctggatgagggcctgcggctgcacacagtgaatgtgcggcagctgggccactgcctggccatggaggagcccaagggctactactggcccagcatccagcccagtgaatatgtgctgccctgcccagacaagccaggcttcagcgccagccgcatctgcttctacaatgccaccaaccccctggtgacctactggggccctgtggacatcagcaactgcctgaaggaggccaatgaggtggccaaccagatcctgaacctgacagcagatggccagaacctgaccagcgccaacatcaccaacatcgtggagcaggtgaagagaattgtgaacaaggaggagaacatcgacatcaccctgggcagcaccctgatgaacatcttcagcaacatcctgagcagcagtgacagcgacctgctggagagcagcagcgaggccctgaagaccattgatgagctggccttcaagattgacctgaacagcaccagccacgtgaacatcaccaccaggaacctggccctgtctgtgagcagcctgctgcccggcaccaatgccatcagcaacttcagcatcggcctgcccagcaacaatgaaagctacttccagatggactttgagagcggccaggtggaccccctggccagcgtcatcctgccccccaacctgctggagaacctgagccctgaggacagcgtgctggtgcggcgggcccagttcaccttcttcaacaagacaggcctcttccaggatgtgggcccccagaggaagaccctggtgtcctatgtgatggcctgcagcatcggcaacatcaccatccagaacctgaaggaccctgtgcagatcaagatcaagcacaccaggacccaggaggtgcaccaccccatctgtgccttctgggacctgaacaagaacaagagctttggaggctggaacaccagcggctgtgtggcccaccgggacagtgatgccagcgagaccgtgtgcctgtgcaaccacttcacccactttggagtgctgatggacctgcccaggtctgccagccagctggatgccaggaacaccaaggtgctgaccttcatctcctacatcggctgcggcatcagcgccatcttctctgctgccaccctgctgacctacgtggcctttgagaagctgcggcgggactaccccagcaagatcctgatgaacctgagcacagccctgctcttcctgaacctgctcttcctgctggatggctggatcaccagcttcaacgtggatggcctgtgcatcgctgtggccgtgctgctgcacttcttcctgctggccaccttcacctggatgggcctggaggccatccacatgtacatcgccctggtgaaggtgttcaacacctacatccgccgctacatcctgaagttctgcatcatcggctggggcctgcctgccctggtggtgtctgtggtgctggccagcaggaacaacaatgaggtgtatggcaaggagagctatggcaaggagaagggagatgagttctgctggatccaggaccccgtcatcttctacgtgacctgtgccggctactttggagtgatgttcttcctgaacatcgccatgtttattgtggtgatggtgcagatctgtggcagaaatggcaagaggagcaacagaaccctgcgggaggaggtgctgaggaacctgcggtctgtggtgtccctgaccttcctgctgggcatgacctggggctttgccttctttgcctggggccccctgaacatccccttcatgtacctgttcagcatcttcaacagcctgcagggcctcttcatcttcatcttccactgtgccatgaaggaaaatgtgcagaagcagtggaggcagcacctgtgctgcggccgcttccggctggccgacaacagcgactggagcaagacagccaccaacatcatcaagaagagcagtgacaacctgggcaagagcctgagcagcagcagcatcggcagcaacagcacctacctgaccagcaagagcaagagcagcagcaccacctacttcaagaggaacagccacacagattctgcctccatggacaagagcctgagcaagctggcccacgcagatggagaccagaccagcatcatccctgtgcaccaggtgattgacaaggtgaagggctactgcaatgcccacagcgacaacttctacaagaacatcatcatgtctgacaccttcagccacagcaccaagttctag

SEQ ID NO: 153178 - DNA, 3753 bp, Artificial Sequence
  Description of Artificial Sequence: Synthetic coding sequence
atgatgttcagaagtgacaggatgtggagctgccactggaagtggaagcccagccccctgctcttcctgtttgccctgtacatcatgtgtgtgccccacagcgtgtggggctgtgccaactgccgggtggtgctgagcaaccccagcggcaccttcaccagcccctgctacccaaatgactaccccaacagccaggcctgcatgtggaccctgcgggcccccaccggctacatcatccagatcaccttcaatgactttgacatcgaggaggcccccaactgcatctatgacagcctgagcctggacaatggagagagccagaccaagttctgtggggccacagccaagggcctgtccttcaacagcagcgccaatgagatgcacgtgtccttcagcagtgacttcagcatccagaagaagggcttcaatgccagctacatccgggtggccgtgtccctgaggaaccagaaggtgatcctgccccagaccagtgatgcctaccaggtgtctgtggccaagagcatcagcatccctgagctgagcgccttcaccctgtgctttgaggccaccaaggtgggccatgaagattctgactggacagccttctcctacagcaatgccagcttcacccagctgctgagctttgggaaggccaagagcggctacttcctgagcatcagtgacagcaagtgcctgctgaacaatgccctgcctgtgaaggagaaggaggacatctttgctgagagctttgagcagctgtgcctggtgtggaacaacagcctgggcagcattggagtgaacttcaagaggaactatgagaccgtgccctgtgacagcaccatcagcaaggtgattcctggaaatggcaagctgctgctgggcagcaaccagaatgagatcgtgtccctgaagggggacatctacaacttccggctgtggaacttcaccatgaatgccaagatcctgagcaacctgagctgcaatgtgaagggaaatgtggtggactggcagaatgacttctggaacatccccaacctggccctgaaggccgagagcaacctgagctgtggcagctacctgatccccctgcctgctgctgagctggccagctgtgccgacctgggcaccctgtgccaggccaccgtgaacagccccagcaccaccccacccaccgtgaccaccaacatgcctgtgaccaacagaattgacaagcagagaaatgatggcatcatctaccgcatctctgtggtgatccagaacatcctgcggcaccctgaggtgaaggtgcagagcaaggtggccgagtggctgaacagcaccttccagaactggaactacacagtgtatgtggtgaacatctccttccacctgtctgctggggaggacaagatcaaggtgaagaggagcctggaggatgagccccggctggtgctgtgggccctgctggtgtacaatgccaccaacaacaccaacctggagggcaagatcatccagcagaagctgctgaagaacaatgaaagcctggatgagggcctgcggctgcacacagtgaatgtgcggcagctgggccactgcctggccatggaggagcccaagggctactactggcccagcatccagcccagtgaatatgtgctgccctgcccagacaagccaggcttcagcgccagccgcatctgcttctacaatgccaccaaccccctggtgacctactggggccctgtggacatcagcaactgcctgaaggaggccaatgaggtggccaaccagatcctgaacctgacagcagatggccagaacctgaccagcgccaacatcaccaacatcgtggagcaggtgaagagaattgtgaacaaggaggagaacatcgacatcaccctgggcagcaccctgatgaacatcttcagcaacatcctgagcagcagtgacagcgacctgctggagagcagcagcgaggccctgaagaccattgatgagctggccttcaagattgacctgaacagcaccagccacgtgaacatcaccaccaggaacctggccctgtctgtgagcagcctgctgcccggcaccaatgccatcagcaacttcagcatcggcctgcccagcaacaatgaaagctacttccagatggactttgagagcggccaggtggaccccctggccagcgtcatcctgccccccaacctgctggagaacctgagccctgaggacagcgtgctggtgcggcgggcccagttcaccttcttcaacaagacaggcctcttccaggatgtgggcccccagaggaagaccctggtgtcctatgtgatggcctgcagcatcggcaacatcaccatccagaacctgaaggaccctgtgcagatcaagatcaagcacaccaggacccaggaggtgcaccaccccatctgtgccttctgggacctgaacaagaacaagagctttggaggctggaacaccagcggctgtgtggcccaccgggacagtgatgccagcgagaccgtgtgcctgtgcaaccacttcacccactttggagtgctgatggacctgcccaggtctgccagccagctggatgccaggaacaccaaggtgctgaccttcatctcctacatcggctgcggcatcagcgccatcttctctgctgccaccctgctgacctacgtggcctttgagaagctgcggcgggactaccccagcaagatcctgatgaacctgagcacagccctgctcttcctgaacctgctcttcctgctggatggctggatcaccagcttcaacgtggatggcctgtgcatcgctgtggccgtgctgctgcacttcttcctgctggccaccttcacctggatgggcctggaggccatccacatgtacatcgccctggtgaaggtgttcaacacctacatccgccgctacatcctgaagttctgcatcatcggctggggcctgcctgccctggtggtgtctgtggtgctggccagcaggaacaacaatgaggtgtatggcaaggagagctatggcaaggagaagggagatgagttctgctggatccaggaccccgtcatcttctacgtgacctgtgccggctactttggagtgatgttcttcctgaacatcgccatgtttattgtggtgatggtgcagatctgtggcagaaatggcaagaggagcaacagaaccctgcgggaggaggtgctgaggaacctgcggtctgtggtgtccctgaccttcctgctgggcatgacctggggctttgccttctttgcctggggccccctgaacatccccttcatgtacctgttcagcatcttcaacagcctgcagggcctcttcatcttcatcttccactgtgccatgaaggaaaatgtgcagaagcagtggaggcagcacctgtgctgcggccgcttccggctggccgacaacagcgactggagcaagacagccaccaacatcatcaagaagagcagtgacaacctgggcaagagcctgagcagcagcagcatcggcagcaacagcacctacctgaccagcaagagcaagagcagcagcaccacctacttcaagaggaacagccacacagattctgcctccatggacaagagcctgagcaagctggcccacgcagatggagaccagaccagcatcatccctgtgcaccaggtgattgacaaggtgaagggctactgcaatgcccacagcgacaacttctacaagaacatcatcatgtctgacaccttcagccacagcaccaagttctag

SEQ ID NO: 153179 - DNA, 2394 bp, Artificial Sequence
  Description of Artificial Sequence: Synthetic coding sequence
atggccagctgccgggcctggaacctgcgggtgctggtggccgtggtgtgtggcctgctgaccggcatcatcctgggcctgggcatctggagaattgtcatccgcatccagaggggcaagagcaccagcagcagcagcacccccacagagttctgcagaaatggaggcacctgggagaatggccgctgcatctgcacagaggagtggaagggcctgcgctgcaccatcgccaacttctgtgagaacagcacctacatgggcttcacctttgcccgcatccctgtgggccgctatggccccagcctgcagacctgtgggaaggacaccccaaatgccggcaaccccatggctgtgcggctgtgcagcctgagcctgtatggagaaattgagctgcagaaggtgaccatcggcaactgcaatgaaaacctggagaccctggagaagcaggtgaaggatgtgacagcccccctgaacaacatcagcagcgaggtgcagatcctgaccagtgatgccaacaagctgacagctgagaacatcaccagcgccaccagggtggtgggccagatcttcaacaccagcagaaatgccagccctgaggccaagaaggtggccatcgtgacagtgtcccagctgctggatgcctctgaagatgccttccagagggtggccgccacagccaatgatgatgccctgaccaccctgattgagcagatggagacctacagcctgagcctgggcaaccagagcgtggtggagcccaacatcgccatccagagcgccaacttcagcagtgaaaatgctgtgggccccagcaatgtgcgcttctctgtgcagaagggggccagcagcagcctggtgagcagcagcaccttcatccacaccaacgtggatggcctgaacccagatgcccagacagagctgcaggtgctgctgaacatgaccaagaactacaccaagacctgtggctttgtggtgtaccagaatgacaagctgttccagagcaagaccttcaccgccaagagtgacttcagccagaagatcatcagcagcaagacagatgaaaatgagcaggaccagagcgcctctgtggacatggtgttcagccccaagtacaaccagaaggagttccagctgtacagctatgcctgtgtgtactggaacctgagcgccaaggactgggacacctacggctgccagaaggacaagggcacagatggcttcctgcgctgccgctgcaaccacaccaccaactttgctgtgctgatgaccttcaagaaggactaccagtaccccaagagcctggacatcctgagcaatgtgggctgtgccctgtctgtgacaggcctggccctgaccgtcatcttccagatcgtgaccaggaaggtgaggaagacctctgtgacctgggtgctggtgaacctgtgcatctccatgctgatcttcaacctgctgtttgtgtttggaattgagaacagcaacaagaacctgcagaccagtgatggagacatcaacaacatcgactttgacaacaatgacatccccaggacagacaccatcaacatccccaaccccatgtgcacagccatcgccgccctgctgcactacttcctgctggtgaccttcacctggaatgccctgtctgctgcccagctgtactacctgctgatccgcaccatgaagcccctgcccaggcacttcatcctcttcatcagcctgattggctggggcgtgcctgccatcgtggtggccatcaccgtgggcgtcatctacagccagaatggaaacaacccccagtgggagctggactaccggcaggagaagatctgctggctggccatccctgagcccaatggagtcatcaagagccccctgctgtggagcttcatcgtgcctgtgaccatcatcctgatcagcaatgtggtgatgttcatcaccatcagcatcaaggtgctgtggaagaacaaccagaacctgaccagcaccaagaaggtgtcctccatgaagaagatcgtgtccaccctgtctgtggccgtggtgtttggcatcacctggatcctggcctacctgatgctggtgaatgatgacagcatcagaattgtgttctcctacatcttctgcctcttcaacaccacccagggcctgcagatcttcatcctgtacacagtgaggaccaaggtgttccagagcgaggccagcaaggtgctgatgctgctgagcagcattggaagaaggaagagcctgcccagcgtgacccggccccggctgcgggtgaagatgtacaacttcctgcggagcctgcccaccctgcacgagcgcttccggctgctggagaccagccccagcacagaggagatcaccctgtctgagagtgacaatgccaaggagagcatctag

SEQ ID NO: 153180 - DNA, 1509 bp, Artificial Sequence
  Description of Artificial Sequence: Synthetic coding sequence
atgcctgtgaagatgctgttcaaggagctgctgctgctgctgatgatgatgcccctgcagcactacaccaagacctgtggctttgtggtgtaccagaatgacaagctgttccagagcaagaccttcaccgccaagagtgacttcagccagaagatcatcagcagcaagacagatgaaaatgagcaggaccagagcgcctctgtggacatggtgttcagccccaagtacaaccagaaggagttccagctgtacagctatgcctgtgtgtactggaacctgagcgccaaggactgggacacctacggctgccagaaggacaagggcacagatggcttcctgcgctgccgctgcaaccacaccaccaactttgctgtgctgatgaccttcaagaaggactaccagtaccccaagagcctggacatcctgagcaatgtgggctgtgccctgtctgtgacaggcctggccctgaccgtcatcttccagatcgtgaccaggaaggtgaggaagacctctgtgacctgggtgctggtgaacctgtgcatctccatgctgatcttcaacctgctgtttgtgtttggaattgagaacagcaacaagaacctgcagaccagtgatggagacatcaacaacatcgactttgacaacaatgacatccccaggacagacaccatcaacatccccaaccccatgtgcacagccatcgccgccctgctgcactacttcctgctggtgaccttcacctggaatgccctgtctgctgcccagctgtactacctgctgatccgcaccatgaagcccctgcccaggcacttcatcctcttcatcagcctcatcggctggggcgtgcctgccatcgtggtggccatcaccgtgggcgtcatctacagccagaatggaaacaacccccagtgggagctggactaccggcaggagaagatctgctggctggccatccctgagcccaacggggtcatcaagagccccctgctgtggagcttcatcgtgcctgtgaccatcatcctgatcagcaatgtggtgatgttcatcaccatcagcatcaaggtgctgtggaagaacaaccagaacctgaccagcaccaagaaggtgtcctccatgaagaagatcgtgtccaccctgtctgtggccgtggtgtttggcatcacctggatcctggcctacctgatgctggtgaatgatgacagcatccgcatcgtgttctcctacatcttctgcctcttcaacaccacccagggcctgcagatcttcatcctgtacacagtgaggaccaaggtgttccagagcgaggccagcaaggtgctgatgctgctgagcagcatcggccgcaggaagagcctgcccagcgtgacccggccccggctgcgggtgaagatgtacaacttcctgcggagcctgcccaccctgcacgagcgcttccggctgctggagaccagccccagcacagaggagatcaccctgtctgagagtgacaatgccaaggagagcatctag

SEQ ID NO: 153181 - DNA, 1143 bp, Artificial Sequence
  Description of Artificial Sequence: Synthetic coding sequence
atgtgccccatgctgctgaagaatggctacaatggaaatgccacccctgtgaccaccacagccccctgggccagcctgggcctgagcgccaagacctgcaacaacgtgtcctttgaggagagcagaattgtgctggtggtggtgtacagcgctgtgtgcaccctgggcgtgcctgccaactgcctgacagcctggctggccctgctgcaggtgctgcagggcaatgtgctggccgtgtacctgctgtgcctggccctgtgtgagctgctgtacacaggcaccctgcccctgtgggtgatctacatccggaaccagcaccgctggaccctgggcctgctggcctgcaaggtgacagcctacatcttcttctgcaacatctacgtgtccatcctcttcctgtgctgcatcagctgtgacagatttgtggccgtggtgtatgccctggagagccggggcagaagaagaagaagaacagccatcctgatcagcgcctgcatcttcatcctggtgggcatcgtgcactaccctgtgttccagacagaggacaaggagacctgctttgacatgctgcagatggacagcagaattgctggctactactatgcccgcttcaccgtgggctttgccatccccctgagcatcatcgccttcaccaaccaccgcatcttccgcagcatcaagcagagcatgggcctgtctgctgcccagaaggccaaggtgaagcacagcgccatcgctgtggtggtgatcttcctggtgtgctttgccccctaccacctggtgctgctggtgaaggctgctgccttctcctactacagaggagacagaaatgccatgtgtggcctggaggagcggctgtacacagcctctgtggtgttcctgtgcctgagcacagtgaatggagtggccgaccccatcatctacgtgctggccacagaccacagccggcaggaggtgagccgcatccacaagggctggaaggagtggagcatgaagacagatgtgacccggctgacccacagccgggacacagaggagctgcagagccctgtggccctggccgaccactacaccttcagcaggcctgtgcaccccccaggcagcccctgcccagccaagaggctcatcgaggagagctgctag

SEQ ID NO: 153182 - DNA, 1116 bp, Artificial Sequence
  Description of Artificial Sequence: Synthetic coding sequence
atgcctggaaatgccacccctgtgaccaccacagccccctgggccagcctgggcctgagcgccaagacctgcaacaacgtgtcctttgaggagagccgcatcgtgctggtggtggtgtacagcgctgtgtgcaccctgggcgtgcctgccaactgcctgacagcctggctggccctgctgcaggtgctgcagggcaatgtgctggccgtgtacctgctgtgcctggccctgtgtgagctgctgtacacaggcaccctgcccctgtgggtgatctacatccggaaccagcaccgctggaccctgggcctgctggcctgcaaggtgacagcctacatcttcttctgcaacatctacgtgtccatcctcttcctgtgctgcatcagctgtgacagatttgtggccgtggtgtatgccctggagagccggggcagaagaagaagaagaacagccatcctgatcagcgcctgcatcttcatcctggtgggcatcgtgcactaccctgtgttccagacagaggacaaggagacctgctttgacatgctgcagatggacagcagaattgctggctactactatgcccgcttcaccgtgggctttgccatccccctgagcatcatcgccttcaccaaccaccgcatcttccgcagcatcaagcagagcatgggcctgtctgctgcccagaaggccaaggtgaagcacagcgccatcgctgtggtggtgatcttcctggtgtgctttgccccctaccacctggtgctgctggtgaaggccgccgccttctcctactacagaggagacagaaatgccatgtgtggcctggaggagcggctgtacacagcctctgtggtgttcctgtgcctgagcacagtgaatggagtggccgaccccatcatctacgtgctggccacagaccacagccggcaggaggtgagccgcatccacaagggctggaaggagtggagcatgaagacagatgtgacccggctgacccacagccgggacacagaggagctgcagagccctgtggccctggccgaccactacaccttcagcaggcctgtgcaccccccaggcagcccctgcccagccaagaggctgattgaggagagctgctag

SEQ ID NO: 153183 - DNA, 1143 bp, Artificial Sequence; identical to SEQ ID NO: 153181
  Description of Artificial Sequence: Synthetic coding sequence

SEQ ID NO: 153184 - DNA, 33 bp, Artificial Sequence
  Description of Artificial Sequence: Synthetic coding sequence
atgtgccccatgctgctgaagaatggctactag

SEQ ID NO: 153185 - DNA, 2625 bp, Artificial Sequence
  Description of Artificial Sequence: Synthetic coding sequence
atggagaagctgctgcggctgtgctgctggtacagctggctgctgctcttctactacaacttccaggtgcggggcgtgtacagccgcagccaggaccaccctggcttccaggtgctggccagcgccagccactactggcccctggagaatgtggatggcatccacgagctgcaggacaccactggagacatcgtggagggcaaggtgaacaagggcatctacctgaaggaggagaagggcgtgaccctgctgtactacggccgctacaacagcagctgcatcagcaagccagagcagtgtggccctgagggcgtgaccttctccttcttctggaagacccagggcgagcagagccggcccatccccagcgcctatggaggccaggtgatcagcaatggcttcaaggtgtgcagcagcggcggccggggctctgtggagctgtacacccgggacaacagcatgacctgggaggccagcttcagccccccaggcccctactggacccacgtgctcttcacctggaagagcaaggagggcctgaaggtgtatgtgaatggcaccctgagcaccagtgaccccagcggcaaggtgtcccgggactatggagagagcaatgtgaacctggtgattggcagcgagcaggaccaggccaagtgctatgaaaatggagcctttgatgagttcatcatctgggagcgggccctgaccccagatgagatcgccatgtacttcaccgctgccatcggcaagcacgccctgctgagcagcaccctgcccagcctcttcatgaccagcacagccagccctgtgatgcccacagatgcctaccaccccatcatcaccaacctgacagaggagaggaagaccttccagagccctggggtcatcctgagctacctgcagaatgtgtccctgagcctgcccagcaagagcctgtctgagcagacagccctgaacctgaccaagaccttcctgaaggctgtgggggagatcctgctgctgcccggctggatcgccctgtctgaggacagcgctgtggtgctgagcctgattgacaccatcgacacagtgatgggccacgtgagcagcaacctgcacggcagcaccccccaggtgacagtggagggcagcagcgccatggccgagttctctgtggccaagatcctgcccaagacagtgaacagcagccactaccgcttccctgcccacggccagagcttcatccagatcccccatgaggccttccacagacatgcctggagcacagtggtgggcctgctgtaccacagcatgcactactacctgaacaacatctggccagcccacaccaagattgctgaggccatgcaccaccaggactgcctgctgtttgccaccagccacctgatcagcctggaggtgtccccaccacccaccctgagccagaacctgagcggcagccccctcatcaccgtgcacctgaagcaccggctgaccaggaagcagcacagcgaggccaccaacagcagcaacagagtgtttgtgtactgtgccttcctggacttcagcagtggagagggcgtgtggagcaaccacggctgtgccctgacccggggcaacctgacctacagcgtgtgccgctgcacccacctgaccaactttgccatcctgatgcaggtggtgcccctggagctggcccggggccaccaggtggccctgagcagcatctcctatgtgggctgcagcctgtctgtgctgtgcctggtggccaccctggtgacctttgctgtgctgagctctgtgtccaccatccggaaccagcgctaccacatccacgccaacctgagctttgctgtgctggtggcccaggtgctgctgctgatctccttccggctggagcccggcaccaccccctgccaggtgatggctgtgctgctgcactacttcttcctgagcgcctttgcctggatgctggtggagggcctgcacctgtacagcatggtgatcaaggtgtttggaagtgaggacagcaagcaccgctactactacggcatgggctggggcttccccctgctgatctgcatcatcagcctgagctttgccatggacagctatggcaccagcaacaactgctggctgagcctggccagcggggccatctgggcctttgtggccccagccctcttcgtcatcgtggtgaacatcggcatcctgattgctgtgaccagggtcatcagccagatctctgctgacaactacaagatccatggagaccccagcgccttcaagctgacagccaaggctgtggccgtgctgctgcccatcctgggcacctcctgggtgtttggagtgctggccgtgaatggctgtgctgtggtgttccagtacatgtttgccaccctgaacagcctgcagggcctcttcatcttcctgttccactgcctgctgaacagcgaggtgcgggccgccttcaagcacaagaccaaggtgtggagcctgaccagcagcagcgcccggaccagcaatgccaagcccttccacagcgacctgatgaatggcaccaggcctggcatggccagcaccaagctgagcccctgggacaagagcagccacagcgcccaccgggtggacctgtctgctgtgtag

SEQ ID NO: 153186 - DNA, 687 bp, Artificial Sequence
  Description of Artificial Sequence: Synthetic coding sequence
tgacatggagtgtctgccagagatgtgctggagagcaggaccaggaagcagcacagcgaggccaccaacagcagcaacagagtgtttgtgtactgtgccttcctggacttcagcagtggagagggcgtgtggagcaaccacggctgtgccctgacccggggcaacctgacctacagcgtgtgccgctgcacccacctgaccaactttgccatcctgatgcaggtggtgcccctggaggtgaacatcggcatcctgattgctgtgaccagggtcatcagccagatctctgctgacaactacaagatccatggagaccccagcgccttcaagctgacagccaaggctgtggccgtgctgctgcccatcctgggcacctcctgggtgtttggagtgctggccgtgaatggctgtgctgtggtgttccagtacatgtttgccaccctgaacagcctgcagggcctcttcatcttcctgttccactgcctgctgaacagcgaggtgcgggccgccttcaagcacaagaccaaggtgtggagcctgaccagcagcagcgcccggaccagcaatgccaagcccttccacagcgacctgatgaatggcaccaggcctggcatggccagcaccaagctgagcccctgggacaagagcagccacagcgcccaccgggtggacctgtctgctgtgtag

SEQ ID NO: 153187 - DNA, 2721 bp, Artificial Sequence
  Description of Artificial Sequence: Synthetic coding sequence
atggagaagctgctgcggctgtgctgctggtacagctggctgctgctcttctactacaacttccaggtgcggggcgtgtacagccgcagccaggaccaccctggcttccaggtgctggccagcgccagccactactggcccctggagaatgtggatggcatccacgagctgcaggacaccactggagccagcaggacccacaagctgactgtgctgcccagcagaaatgccacctttgtgtacagcaatgattctgcctacagcaacctgagcgccaccgtggacatcgtggagggcaaggtgaacaagggcatctacctgaaggaggagaagggcgtgaccctgctgtactacggccgctacaacagcagctgcatcagcaagccagagcagtgtggccctgagggcgtgaccttctccttcttctggaagacccagggcgagcagagccggcccatccccagcgcctatggaggccaggtgatcagcaatggcttcaaggtgtgcagcagcggcggccggggctctgtggagctgtacacccgggacaacagcatgacctgggaggccagcttcagccccccaggcccctactggacccacgtgctcttcacctggaagagcaaggagggcctgaaggtgtatgtgaatggcaccctgagcaccagtgaccccagcggcaaggtgtcccgggactatggagagagcaatgtgaacctggtgattggcagcgagcaggaccaggccaagtgctatgaaaatggagcctttgatgagttcatcatctgggagcgggccctgaccccagatgagatcgccatgtacttcaccgctgccatcggcaagcacgccctgctgagcagcaccctgcccagcctcttcatgaccagcacagccagccctgtgatgcccacagatgcctaccaccccatcatcaccaacctgacagaggagaggaagaccttccagagccctggggtcatcctgagctacctgcagaatgtgtccctgagcctgcccagcaagagcctgtctgagcagacagccctgaacctgaccaagaccttcctgaaggctgtgggggagatcctgctgctgcccggctggatcgccctgtctgaggacagcgctgtggtgctgagcctgattgacaccatcgacacagtgatgggccacgtgagcagcaacctgcacggcagcaccccccaggtgacagtggagggcagcagcgccatggccgagttctctgtggccaagatcctgcccaagacagtgaacagcagccactaccgcttccctgcccacggccagagcttcatccagatcccccatgaggccttccacagacatgcctggagcacagtggtgggcctgctgtaccacagcatgcactactacctgaacaacatctggccagcccacaccaagattgctgaggccatgcaccaccaggactgcctgctgtttgccaccagccacctgatcagcctggaggtgtccccaccacccaccctgagccagaacctgagcggcagccccctcatcaccgtgcacctgaagcaccggctgaccaggaagcagcacagcgaggccaccaacagcagcaacagagtgtttgtgtactgtgccttcctggacttcagcagtggagagggcgtgtggagcaaccacggctgtgccctgacccggggcaacctgacctacagcgtgtgccgctgcacccacctgaccaactttgccatcctgatgcaggtggtgcccctggagctggcccggggccaccaggtggccctgagcagcatctcctatgtgggctgcagcctgtctgtgctgtgcctggtggccaccctggtgacctttgctgtgctgagctctgtgtccaccatccggaaccagcgctaccacatccacgccaacctgagctttgctgtgctggtggcccaggtgctgctgctgatctccttccggctggagcccggcaccaccccctgccaggtgatggctgtgctgctgcactacttcttcctgagcgcctttgcctggatgctggtggagggcctgcacctgtacagcatggtgatcaaggtgtttggaagtgaggacagcaagcaccgctactactacggcatgggctggggcttccccctgctgatctgcatcatcagcctgagctttgccatggacagctatggcaccagcaacaactgctggctgagcctggccagcggggccatctgggcctttgtggccccagccctcttcgtcatcgtggtgaacatcggcatcctgattgctgtgaccagggtcatcagccagatctctgctgacaactacaagatccatggagaccccagcgccttcaagctgacagccaaggctgtggccgtgctgctgcccatcctgggcacctcctgggtgtttggagtgctggccgtgaatggctgtgctgtggtgttccagtacatgtttgccaccctgaacagcctgcagggcctcttcatcttcctgttccactgcctgctgaacagcgaggtgcgggccgccttcaagcacaagaccaaggtgtggagcctgaccagcagcagcgcccggaccagcaatgccaagcccttccacagcgacctgatgaatggcaccaggcctggcatggccagcaccaagctgagcccctgggacaagagcagccacagcgcccaccgggtggacctgtctgctgtgtag

SEQ ID NO: 153188 - DNA, 1275 bp, Artificial Sequence
  Description of Artificial Sequence: Synthetic coding sequence
atgacccaggccggccggcggggccctggcaccccagagccccggcccaggacccagcccatggccagcccccggctgggcaccttctgctgccccaccagagatgctgccacccagctggtgctgtccttccagccccgggccttccacgccctgtgcctgggcagcggcggcctgcggctggccctgggcctgctgcagctgctgcccggccggcggcctgctggccctggcagccctgccaccagccccccagcctctgtgcgcatcctgcgggctgctgctgcctgtgacctgctgggctgcctgggcatggtgatccgcagcacagtgtggctgggcttccccaactttgtggacagcgtgtctgacatgaaccacacagagatctggccagctgccttctgtgtgggcagcgccatgtggatccagctgctgtacagcgcctgcttctggtggctgttctgctatgctgtggatgcctacctggtgatccgccgctctgctggcctgagcaccatcctgctgtaccacatcatggcctggggcctggccaccctgctgtgtgtggagggcgccgccatgctgtactaccccagcgtgagccgctgtgagcggggcctggaccacgccatcccccactacgtgaccatgtacctgcccctgctgctggtgctggtggccaaccccatcctcttccagaagacagtgacagctgtggccagcctgctgaagggccggcagggcatctacacagaaaatgaaagaaggatgggcgccgtcatcaagatccgcttcttcaagatcatgctggtgctgatcatctgctggctgagcaacatcatcaatgaaagcctgctcttctacctggagatgcagacagacatcaatggaggcagcctgaagcctgtgaggacagctgccaagaccacctggttcatcatgggcatcctgaacccagcccagggcttcctgctgagcctggccttctacggctggacaggctgcagcctgggcttccagagccccaggaaggagatccagtgggagagcctgaccaccagcgctgctgagggcgcccaccccagccccctgatgcctcatgaaaatcctgccagcggcaaggtgtcccaggtgggcggccagaccagtgatgaggccctgtccatgctgtctgagggcagtgatgccagcaccatcgagatccacacagccagcgagagctgcaacaagaatgaaggagaccctgccctgcccacccatggagacctgtag

SEQ ID NO: 153189 - DNA, 516 bp, Artificial Sequence
  Description of Artificial Sequence: Synthetic coding sequence
atggtgatccgcagcacagtgtggctgggcttccccaactttgtggacagcgtgtctgacatgaaccacacagagatctggccagctgccttctgtgtgggcagcgccatgtggatccagctgctgtacagcgcctgcttctggtggctgttctgctatgctgtggatgcctacctggtgatccgccgctctgctggcctgagcaccatcctgctgtaccacatcatggcctggggcctggccaccctgctgtgtgtggagggcgccgccatgctgtactaccccagcgtgagccgctgtgagcggggcctggaccacgccatcccccactacgtgaccatgtacctgcccctgctgctggtgctggtggccaaccccatcctcttccagaagacagtgacagctgtggccagcctgctgaagggccggcagggcatctacacagaaaatgaaagaaggatgggcgccgtcatcaagatccgcttcttcaagatcatgctggtgctgatcatctag

SEQ ID NO: 153190 - DNA, 864 bp, Artificial Sequence
  Description of Artificial Sequence: Synthetic coding sequence
tgaacagctggccctgtgactggaagtgccagccggggccctgcccggggccccaagggcatggtgatccgcagcacagtgtggctgggcttccccaactttgtggacagcgtgtctgacatgaaccacacagagatctggccagctgccttctgtgtgggcagcgccatgtggatccagctgctgtacagcgcctgcttctggtggctgttctgctatgctgtggatgcctacctggtgatccgccgctctgctggcctgagcaccatcctgctgtaccacatcatggcctggggcctggccaccctgctgtgtgtggagggcgccgccatgctgtactaccccagcgtgagccgctgtgagcggggcctggaccacgccatcccccactacgtgaccatgtacctgcccctgctgctggtgctggtggccaaccccatcctcttccagaagacagtgacagctgtggccagcctgctgaagggccggcagggcatctacacagaaaatgaaagaaggatgggcgccgtcatcaagatccgcttcttcaagatcatgctggtgctgatcatctgctggctgagcaacatcatcaatgaaagcctgctcttctacctggagatgcagacagacatcaatggaggcagcctgaagcctgtgaggacagctgccaagaccacctggttcatcatgggcatcctgaacccagcccagggcttcctgctgagcctggccttctacggctggacaggctgcagcctgggcttccagagccccaggaaggagatccagtgggagagcctgaccaccagcgctgctgagggcgcccaccccagccccctgatgcctcatgagaacccctag

SEQ ID NO: 153191 - DNA, 1215 bp, Artificial Sequence
  Description of Artificial Sequence: Synthetic coding sequence
atggccagcccccggctgggcaccttctgctgccccaccagagatgctgccacccagctggtgctgtccttccagccccgggccttccacgccctgtgcctgggcagcggcggcctgcggctggccctgggcctgctgcagctgctgcccggccggcggcctgctggccctggcagccctgccaccagccccccagcctctgtgcgcatcctgcgggctgctgctgcctgtgacctgctgggctgcctgggcatggtgatccgcagcacagtgtggctgggcttccccaactttgtggacagcgtgtctgacatgaaccacacagagatctggccagctgccttctgtgtgggcagcgccatgtggatccagctgctgtacagcgcctgcttctggtggctgttctgctatgctgtggatgcctacctggtgatccgccgctctgctggcctgagcaccatcctgctgtaccacatcatggcctggggcctggccaccctgctgtgtgtggagggcgccgccatgctgtactaccccagcgtgagccgctgtgagcggggcctggaccacgccatcccccactacgtgaccatgtacctgcccctgctgctggtgctggtggccaaccccatcctcttccagaagacagtgacagctgtggccagcctgctgaagggccggcagggcatctacacagaaaatgaaagaaggatgggcgccgtcatcaagatccgcttcttcaagatcatgctggtgctgatcatctgctggctgagcaacatcatcaatgaaagcctgctcttctacctggagatgcagacagacatcaatggaggcagcctgaagcctgtgaggacagctgccaagaccacctggttcatcatgggcatcctgaacccagcccagggcttcctgctgagcctggccttctacggctggacaggctgcagcctgggcttccagagccccaggaaggagatccagtgggagagcctgaccaccagcgctgctgagggcgcccaccccagccccctgatgcctcatgaaaatcctgccagcggcaaggtgtcccaggtgggcggccagaccagtgatgaggccctgtccatgctgtctgagggcagtgatgccagcaccatcgagatccacacagccagcgagagctgcaacaagaatgaaggagaccctgccctgcccacccatggagacctgtag

SEQ ID NO: 153192 - DNA, 1083 bp, Artificial Sequence
  Description of Artificial Sequence: Synthetic coding sequence
atggaccctgaggagacctctgtgtacctggactactactatgccaccagccccaacagcgacatccgggagacccacagccacgtgccctacacctctgtgttcctgcctgtgttctacacagctgtgttcctgactggagtgctgggcaacctggtgctgatgggcgccctgcacttcaagccaggcagccggcggctgattgacatcttcatcatcaacctggccgccagtgacttcatcttcctggtgaccctgcccctgtgggtggacaaggaggccagcctgggcctgtggaggacaggcagcttcctgtgcaagggcagcagctacatgatctctgtgaacatgcactgcagcgtgctgctgctgacctgcatgtctgtggaccgctacctggccatcgtgtggcctgtggtgtccaggaagttcagaagaacagactgtgcctacgtggtgtgtgccagcatctggttcatcagctgcctgctgggcctgcccaccctgctgagccgggagctgaccctgattgatgacaagccctactgtgccgagaagaaggccacccccatcaagctgatctggagcctggtggccctgatcttcaccttctttgtgcccctgctgagcatcgtgacctgctactgctgcatcgccaggaagctgtgtgcccactaccagcagagcggcaagcacaacaagaagctgaagaagagcatcaagatcatcttcatcgtggtggccgccttcctggtgtcctggctgcccttcaacaccttcaagttcctggccatcgtgtctggcctgcggcaggagcactacctgcccagcgccatcctgcagctgggcatggaggtgtctggccccctggcctttgccaacagctgtgtgaaccccttcatctactacatctttgacagctacatccggcgggccatcgtgcactgcctgtgcccctgcctgaagaactatgactttggcagcagcacagagaccagtgacagccacctgaccaaggccctgagcaccttcatccatgctgaggactttgcccggcggaggaagaggtctgtgtccctgtag

SEQ ID NO: 153193 - DNA, 1830 bp, Artificial Sequence
  Description of Artificial Sequence: Synthetic coding sequence
atgtctgatgaaagaaggctgcccggcagcgctgtgggctggctggtgtgtggcggcctgagcctgctggccaatgcctggggcatcctgtctgtgggcgccaagcagaagaagtggaagcccctggagttcctgctgtgcaccctggccgccacccacatgctgaatgtggccgtgcccatcgccacctacagcgtggtgcagctgcggcggcagaggccagactttgagtggaatgaaggcctgtgcaaggtgtttgtgtccaccttctacaccctgaccctggccacctgcttctctgtgaccagcctgagctaccacaggatgtggatggtgtgctggcctgtgaactaccgcctgagcaatgccaagaagcaggccgtgcacacagtgatgggcatctggatggtgtccttcatcctgagcgccctgcctgctgtgggctggcatgacaccagcgagcgcttctacacccacggctgccgcttcatcgtggccgagatcggcctgggcttcggcgtgtgcttcctgctgctggtgggcggctctgtggccatgggcgtcatctgcacagccatcgccctcttccagaccctggccgtgcaggtgggccggcaggccgacagaagagccttcaccgtgcccaccatcgtggtggaggatgcccagggcaagaggaggagcagcattgatggcagcgagcccgccaagaccagcctgcagaccaccggcctggtgaccaccatcgtgttcatctatgactgcctgatgggcttccctgtgctggtggtgtccttcagcagcctgcgggcagatgccagcgccccctggatggccctgtgtgtgctgtggtgcagcgtggcccaggccctgctgctgcccgtcttcctgtgggcctgtgaccgctacagagctgacctgaaggctgtgcgggagaagtgcatggccctgatggccaatgatgaggagagtgatgatgagaccagcctggagggcggcatcagcccagacctggtgctggagaggagcctggactatggctacggcggggactttgtggccctggacaggatggccaagtatgagatcagcgccctggagggcggcctgccccagctgtaccccctgcggcccctgcaggaggacaagatgcagtacctgcaggtgccccccacccggcgcttcagccatgatgatgctgatgtgtgggccgctgtgcccctgcctgccttcctgccccgctggggcagcggggaggacctggccgccctggcccacctggtgctgcctgctggccctgagcggcggcgggccagcctgctggcctttgctgaagatgccccacccagccgggcccggcggcgctctgctgagagcctgctgagcctgcggcccagcgccctggacagcggccccaggggggcccgggacagccccccaggcagccccaggagaagacctggccctggccccaggtctgccagcgccagcctgctgcctgatgcctttgccctgacagcctttgaatgtgagccccaggccctgcggcggcccccaggccccttccctgctgccccagctgccccagatggagctgaccccggggaggcccccaccccacccagcagcgcccagaggagccctggcccccggcccagcgcccacagccacgccggcagcctgcggcccggcctgagcgcctcctggggcgagcccggcggcctgcgggccgccggcggcggcggcagcaccagcagcttcctgagcagccccagcgagagcagcggctacgccaccctgcacagcgacagcctgggcagcgccagctag

SEQ ID NO: 153194 - DNA, 2445 bp, Artificial Sequence
  Description of Artificial Sequence: Synthetic coding sequence
atggagcctgagatcaactgcagcgagctgtgtgacagcttccctggccaggagctggacagaagacccctgcatgacctgtgcaagaccaccatcaccagcagccaccacagcagcaagaccatcagcagcctgagccctgtgctgctgggcatcgtgtggaccttcctgagctgtggcctgctgctgatcctcttcttcctggccttcaccatccactgcaggaagaacagaattgtgaagatgagcagccccaacctgaacatcgtgaccctgctgggcagctgcctgacctacagcagcgcctacctgtttggcatccaggatgtgctggtgggcagctccatggagaccctcatccagacccggctgtccatgctgtgcatcggcaccagcctggtgtttggccccatcctgggcaagtcctggaggctgtacaaggtgttcacccagagggtgcctgacaagagggtcatcatcaaggacctgcagctgctgggcctggtggccgccctgctgatggctgatgtgatcctgctgatgacctgggtgctgacagaccccatccagtgcctgcagatcctgtctgtgtccatgacagtgacaggcaaggatgtgtcctgcaccagcaccagcacccacttctgtgccagccgctacagtgatgtgtggatcgccctgatctggggctgcaagggcctgctgctgctgtatggagcctacctggccggcctgaccggccacgtgagcagcccccctgtgaaccagagcctgaccatcatggtgggcgtgaacctgctggtgctggccgccggcctgctgtttgtggtgacccgctacctgcacagctggcccaacctggtgtttggcctgaccagcggcggcatctttgtgtgcaccaccaccatcaactgcttcatcttcatcccccagctgaagcagtggaaggcctttgaggaggagaaccagaccatccggaggatggccaagtacttcagcacccccaacaagagcttccacacccagtatggagaggaggagaactgccaccccagaggagagaagagctccatggagcggctgctgacagagaagaatgctgtgattgagagcctgcaggagcaggtgaacaatgccaaggagaagatcgtgcggctgatgtctgctgagtgcacctatgacctgcctgagggcgccgcccccccagccagcagccccaacaaggatgtgcaggccgtggcctctgtgcacaccctggccgccgcccagggccccagcggccacctgagtgacttccagaatgaccccggcatggccgcccgggacagccagtgcaccagcggccccagcagctatgcccagagcctggagggccctgggaaggacagcagcttcagccctgggaaggaggagaagatcagtgacagcaaggacttcagtgaccacctggacagcggctgcagccagaagccctggacagagcagagcctgggccctgagcggggggaccaggtgcccatgaaccccagccagagcctgctgcctgagcggggcggcagtgacccccagaggcagaggcacctggagaacagcgaggagcccccagagaggaggagccgggtgtcctctgtcatccgggagaagctgcaggaggtgctgcaggacctgggcctgggccctgaggccagcctgagcacagcccccagctgccaccagcagacctggaagaacagcgctgccttcagcccccagaagatgcccctgagcaaggagctgggcttcagcccctacatggtgagaagaagaagagctgcccagagggcccggagccacttccctggcagcgcccccagctctgtgggccaccgggccaacagaacagtgcctggggcccacagccggctgcacgtgcagaatggagacagccccagcctggccccccagaccacagacagccgggtgagaagacccagcagcaggaagcccagcctgcccagcgacccccaggaccggcccggcaccctggagggcagcaagcagagccagacagagcctgagggcgcccggggcagcaaggccgccttcctgcggcagcccagcggcagcggccgggcccccagccctgctgccccctgcctgagcaaggccagcccagacctgcctgagcagtggcagctgtggccccctgtgcccagcggctgtgccagcctgagcagccagcacagctactttgacacagagagcagcagcagtgatgagttcttctgccgctgccaccggccctactgtgagatctgcttccagagcagcagtgacagcagtgacagcggcaccagtgacacagatcctgagcccaccggcggcctggcctcctgggagaagctgtgggcccggagcaagcccatcgtgaacttcaaggatgacctgaagcccaccctggtgtag

SEQ ID NO: 153195 - DNA, 2445 bp, Artificial Sequence; identical to SEQ ID NO: 153194
  Description of Artificial Sequence: Synthetic coding sequence

SEQ ID NO: 153196 - DNA, 2433 bp, Artificial Sequence
  Description of Artificial Sequence: Synthetic coding sequence
atggagcctgagatcaactgcagcgagctgtgtgacagcttccctggccaggagctggacagaagacccctgcatgacctgtgcaagaccaccatcaccagcagccaccacagcagcaagaccatcagcagcctgagccctgtgctgctgggcatcgtgtggaccttcctgagctgtggcctgctgctgatcctcttcttcctggccttcaccatccactgcaggaagaacagaattgtgaagatgagcagccccaacctgaacatcgtgaccctgctgggcagctgcctgacctacagcagcgcctacctgtttggcatccaggatgtgctggtgggcagctccatggagaccctcatccagacccggctgtccatgctgtgcatcggcaccagcctggtgtttggccccatcctgggcaagtcctggaggctgtacaaggtgttcacccagagggtgcctgacaagagggtcatcatcaaggacctgcagctgctgggcctggtggccgccctgctgatggctgatgtgatcctgctgatgacctgggtgctgacagaccccatccagtgcctgcagatcctgtctgtgacaggcaaggatgtgtcctgcaccagcaccagcacccacttctgtgccagccgctacagtgatgtgtggatcgccctgatctggggctgcaagggcctgctgctgctgtatggagcctacctggccggcctgaccggccacgtgagcagcccccctgtgaaccagagcctgaccatcatggtgggcgtgaacctgctggtgctggccgccggcctgctgtttgtggtgacccgctacctgcacagctggcccaacctggtgtttggcctgaccagcggcggcatctttgtgtgcaccaccaccatcaactgcttcatcttcatcccccagctgaagcagtggaaggcctttgaggaggagaaccagaccatccggaggatggccaagtacttcagcacccccaacaagagcttccacacccagtatggagaggaggagaactgccaccccagaggagagaagagctccatggagcggctgctgacagagaagaatgctgtgattgagagcctgcaggagcaggtgaacaatgccaaggagaagatcgtgcggctgatgtctgctgagtgcacctatgacctgcctgagggcgccgcccccccagccagcagccccaacaaggatgtgcaggccgtggcctctgtgcacaccctggccgccgcccagggccccagcggccacctgagtgacttccagaatgaccccggcatggccgcccgggacagccagtgcaccagcggccccagcagctatgcccagagcctggagggccctgggaaggacagcagcttcagccctgggaaggaggagaagatcagtgacagcaaggacttcagtgaccacctggacagcggctgcagccagaagccctggacagagcagagcctgggccctgagcggggggaccaggtgcccatgaaccccagccagagcctgctgcctgagcggggcggcagtgacccccagaggcagaggcacctggagaacagcgaggagcccccagagaggaggagccgggtgtcctctgtcatccgggagaagctgcaggaggtgctgcaggacctgggcctgggccctgaggccagcctgagcacagcccccagctgccaccagcagacctggaagaacagcgctgccttcagcccccagaagatgcccctgagcaaggagctgggcttcagcccctacatggtgagaagaagaagagctgcccagagggcccggagccacttccctggcagcgcccccagctctgtgggccaccgggccaacagaacagtgcctggggcccacagccggctgcacgtgcagaatggagacagccccagcctggccccccagaccacagacagccgggtgagaagacccagcagcaggaagcccagcctgcccagcgacccccaggaccggcccggcaccctggagggcagcaagcagagccagacagagcctgagggcgcccggggcagcaaggccgccttcctgcggcagcccagcggcagcggccgggcccccagccctgctgccccctgcctgagcaaggccagcccagacctgcctgagcagtggcagctgtggccccctgtgcccagcggctgtgccagcctgagcagccagcacagctactttgacacagagagcagcagcagtgatgagttcttctgccgctgccaccggccctactgtgagatctgcttccagagcagcagtgacagcagtgacagcggcaccagtgacacagatcctgagcccaccggcggcctggcctcctgggagaagctgtgggcccggagcaagcccatcgtgaacttcaaggatgacctgaagcccaccctggtgtag

SEQ ID NO: 153197 - DNA, 1590 bp, Artificial Sequence
  Description of Artificial Sequence: Synthetic coding sequence
atgagcctgaacagcagcctgagctgcaggaaggagctgagcaacctgacagaggaggagggcggggagggcggcgtcatcatcacccagttcatcgccatcatcgtcatcaccatctttgtgtgcctgggcaacctggtgattgtggtgaccctgtacaagaagagctacctgctgaccctgagcaacaagtttgtgttcagcctgaccctgagcaacttcctgctgtctgtgctggtgctgccctttgtggtgaccagcagcatccggcgggagtggatctttggagtggtgtggtgcaacttcagcgccctgctgtacctgctgatcagcagcgcctccatgctgaccctgggcgtgattgccatcgaccgctactatgctgtgctgtaccccatggtgtaccccatgaagatcaccggcaacagagctgtgatggccctggtgtacatctggctgcacagcctgattggctgcctgccccccctgtttggctggagctctgtggagtttgatgagttcaagtggatgtgtgtggccgcctggcaccgggagcccggctacacagccttctggcagatctggtgtgccctcttccccttcctggtgatgctggtgtgctacggcttcatcttccgggtggcccgggtgaaggccaggaaggtgcactgcggcaccgtggtgattgtggaggaggatgcccagaggactggaaggaagaacagcagcaccagcaccagcagcagcggcagcagaagaaatgccttccagggcgtggtgtacagcgccaaccagtgcaaggccctgatcaccatcctggtggtgctgggcgccttcatggtgacctggggcccctacatggtggtgattgccagcgaggccctgtggggcaagagctctgtgagccccagcctggagacctgggccacctggctgagctttgccagcgctgtgtgccaccccctcatctacggcctgtggaacaagacagtgaggaaggagctgctgggcatgtgcttcggggaccgctactaccgggagccctttgtgcagaggcagaggaccagccgcctcttcagcatcagcaaccgcatcacagacctgggcctgagcccccacctgacagccctgatggccggcggccagcccctgggccacagcagcagcactggagacaccggcttcagctgcagccaggacagcggcacagacatgatgctgctggaggactacaccagtgatgacaacccccccagccactgcacctgcccccccaagagaagaagctctgtgacctttgaagatgaggtggagcagatcaaggaggccgccaagaacagcatcctgcacgtgaaggccgaggtgcacaagagcctggacagctatgctgccagcctggccaaggccatcgaggccgaggccaagatcaacctgtttggagaggaggccctgcccggggtgctggtgacagccaggacagtgcctgggggcggctttggaggccggcggggcagcaggaccctggtgtcccagaggctgcagctgcagagcattgaggagggagatgtgctggccgctgagcagaggtag

SEQ ID NO: 153198 - DNA, 1590 bp, Artificial Sequence; identical to SEQ ID NO: 153197
  Description of Artificial Sequence: Synthetic coding sequence

SEQ ID NO: 153199 - DNA, 1590 bp, Artificial Sequence; identical to SEQ ID NO: 153197
  Description of Artificial Sequence: Synthetic coding sequence

SEQ ID NO: 153200 - DNA, 1590 bp, Artificial Sequence; identical to SEQ ID NO: 153197
  Description of Artificial Sequence: Synthetic coding sequence

SEQ ID NO: 153201 - DNA, 1650 bp, Artificial Sequence
  Description of Artificial Sequence: Synthetic coding sequence
atgtctgcccggggcgtggtgcagcacgccctgcccaccccaagaagaggagccctgaccatgagcctgaacagcagcctgagctgcaggaaggagctgagcaacctgacagaggaggagggcggggagggcggcgtcatcatcacccagttcatcgccatcatcgtcatcaccatctttgtgtgcctgggcaacctggtgattgtggtgaccctgtacaagaagagctacctgctgaccctgagcaacaagtttgtgttcagcctgaccctgagcaacttcctgctgtctgtgctggtgctgccctttgtggtgaccagcagcatccggcgggagtggatctttggagtggtgtggtgcaacttcagcgccctgctgtacctgctgatcagcagcgcctccatgctgaccctgggcgtgattgccatcgaccgctactatgctgtgctgtaccccatggtgtaccccatgaagatcaccggcaacagagctgtgatggccctggtgtacatctggctgcacagcctgattggctgcctgccccccctgtttggctggagctctgtggagtttgatgagttcaagtggatgtgtgtggccgcctggcaccgggagcccggctacacagccttctggcagatctggtgtgccctcttccccttcctggtgatgctggtgtgctacggcttcatcttccgggtggcccgggtgaaggccaggaaggtgcactgcggcaccgtggtgattgtggaggaggatgcccagaggactggaaggaagaacagcagcaccagcaccagcagcagcggcagcagaagaaatgccttccagggcgtggtgtacagcgccaaccagtgcaaggccctgatcaccatcctggtggtgctgggcgccttcatggtgacctggggcccctacatggtggtgattgccagcgaggccctgtggggcaagagctctgtgagccccagcctggagacctgggccacctggctgagctttgccagcgctgtgtgccaccccctcatctacggcctgtggaacaagacagtgaggaaggagctgctgggcatgtgcttcggggaccgctactaccgggagccctttgtgcagaggcagaggaccagccgcctcttcagcatcagcaaccgcatcacagacctgggcctgagcccccacctgacagccctgatggccggcggccagcccctgggccacagcagcagcactggagacaccggcttcagctgcagccaggacagcggcacagacatgatgctgctggaggactacaccagtgatgacaacccccccagccactgcacctgcccccccaagagaagaagctctgtgacctttgaagatgaggtggagcagatcaaggaggccgccaagaacagcatcctgcacgtgaaggccgaggtgcacaagagcctggacagctatgctgccagcctggccaaggccatcgaggccgaggccaagatcaacctgtttggagaggaggccctgcccggggtgctggtgacagccaggacagtgcctgggggcggctttggaggccggcggggcagcaggaccctggtgtcccagaggctgcagctgcagagcattgaggagggagatgtgctggccgctgagcagaggtag

SEQ ID NO: 153202 - DNA, 1356 bp, Artificial Sequence
  Description of Artificial Sequence: Synthetic coding sequence
atgggcggccgccgctgtgtgcccggcaccctgcccatgagagctgcccctcctggggccaagaggctgcacgtgcccctgcgggccaagggcgtgggccgcagcggccacgccccccggctggagagcgtgaggaccagctactatgctgtgctgtaccccatggtgtaccccatgaagatcaccggcaacagagctgtgatggccctggtgtacatctggctgcacagcctgattggctgcctgccccccctgtttggctggagctctgtggagtttgatgagttcaagtggatgtgtgtggccgcctggcaccgggagcccggctacacagccttctggcagatctggtgtgccctcttccccttcctggtgatgctggtgtgctacggcttcatcttccgggtggcccgggtgaaggccaggaaggtgcactgcggcaccgtggtgattgtggaggaggatgcccagaggactggaaggaagaacagcagcaccagcaccagcagcagcggcagcagaagaaatgccttccagggcgtggtgtacagcgccaaccagtgcaaggccctgatcaccatcctggtggtgctgggcgccttcatggtgacctggggcccctacatggtggtgattgccagcgaggccctgtggggcaagagctctgtgagccccagcctggagacctgggccacctggctgagctttgccagcgctgtgtgccaccccctcatctacggcctgtggaacaagacagtgaggaaggagctgctgggcatgtgcttcggggaccgctactaccgggagccctttgtgcagaggcagaggaccagccgcctcttcagcatcagcaaccgcatcacagacctgggcctgagcccccacctgacagccctgatggccggcggccagcccctgggccacagcagcagcactggagacaccggcttcagctgcagccaggacagcggcacagacatgatgctgctggaggactacaccagtgatgacaacccccccagccactgcacctgcccccccaagagaagaagctctgtgacctttgaagatgaggtggagcagatcaaggaggccgccaagaacagcatcctgcacgtgaaggccgaggtgcacaagagcctggacagctatgctgccagcctggccaaggccatcgaggccgaggccaagatcaacctgtttggagaggaggccctgcccggggtgctggtgacagccaggacagtgcctgggggcggctttggaggccggcggggcagcaggaccctggtgtcccagaggctgcagctgcagagcattgaggagggagatgtgctggccgctgagcagaggtag

SEQ ID NO: 153203 - DNA, 1248 bp, Artificial Sequence
  Description of Artificial Sequence: Synthetic coding sequence
atgctggtgcctgtgggctggatgaatgaaagctactatgctgtgctgtaccccatggtgtaccccatgaagatcaccggcaacagagctgtgatggccctggtgtacatctggctgcacagcctgattggctgcctgccccccctgtttggctggagctctgtggagtttgatgagttcaagtggatgtgtgtggccgcctggcaccgggagcccggctacacagccttctggcagatctggtgtgccctcttccccttcctggtgatgctggtgtgctacggcttcatcttccgggtggcccgggtgaaggccaggaaggtgcactgcggcaccgtggtgattgtggaggaggatgcccagaggactggaaggaagaacagcagcaccagcaccagcagcagcggcagcagaagaaatgccttccagggcgtggtgtacagcgccaaccagtgcaaggccctgatcaccatcctggtggtgctgggcgccttcatggtgacctggggcccctacatggtggtgattgccagcgaggccctgtggggcaagagctctgtgagccccagcctggagacctgggccacctggctgagctttgccagcgctgtgtgccaccccctcatctacggcctgtggaacaagacagtgaggaaggagctgctgggcatgtgcttcggggaccgctactaccgggagccctttgtgcagaggcagaggaccagccgcctcttcagcatcagcaaccgcatcacagacctgggcctgagcccccacctgacagccctgatggccggcggccagcccctgggccacagcagcagcactggagacaccggcttcagctgcagccaggacagcggcacagacatgatgctgctggaggactacaccagtgatgacaacccccccagccactgcacctgcccccccaagagaagaagctctgtgacctttgaagatgaggtggagcagatcaaggaggccgccaagaacagcatcctgcacgtgaaggccgaggtgcacaagagcctggacagctatgctgccagcctggccaaggccatcgaggccgaggccaagatcaacctgtttggagaggaggccctgcccggggtgctggtgacagccaggacagtgcctgggggcggctttggaggccggcggggcagcaggaccctggtgtcccagaggctgcagctgcagagcattgaggagggagatgtgctggccgctgagcagaggtag

SEQ ID NO: 153204 - DNA, 1104 bp, Artificial Sequence
  Description of Artificial Sequence: Synthetic coding sequence
atgagcaagaggtcctggtgggccggcagcaggaagccaccccgggagatgctgaagctgagcggcagtgacagcagccagagcatgaatggcctggaggtggcccctcctggcctcatcaccaacttcagcctggccacagctgagcagtgtggccaggagacccccctggagaacatgctgtttgccagcttctacctgctggacttcatcctggccctggtgggcaacaccctggccctgtggctgttcatccgggaccacaagagcggcaccccagccaacgtgttcctgatgcacctggccgtggccgacctgagctgtgtgctggtgctgcccacccggctggtgtaccacttcagcggcaaccactggccctttggagagatcgcctgccgcctgaccggcttcctgttctacctgaacatgtatgccagcatctacttcctgacctgcatctctgctgaccgcttcctggccatcgtgcaccctgtgaagagcctgaagctgcggcggcccctgtatgcccacctggcctgtgccttcctgtgggtggtggtggccgtggccatggcccccctgctggtgagcccccagacagtgcagaccaaccacacagtggtgtgcctgcagctgtaccgggagaaggccagccaccacgccctggtgtccctggccgtggccttcaccttccccttcatcaccaccgtgacctgctacctgctgatcatccgcagcctgcggcagggcctgcgggtggagaagaggctgaagaccaaggctgtgaggatgattgccatcgtgctggccatcttcctggtgtgctttgtgccctaccacgtgaacagatctgtgtatgtgctgcactaccgcagccatggagccagctgtgccacccagaggatcctggccctggccaaccgcatcaccagctgcctgaccagcctgaatggagccctggaccccatcatgtacttctttgtggccgagaagttcagacatgccctgtgcaacctgctgtgtgggaagaggctgaagggccccccacccagctttgagggcaagaccaatgaaagcagcctgagcgccaagtctgagctgtag

SEQ ID NO: 153205 - DNA, 312 bp, Artificial Sequence
  Description of Artificial Sequence: Synthetic coding sequence
atgaatggcctggaggtggcccctcctggcctcatcaccaacttcagcctggccacagctgagcagtgtggccaggagacccccctggagaacatgctgtttgccagcttctacctgcccctgccccggcagcccaggatgtgcaccgtgacaggcctgacagctggcagcacagcccggagcaagcagcacctggaggtggtgtttgctgtgctgcctgccttcaagctgcagagaggaagaagagagaggaccagcaagccacccatcatccccatgagcagccctggcccctgctgggtgaggacatag

SEQ ID NO: 153206 - DNA, 1104 bp, Artificial Sequence; identical to SEQ ID NO: 153204
  Description of Artificial Sequence: Synthetic coding sequence

SEQ ID NO: 153207 - DNA, 411 bp, Artificial Sequence
  Description of Artificial Sequence: Synthetic coding sequence
atgagcaagaggtcctggtgggccggcagcaggaagccaccccgggagatgctgaagctgagcggcagtgacagcagccagagcatgaatggcctggaggtggcccctcctggcctcatcaccaacttcagcctggccacagctgagcagtgtggccaggagacccccctggagaacatgctgtttgccagcttctacctgctggacttcatcctggccctggtgggcaacaccctggccctgtggctgttcatccgggaccacaagagcggcaccccagccaacgtgttcctgatgcacctggccgtggccgacctgagctgtgtgctggtgctgcccacccggctggtgtaccacttcagcggcaaccactggccctttggagagatcgcctgccgcctgactggatag

SEQ ID NO: 153208 - DNA, 1104 bp, Artificial Sequence; identical to SEQ ID NO: 153204
  Description of Artificial Sequence: Synthetic coding sequence

SEQ ID NO: 153209 - DNA, 1338 bp, Artificial Sequence
  Description of Artificial Sequence: Synthetic coding sequence
atggccgcccccaccccagcccggcctgtgctgacccacctgctggtggccctgtttggcatgggctcctgggccgctgtgaatggcatctgggtggagctgcctgtggtggtgaaggagctgcctgagggctggagcctgcccagctatgtgtctgtgctggtggccctgggcaacctgggcctgctggtggtgaccctgtggaggcggctggcccctgggaaggatgagcaggtgcccatccgggtggtgcaggtgctgggcatggtgggcacagccctgctggccagcctgtggcaccacgtggcccctgtggccggccagctgcacagcgtggccttcctggccctggcctttgtgctggccctggcctgctgtgccagcaatgtgaccttcctgcccttcctgagccacctgcccccacgcttcctgcggagcttcttcctgggccagggcctgagcgccctgctgccctgtgtgctggccctggtgcagggcgtgggccgcctggagtgccccccagcccccatcaatggcaccccaggcccccccctggacttcctggagcgcttccctgccagcaccttcttctgggccctgacagccctgctggtggccagcgctgctgccttccagggcctgctgctgctgctgcccccacctccttctgtgcccaccggggagctgggcagcggcctgcaggtgggcgcccctggagctgaggaggaggtggaggagagcagccccctgcaggagccccccagccaggccgccggcaccaccccaggccctgaccccaaggcctaccagctgctgagcgcccggagcgcctgcctgctgggcctgctggccgccaccaatgccctgaccaatggagtgctgcctgctgtgcagagcttcagctgcctgccctacggccgcctggcctaccacctggccgtggtgctgggcagcgctgccaaccccctggcctgcttcctggccatgggcgtgctgtgccgcagcctggccggcctgggcggcctgagcctgctgggcgtcttctgtggcggctacctgatggccctggccgtgctgagcccctgcccccccctggtgggcaccagcgctggggtggtgctggtggtgctgtcctgggtgctgtgcctgggcgtcttctcctatgtgaaggtggccgccagcagcctgctgcacggcggcggccgcccagccctgctggccgccggcgtggccatccaggtgggcagcctgctgggcgctgtggccatgtttcctcccaccagcatctaccacgtgttccacagcaggaaggactgtgccgacccctgtgacagctag

SEQ ID NO: 153210 - DNA, 1338 bp, Artificial Sequence; identical to SEQ ID NO: 153209
  Description of Artificial Sequence: Synthetic coding sequence

SEQ ID NO: 153211 - DNA, 1338 bp, Artificial Sequence; identical to SEQ ID NO: 153209
  Description of Artificial Sequence: Synthetic coding sequence

SEQ ID NO: 153212 - DNA, 1338 bp, Artificial Sequence; identical to SEQ ID NO: 153209
  Description of Artificial Sequence: Synthetic coding sequence

SEQ ID NO: 153213 - DNA, 1338 bp, Artificial Sequence; identical to SEQ ID NO: 153209
  Description of Artificial Sequence: Synthetic coding sequence

SEQ ID NO: 153214 - DNA, 1074 bp, Artificial Sequence
  Description of Artificial Sequence: Synthetic coding sequence
atggtgggcacagccctgctggccagcctgtggcaccacgtggcccctgtggccggccagctgcacagcgtggccttcctggccctggcctttgtgctggccctggcctgctgtgccagcaatgtgaccttcctgcccttcctgagccacctgcccccacgcttcctgcggagcttcttcctgggccagggcctgagcgccctgctgccctgtgtgctggccctggtgcagggcgtgggccgcctggagtgccccccagcccccatcaatggcaccccaggcccccccctggacttcctggagcgcttccctgccagcaccttcttctgggccctgacagccctgctggtggccagcgctgctgccttccagggcctgctgctgctgctgcccccacctccttctgtgcccaccggggagctgggcagcggcctgcaggtgggcgcccctggagctgaggaggaggtggaggagagcagccccctgcaggagccccccagccaggccgccggcaccaccccaggccctgaccccaaggcctaccagctgctgagcgcccggagcgcctgcctgctgggcctgctggccgccaccaatgccctgaccaatggagtgctgcctgctgtgcagagcttcagctgcctgccctacggccgcctggcctaccacctggccgtggtgctgggcagcgctgccaaccccctggcctgcttcctggccatgggcgtgctgtgccgcagcctggccggcctgggcggcctgagcctgctgggcgtcttctgtggcggctacctgatggccctggccgtgctgagcccctgcccccccctggtgggcaccagcgctggggtggtgctggtggtgctgtcctgggtgctgtgcctgggcgtcttctcctatgtgaaggtggccgccagcagcctgctgcacggcggcggccgcccagccctgctggccgccggcgtggccatccaggtgggcagcctgctgggcgctgtggccatgtttcctcccaccagcatctaccacgtgttccacagcaggaaggactgtgccgacccctgtgacagctag

SEQ ID NO: 153215 - DNA, 1347 bp, Artificial Sequence
  Description of Artificial Sequence: Synthetic coding sequence
atggccgcccccaccctgggccgcctggtgctgacccacctgctggtggccctgtttggcatgggctcctgggccgctgtgaatggcatctgggtggagctgcctgtggtggtgaaggacctgcctgagggctggagcctgcccagctacctgtctgtggtggtggccctgggcaacctgggcctgctggtggtgaccctgtggaggcagctggcccctggaaaaggagagcaggtgcccatccaggtggtgcaggtgctgtctgtggtgggcacagccctgctggcccccctgtggcaccacgtggcccctgtggccggccagctgcacagcgtggccttcctgaccctggccctggtgctggccatggcctgctgcaccagcaatgtgaccttcctgcccttcctgagccacctgcccccacccttcctgcggagcttcttcctgggccagggcctgagcgccctgctgccctgtgtgctggccctggtgcagggcgtgggccgcctggagtgccccccagcccccaccaacggcaccagcggcccccccctggacttccctgagcgcttccctgccagcaccttcttctgggccctgacagccctgctggtgaccagcgctgctgccttccggggcctgctgctgctgctgcccagcctgcccagcgtgaccaccggcggcagcggccctgagctgcagctgggcagccctggagctgaggaggaggagaaggaggaggaggaggccctgcccctgcaggagccccccagccaggccgccggcaccatccctggccctgaccctgaggcccaccagctgttcagcgcccacggggccttcctgctgggcctgatggccttcaccagcgctgtgaccaacggggtgctgcccagcgtgcagagcttcagctgcctgccctacggccgcctggcctaccacctggccgtggtgctgggcagcgctgccaaccccctggcctgcttcctggccatgggcgtgctgtgccgcagcctggccggcctggtgggcctgagcctgctgggcatgctgtttggagcctacctgatggccctggccatcctgagcccctgcccccccctggtgggcaccacagctggggtggtgctggtggtgctgtcctgggtgctgtgcctgtgtgtgttctcctatgtgaaggtggccgccagcagcctgctgcatggaggcggccggcctgccctgctggccgccggcgtggccatccaggtgggcagcctgctgggcgctggggccatgttcccccccaccagcatctaccacgtgttccagagcaggaaggactgtgtggacccctgtggcccctag

SEQ ID NO: 153216 - DNA, 1347 bp, Artificial Sequence; identical to SEQ ID NO: 153215
  Description of Artificial Sequence: Synthetic coding sequence

SEQ ID NO: 153217 - DNA, 1053 bp, Artificial Sequence
  Description of Artificial Sequence: Synthetic coding sequence
atggccgcccccaccctgggccgcctggtgctgacccacctgctggtggccctgtttggcatgggctcctgggccgctgtgaatggcatctgggtggagctgcctgtggtggtgaaggacctgcctgagggctggagcctgcccagctacctgtctgtggtggtggccctgggcaacctgggcctgctggtggtgaccctgtggaggcagctggcccctggaaaaggagagcaggtgcccatccaggtggtgcaggtgctgtctgtggtgggcacagccctgctggcccccctgtggcaccacgtggcccctgtggccggccagctgcacagcgtggccttcctgaccctggccctggtgctggccatggcctgctgcaccagcaatgtgaccttcctgcccttcctgagccacctgcccccacccttcctgcggagcttcttcctgggccagggcctgagcgccctgctgccctgtgtgctggccctggtgcagggcgtgggccgcctggagtgccccccagcccccaccaacggcaccagcggcccccccctggacttccctgagcgcttccctgccagcaccttcttctgggccctgacagccctgctggtgaccagcgctgctgccttccggggcctgctgctgctgctgcccagcctgcccagcgtgaccaccggcggcagcggccctgagctgcagctgggcagccctggagctgaggaggaggagaaggaggaggaggaggccctgcccctgcaggagccccccagccaggccgccggcaccatccctggccctgaccctgaggcccaccagctgttcagcgcccacggggccttcctgctgggcctgatggccttcaccagcgctgtgaccaacggggtgctgcccagcgtgcagagcttcagctgcctgccctacggccgcctggcctaccacctggccgtggtgctgggcagcgctgccaaccccctggcctgcttcctggccatgggcgtgctgtgccgctgctgccggggctgctgcgtgtgtgtgtgcagccacatgtag

SEQ ID NO: 153218 - DNA, 1413 bp, Artificial Sequence
  Description of Artificial Sequence: Synthetic coding sequence
atgcctgcccccctgctgctgatcagcaggaccctgggcaacttcatggtgctgtggagcacctgcaggaccaccgtcttcaagtctgtgaccaaccgcttcatcaagaacctggcctgcagcggcatctgtgccagcctggtgtgtgtgccctttgacatcatcctgagcaccagcccccactgctgctggtggatctacaccatgctgttctgcaaggtggtgaagttcctgcacaaggtgttctgcagcgtgaccatcctgtccttccctgccatcgccctggaccgctactacagcgtgctgtaccccctggagaggaagatcagtgatgccaagagccgggagctggtgatgtacatctgggcccatgctgtggtggcctctgtgcctgtgtttgctgtgaccaacgtggccgacatctatgccaccagcacctgcacagaggtgtggagcaacagcctgggccacctggtgtatgtgctggtgtacaacatcaccaccgtcatcgtgcctgtggtggtggtgttcctgttcctgatcctgatccggcgggccctgagcgccagccagaagaagaaggtgatcatcgccgccctgcggaccccccagaacaccatcagcatcccctatgccagccagcgggaggccgagctgcacgccaccctgctgtccatggtgatggtgttcatcctgtgcagcgtgccctatgccaccctggtggtgtaccagacagtgctgaatgtgcctgacacctctgtgttcctgctgctgacagctgtgtggctgcccaaggtgtccctgctggccaaccctgtgctcttcctgactgtgaacaagtctgtgaggaagtgcctgattggcaccctggtgcagctgcaccaccgctacagcagaagaaatgtggtgtccactggaagtggcatggccgaggccagcctggagcccagcatccgcagcggcagccagctgctggagatgttccacatcggccagcagcagatcttcaagcccacagaagatgaggaggagagcgaggccaagtacatcggcagcgctgacttccaggccaaggagatcttcagcacctgcctggagggggagcagggcccccagtttgcccccagcgccccacccctgagcacagtggacagcgtgtcccaggtggccccagctgcccctgtggagcctgagaccttcccagacaagtacagcctgcagtttggcttcggcccctttgagctgcccccccagtggctgtctgagaccaggaacagcaagaagaggctgctgccccccctgggcaacaccccagaggagctgatccagaccaaggtgcccaaggtgggccgggtggagaggaagatgagcaggaacaacaaggtgtccatcttccccaaggtggacagctag

SEQ ID NO: 153219 - DNA, 1548 bp, Artificial Sequence
  Description of Artificial Sequence: Synthetic coding sequence
atgggccacaacggctcctggatcagccccaatgccagcgagccccacaatgccagcggggctgaggccgccggcgtgaacagaagtgccctgggggagtttggagaggcccagctgtaccggcagttcaccaccaccgtgcaggtggtgatcttcatcggcagcctgctgggcaacttcatggtgctgtggagcacctgcaggaccaccgtcttcaagtctgtgaccaaccgcttcatcaagaacctggcctgcagcggcatctgtgccagcctggtgtgtgtgccctttgacatcatcctgagcaccagcccccactgctgctggtggatctacaccatgctgttctgcaaggtggtgaagttcctgcacaaggtgttctgcagcgtgaccatcctgtccttccctgccatcgccctggaccgctactacagcgtgctgtaccccctggagaggaagatcagtgatgccaagagccgggagctggtgatgtacatctgggcccatgctgtggtggcctctgtgcctgtgtttgctgtgaccaacgtggccgacatctatgccaccagcacctgcacagaggtgtggagcaacagcctgggccacctggtgtatgtgctggtgtacaacatcaccaccgtgattgtgcctgtggtggtggtgttcctgttcctgatcctgatcagaagagccctgagcgccagccagaagaagaaggtgatcatcgccgccctgcggaccccccagaacaccatcagcatcccctatgccagccagcgggaggccgagctgcacgccaccctgctgtccatggtgatggtgttcatcctgtgcagcgtgccctatgccaccctggtggtgtaccagacagtgctgaatgtgcctgacaccagcgtcttcctgctgctgacagctgtgtggctgcccaaggtgtccctgctggccaaccctgtgctcttcctgactgtgaacaagtctgtgaggaaatgtctcatcggcaccctggtgcagctgcaccaccgctacagcagaagaaatgtggtgtccacaggcagcggcatggccgaggccagcctggagcccagcatccgcagcggcagccagctgctggagatgttccacatcggccagcagcagatcttcaagcccacagaagatgaggaggagagcgaggccaagtacatcggcagcgctgacttccaggccaaggagatcttcagcacctgcctggagggggagcagggcccccagtttgcccccagcgccccacccctgagcacagtggacagcgtgtcccaggtggccccagctgcccctgtggagcctgagaccttcccagacaagtacagcctgcagtttggatttggcccctttgagctgcccccccagtggctgtctgagaccaggaacagcaagaagaggctgctgccccccctgggcaacaccccagaggagctgatccagaccaaggtgcccaaggtgggccgggtggagaggaagatgagcaggaacaacaaggtgtccatcttccccaaggtggacagctag

SEQ ID NO: 153220 - DNA, 1548 bp, Artificial Sequence; identical to SEQ ID NO: 153219
  Description of Artificial Sequence: Synthetic coding sequence

SEQ ID NO: 153221 - DNA, 996 bp, Artificial Sequence
  Description of Artificial Sequence: Synthetic coding sequence
atgatcaccctgaacaaccaggaccagcctgtgcccttcaacagcagccacccagatgagtacaagattgctgccctggtgttctacagctgcatcttcatcatcggcctgtttgtgaacatcacagccctgtgggtgttcagctgcaccaccaagaagaggaccaccgtgaccatctacatgatgaatgtggccctggtggacctgatcttcatcatgaccctgcccttcaggatgttctactatgccaaggatgagtggccctttggagagtacttctgccagatcctgggcgccctgactgtgttctaccccagcatcgccctgtggctgctggccttcatctctgctgaccgctacatggccatcgtgcagcccaagtatgccaaggagctgaagaacacctgcaaggctgtgctggcctgtgtgggcgtgtggatcatgaccctgaccaccaccacccccctgctgctgctgtacaaggaccctgacaaggacagcaccccagccacctgcctgaagatcagtgacatcatctacctgaaggctgtgaatgtgctgaacctgacccggctgaccttcttcttcctgatccccctcttcatcatgattggctgctacctggtgatcatccacaacctgctgcacggccgcaccagcaagctgaagcccaaggtgaaggagaagagcatccgcatcatcatcaccctgctggtgcaggtgctggtgtgcttcatgcccttccacatctgctttgccttcctgatgctgggcactggagaaaattcctacaacccctggggcgccttcaccaccttcctgatgaacctgagcacctgcctggatgtgatcctgtactacatcgtgtccaagcagttccaggcccgggtcatctctgtgatgctgtacagaaactacctgcgctccatgaggaggaagagcttccgcagcggcagcctgcggagcctgagcaacatcaacagcgagatgctgtag

SEQ ID NO: 153222 - DNA, 996 bp, Artificial Sequence; identical to SEQ ID NO: 153221
  Description of Artificial Sequence: Synthetic coding sequence

SEQ ID NO: 153223 - DNA, 996 bp, Artificial Sequence; identical to SEQ ID NO: 153221
  Description of Artificial Sequence: Synthetic coding sequence

SEQ ID NO: 153224 - DNA, 297 bp, Artificial Sequence
  Description of Artificial Sequence: Synthetic coding sequence
atgatcaccctgaacaaccaggaccagcctgtgcccttcaacagcagccacccagatgagtacaagattgctgccctggtgttctacagctgcatcttcatcatcggcctgtttgtgaacatcacagccctgtgggtgttcagctgcaccaccaagaagaggaccaccgtgaccatctacatgatgaatgtggccctggtggacctgatcttcatcatgaccctgcccttcaggatgttctactatgccaaggatgagtggccctttggagagtacttctgccagatcctgggctag

SEQ ID NO: 153225 - DNA, 1086 bp, Artificial Sequence
  Description of Artificial Sequence: Synthetic coding sequence
atggacatccagatggccaacaacttcaccccaccttctgccaccccccagggcaatgactgtgacctgtatgcccaccacagcacagcccgcatcgtgatgcccctgcactacagcctggtgttcatcatcggcctggtgggcaacctgctggccctggtggtgattgtgcagaacaggaagaagatcaacagcaccaccctgtacagcaccaacctggtgatcagtgacatcctcttcaccacagccctgcccacccgcatcgcctactatgccatgggctttgactggagaattggagatgccctgtgccgcatcacagccctggtgttctacatcaacacctacgccggcgtgaacttcatgacctgcctgagcattgaccgcttcatcgctgtggtgcaccccctgcgctacaacaagatcaagagaattgaacatgccaagggcgtgtgcatctttgtgtggatcctggtgtttgcccagaccctgcccctgctgatcaaccccatgagcaagcaggaggccgagcgcatcacctgcatggagtaccccaactttgaggagaccaagagcctgccctggatcctgctgggcgcctgcttcatcggctacgtgctgcccctcatcatcatcctgatctgctacagccagatctgctgcaagctgttcagaacagccaagcagaaccccctgacagagaagagcggcgtgaacaagaaggccctgaacaccatcatcctgatcatcgtggtgtttgtgctgtgcttcaccccctaccacgtggccatcatccagcacatgatcaagaagctgcgcttcagcaacttcctggagtgcagccagaggcacagcttccagatcagcctgcacttcaccgtgtgcctgatgaacttcaactgctgcatggaccccttcatctacttctttgcctgcaagggctacaagaggaaggtgatgaggatgctgaagaggcaggtgtctgtgtccatcagcagcgctgtgaagagcgcccctgaggagaacagccgggagatgacagagacccagatgatgatccacagcaagagcagcaatggcaagtag

SEQ ID NO: 153226 - DNA, 1248 bp, Artificial Sequence
  Description of Artificial Sequence: Synthetic coding sequence
atggtgtttgcccacaggatggacaacagcaagccccacctgatcatccccaccctgctggtgcccctgcagaacagaagctgcacagaaacagccacccccctgcccagccagtacctgatggagctgtctgaggagcacagctggatgagcaaccagacagacctgcactacgtgctgaagccaggagaggtggccacagccagcatcttcttcggcatcctgtggctgttcagcatctttggaaacagcctggtgtgcctggtgatccacaggagcaggaggacccagagcaccaccaactactttgtggtgtccatggcctgtgccgacctgctgatctctgtggccagcaccccatttgtgctgctgcagttcaccaccggccgctggaccctgggcagcgccacctgcaaggtggtgcgctacttccagtacctgaccccaggagtgcagatctacgtgctgctgagcatctgcatcgaccgcttctacaccatcgtgtaccccctgtccttcaaggtgtcccgggagaaggccaagaagatgattgctgcctcctgggtgtttgatgctggctttgtgacccctgtgctcttcttctacggcagcaactgggacagccactgcaactacttcctgcccagctcctgggagggcacagcctacaccgtcatccacttcctggtgggcttcgtcatccccagcgtgctgatcatcctcttctaccagaaggtgatcaagtacatctggagaattggaacagatggccgcacagtgcggaggaccatgaacatcgtgcccaggaccaaggtgaagaccatcaagatgttcctgatcctgaacctgctcttcctgctgtcctggctgcccttccacgtggcccagctgtggcacccccatgagcaggactacaagaagagcagcctggtgttcaccgccatcacctggatctccttcagcagcagcgccagcaagcccaccctgtacagcatctacaatgccaacttccggcggggcatgaaggagaccttctgcatgagctccatgaagtgctaccgcagcaatgcctacaccatcaccaccagcagcaggatggccaagaagaactacgtgggcatcagcgagatccccagcatggccaagaccatcaccaaggacagcatctatgacagctttgaccgggaggccaaggagaagaagctggcctggcccatcaacagcaacccccccaacacctttgtgtag

SEQ ID NO: 153227 - DNA, 1248 bp, Artificial Sequence; identical to SEQ ID NO: 153226
  Description of Artificial Sequence: Synthetic coding sequence

SEQ ID NO: 153228 - DNA, 180 bp, Artificial Sequence
  Description of Artificial Sequence: Synthetic coding sequence
atggtgtttgcccacaggatggacaacagcaagccccacctgatcatccccaccctgctggtgcccctgcagaacagaagctgcacagaaacagccacccccctgcccagccagtacctgatggagctgtctgaggagcacagctggatgagcaaccagacagacctgcactacgtgtag

SEQ ID NO: 153229 - DNA, 1077 bp, Artificial Sequence
  Description of Artificial Sequence: Synthetic coding sequence
atgcccagcgtgtccccagctggccccagcgctggagctgtgcccaatgccacagctgtgaccaccgtgaggaccaatgccagcggcctggaggtgcccctcttccacctgtttgcccggctggatgaggagctgcacggcaccttccctggcctgtggctggccctgatggctgtgcacggggccatcttcctggccggcctggtgctgaatggcctggccctgtatgtgttctgctgcaggacccgggccaagacccccagcgtcatctacaccatcaacctggtggtgacagacctgctggtgggcctgagcctgcccaccaggtttgctgtgtactacggggcccggggctgcctgcgctgtgccttcccccacgtgctgggctacttcctgaacatgcactgcagcatcctcttcctgacctgcatctgtgtggaccgctacctggccatcgtgcggcctgagggcagccgccgctgccggcagcctgcctgtgcccgggctgtgtgtgcctttgtgtggctggccgccggggctgtgaccctgtctgtgctgggcgtgacaggcagccggccctgctgccgggtgtttgccctgactgtgctggagttcctgctgcccctgctggtgatctctgtgttcaccggccgcatcatgtgtgccctgagccggcccggcctgctgcaccagggccggcagaggagagtgcgggccatgcagctgctgctgactgtgctgatcatcttcctggtgtgcttcacccccttccacgcccggcaggtggccgtggccctgtggccagacatgccccaccacaccagcctggtggtgtaccacgtggccgtgaccctgagcagcctgaacagctgcatggaccccatcgtgtactgctttgtgaccagcggcttccaggccaccgtgcggggcctgtttggccagcacggggagcgggagcccagcagtggagatgtggtgtccatgcacaggagcagcaaaggaagtggccgccaccacatcctgtctgctggcccccacgccctgacccaggccctggccaacggccctgaggcctag

SEQ ID NO: 153230 - DNA, 1050 bp, Artificial Sequence
  Description of Artificial Sequence: Synthetic coding sequence
atgaacagcaccctggatggcaaccagagcagccaccccttctgcctgctggccttcggctacctggagaccgtgaacttctgcctgctggaggtgctgatcatcgtgttcctgactgtgctgatcatcagcggcaacatcatcgtcatctttgtgttccactgtgcccccctgctgaaccaccacaccaccagctacttcatccagaccatggcctatgctgacctgtttgtgggcgtgtcctgtgtggtgcccagcctgagcctgctgcaccaccccctgcctgtggaggagagcctgacctgccagatctttggatttgtggtgtctgtgctgaagtctgtgtccatggccagcctggcctgcatcagcattgaccgctacatcgccatcaccaagcccctgacctacaacaccctggtgaccccctggaggctgcggctgtgcatcttcctgatctggctgtacagcaccctggtgttcctgcccagcttcttccactggggcaagccaggctaccatggagatgtgttccagtggtgtgccgagagctggcacacagacagctacttcaccctcttcatcgtgatgatgctgtatgccccagctgccctgattgtgtgcttcacctacttcaacatcttccgcatctgccagcagcacaccaaggacatcagcgagcggcaggcccgcttcagcagccagagcggggagactggagaggtgcaggcctgcccagacaagagatatgccatggtgctcttccgcatcacctctgtgttctacatcctgtggctgccctacatcatctacttcctgctggagagcagcacaggccacagcaacagatttgccagcttcctgaccacctggctggccatcagcaacagcttctgcaactgtgtgatctacagcctgagcaacagcgtcttccagaggggcctgaagaggctgagcggggccatgtgcaccagctgtgccagccagaccacagccaatgacccctacacagtgcgcagcaagggccccctgaatggctgccacatctag

SEQ ID NO: 153231 - DNA, 753 bp, Artificial Sequence
  Description of Artificial Sequence: Synthetic coding sequence
atgaacagcaccctggatggcaaccagagcagccaccccttctgcctgctggccttcggctacctggagaccgtgaacttctgcctgctggaggtgctgatcatcgtgttcctgactgtgctgatcatcagcggcaacatcatcgtcatctttgtgttccactgtgcccccctgctgaaccaccacaccaccagctacttcatccagaccatggcctatgctgacctgtttgtgggcgtgtcctgtgtggtgcccagcctgagcctgctgcaccaccccctgcctgtggaggagagcctgacctgccagatctttggatttgtggtgtctgtgctgaagtctgtgtccatggccagcctggcctgcatcagcattgaccgctacatcgccatcaccaagcccctgacctacaacaccctggtgaccccctggaggctgcggctgtgcatcttcctgatctggctgtacagcaccctggtgttcctgcccagcttcttccactggggcaagccaggctaccatggagatgtgttccagtggtgtgccgagagctggcacacagacagctacttcaccctcttcatcgtgatgatgctgtatgccccagctgccctgattgtgtgcttcacctacttcaacatcttccgcatctgccagcagcacaccaaggacatcagcgagcggcaggcccgcttcagcagccagagcggggagactggagaggtgcaggcctgccctgtgagcaaccactag

SEQ ID NO: 153232 - DNA, 1302 bp, Artificial Sequence
  Description of Artificial Sequence: Synthetic coding sequence
atgtgcttcagccccatcctggagatcaacatgcagagcgagagcaacatcaccgtgagagatgacattgatgacatcaacaccaacatgtaccagcccctgagctaccccctgtccttccaggtgtccctgaccggcttcctgatgctggagatcgtgctgggcctgggcagcaacctgactgtgctggtgctgtactgcatgaagagcaacctgatcaacagcgtgagcaacatcatcaccatgaacctgcacgtgctggatgtgatcatctgtgtgggctgcatccccctgaccatcgtcatcctgctgctgagcctggagagcaacacagccctgatctgctgcttccacgaggcctgtgtgtcctttgcctctgtgtccacagccatcaacgtgtttgccatcaccctggacagatatgacatctctgtgaagccagccaaccgcatcctgaccatgggccgggctgtgatgctgatgatcagcatctggatcttctccttcttctccttcctgatccccttcatcgaggtgaacttcttcagcctgcagagcggcaacacctgggagaacaagaccctgctgtgtgtgtccaccaatgagtactacacagagctgggcatgtactaccacctgctggtgcagatccccatcttcttcttcaccgtggtggtgatgctgatcacctacaccaagatcctgcaggccctgaacatccgcatcggcacccgcttcagcacaggccagaagaagaaggccaggaagaagaagaccatcagcctgaccacccagcacgaggccacagacatgagccagagcagcggcggcagaaatgtggtgtttggagtgaggacctctgtgtctgtcatcatcgccctgcggcgggctgtgaagaggcaccgggagcggcgggagcggcagaagagggtcttcaggatgagcctgctgatcatcagcaccttcctgctgtgctggacccccatctctgtgctgaacaccaccatcctgtgcctgggccccagcgacctgctggtgaagctgcggctgtgcttcctggtgatggcctacggcaccaccatcttccaccccctgctgtatgccttcacccggcagaagttccagaaggtgctgaagagcaagatgaagaagagggtggtgtccatcgtggaggccgaccccctgcccaacaatgctgtgatccacaacagctggattgaccccaagaggaacaagaagatcacctttgaagattctgagatccgggagaagtgcctggtgccccaggtggtgacagactag

SEQ ID NO: 153233 - DNA, 1086 bp, Artificial Sequence
  Description of Artificial Sequence: Synthetic coding sequence
atggcccccacagagccctggagccccagccctggcagcgccccctgggactacagcggcctggatggcctggaggagctggagctgtgcccagctggggacctgccctacggctacgtgtacatcccagccctgtacctggccgcctttgctgtgggcctgctgggcaatgcctttgtggtgtggctgctggccggcagaagaggcccccggcggctggtggacacctttgtgctgcacctggccgctgctgacctgggctttgtgctgaccctgcccctgtgggccgctgctgctgccctgggcggccgctggccctttggagatggcctgtgcaagctgagcagctttgccctggccggcacccgctgtgccggggccctgctgctggccggcatgtctgtggaccgctacctggccgtggtgaagctgctggaggcccggcccctgcggaccccccgctgtgccctggccagctgctgcggcgtgtgggccgtggccctgctggccggcctgcccagcctggtgtaccggggcctgcagcccctgcccggcggccaggacagccagtgtggggaggagcccagccacgccttccagggcctgagcctgctgctgctgctgctgacctttgtgctgcccctggtggtgaccctcttctgctactgccgcatcagccggcggctgcggcggcccccccacgtgggccgggcccggaggaacagcctgcgcatcatctttgccatcgagagcacctttgtgggctcctggctgcccttcagcgccctgcgggctgtgttccacctggcccggctgggcgccctgcccctgccctgccccctgctgctggccctgcgctggggcctgaccatcgccacctgcctggcctttgtgaacagctgtgccaaccccctcatctacctgctgctggaccgctccttccgggcccgggccctggatggagcctgtggccgcacaggccgcctggcccggcgcatcagcagcgccagcagcctgagcagagatgacagctctgtgttccgctgccgggcccaggccgccaacacagccagcgcctcctggtag

SEQ ID NO: 153234 - DNA, 1014 bp, Artificial Sequence
  Description of Artificial Sequence: Synthetic coding sequence
atgaacagctgggatgctggcctggccggcctgctggtgggcaccatgggcgtgtccctgctgagcaatgccctggtgctgctgtgcctgctgcacagcgctgacatccggcggcaggccccagccctcttcaccctgaacctgacctgtggcaacctgctgtgcaccgtggtgaacatgcccctgaccctggccggcgtggtggcccagaggcagcctgctggggaccggctgtgccgcctggccgccttcctggacaccttcctggccgccaacagcatgctgtccatggccgccctgagcattgaccgctgggtggccgtggtgttccccctgagctaccgggccaagatgaggctgagagatgctgccctgatggtggcctacacctggctgcacgccctgaccttccctgctgctgccctggccctgtcctggctgggcttccaccagctgtatgccagctgcaccctgtgcagcagaagaccagatgagcggctgcgctttgctgtgttcaccggggccttccacgccctgtccttcctgctgagctttgtggtgctgtgctgcacctacctgaaggtgctgaaggtggcccgcttccactgcaagagaattgatgtgatcaccatgcagaccctggtgctgctggtggacctgcaccccagcgtgcgggagcgctgcctggaggagcagaagagaagacggcagagggccaccaagaagatcagcaccttcatcggcaccttcctggtgtgctttgccccctacgtgatcacccggctggtggagctgttcagcacagtgcccatcggcagccactggggcgtgctgagcaagtgcctggcctacagcaaggccgccagtgacccctttgtgtacagcctgctgcggcaccagtacaggaagagctgcaaggagatcctgaaccggctgctgcacagaagaagcatccacagcagcggcctgaccggggacagccacagccagaacatcctgcctgtgtctgagtag

SEQ ID NO: 153235 - DNA, 1128 bp, Artificial Sequence
  Description of Artificial Sequence: Synthetic coding sequence
atggccaatgccagcgagcccggcggcagcggcggcggggaggccgccgccctgggcctgaagctggccaccctgagcctgctgctgtgtgtgtccctggccggaaatgtgctgtttgccctgctgattgtgcgggagaggagcctgcaccgggccccctactacctgctgctggacctgtgcctggctgatggcctgcgggccctggcctgcctgcctgctgtgatgctggccgcccggcgggctgctgctgctgctggggcccctcctggggccctgggctgcaagctgctggccttcctggccgccctcttctgcttccacgccgccttcctgctgctgggcgtgggcgtgacccgctacctggccatcgcccaccaccgcttctatgcagagcggctggccggctggccctgtgccgccatgctggtgtgtgccgcctgggccctggccctggccgccgccttcccccctgtgctggatggcggcggagatgatgaagatgccccctgtgccctggagcagaggccagatggagcccctggggccctgggcttcctgctgctgctggccgtggtggtgggcgccacccacctggtgtacctgcggctgctcttcttcatccatgacaggaggaagatgaggcctgcccggctggtgcctgctgtgtcccatgactggaccttccacggccctggggccaccggccaggccgccgccaactggacagctggcttcggccggggccccaccccaccagccctggtgggcatccggcctgctggccctggccgcggggcccggcggctgctggtgctggaggagttcaagacagagaagaggctgtgcaagatgttttatgctgtgaccctgctcttcctgctgctgtggggcccctacgtggtggccagctacctgcgggtgctggtgcggcctggagctgtgccccaggcctacctgacagcctctgtgtggctgacctttgcccaggccggcatcaaccctgtggtgtgcttcctgttcaaccgggagctgcgggactgcttccgggcccagttcccctgctgccagagccccaggaccacccaggccacccacccctgtgacctgaagggcatcggcctgtag

SEQ ID NO: 153236 - DNA, 993 bp, Artificial Sequence
  Description of Artificial Sequence: Synthetic coding sequence
atgatgtggggcgccggcagccccctggcctggctgtctgctggcagcggaaatgtgaatgtgtcctctgtgggccctgctgagggccccactggacctgctgcccccctgcccagccccaaggcctgggatgtggtgctgtgcatcagcggcaccctggtgtcctgtgaaaatgccctggtggtggccatcatcgtgggcaccccagccttccgggcccccatgttcctgctggtgggcagcctggccgtggccgacctgctggccggcctgggcctggtgctgcactttgctgctgtgttctgcatcggcagcgctgagatgagcctggtgctggtgggcgtgctggccatggccttcaccgccagcatcggcagcctgctggccatcaccgtggaccgctacctgagcctgtacaatgccctgacctactacagcgagaccaccgtgaccaggacctacgtgatgctggccctggtgtggggcggggccctgggcctgggcctgctgcctgtgctggcctggaactgcctggatggcctgaccacctgtggggtggtgtaccccctgagcaagaaccacctggtggtgctggccatcgccttcttcatggtgtttggcatcatgctgcagctgtatgcccagatctgcagaattgtgtgcagacatgcccagcagatcgccctgcagaggcacctgctgcctgccagccactacgtggccaccaggaagggcatcgccaccctggccgtggtgctgggcgcctttgctgcctgctggctgcccttcaccgtgtactgcctgctgggagatgcccacagcccccccctgtacacctacctgaccctgctgcctgccacctacaacagcatgatcaaccccatcatctatgccttcaggaaccaggatgtgcagaaggtgctgtgggccgtgtgctgctgctgcagcagcagcaagatccccttccgcagccgcagccccagtgatgtgtag

SEQ ID NO: 153237 - DNA, 960 bp, Artificial Sequence
  Description of Artificial Sequence: Synthetic coding sequence
atgcccttccccaactgcagcgcccccagcacagtggtggccacagctgtgggcgtgctgctgggcctggagtgtggcctgggcctgctgggcaatgctgtggccctgtggaccttcctgttccgggtgcgggtgtggaagccctatgctgtgtacctgctgaacctggccctggccgacctgctgctggccgcctgcctgcccttcctggccgccttctacctgagcctgcaggcctggcacctgggccgggtgggctgctgggccctgcacttcctgctggacctgagccgctctgtgggcatggccttcctggccgctgtggccctggaccgctacctgcgggtggtgcacccccggctgaaggtgaacctgctgagcccccaggccgccctgggcgtgtctggcctggtgtggctgctgatggtggccctgacctgccccggcctgctgatcagcgaggccgcccagaacagcacccgctgccacagcttctacagcagagcagatggcagcttcagcatcatctggcaggaggccctgagctgcctgcagtttgtgctgcccttcggcctgattgtgttctgcaatgccggcatcatccgggccctgcagaagaggctgcgggagcctgagaagcagcccaagctgcagagggcccaggccctggtgaccctggtggtggtgctgtttgccctgtgcttcctgccctgcttcctggcccgggtgctgatgcacatcttccagaacctgggcagctgccgggccctgtgtgctgtggcccacaccagtgatgtgacaggcagcctgacctacctgcacagcgtgctgaaccctgtggtgtactgcttcagcagccccaccttccgcagcagctaccgccgggtcttccacaccctgcggggcaagggccaggccgctgagcccccagacttcaacccccgggacagctacagctag

SEQ ID NO: 153238 - DNA, 1071 bp, Artificial Sequence
  Description of Artificial Sequence: Synthetic coding sequence
atgaatggagtgtctgagggcacccggggctgcagcgaccggcagcccggggtgctgacccgggacaggagctgcagcaggaagatgaacagcagcggctgcctgtctgaggaggtgggcagcctgcggcccctgactgtggtgatcctgagcgccagcatcgtggtgggcgtgctgggcaatggcctggtgctgtggatgaccgtcttcaggatggccaggacagtgtccacagtgtgcttcttccacctggccctggccgacttcatgctgagcctgagcctgcccatcgccatgtactacatcgtgtcccggcagtggctgctgggggagtgggcctgcaagctgtacatcacctttgtgttcctgagctactttgccagcaactgcctgctggtgttcatctctgtggaccgctgcatctctgtgctgtaccctgtgtgggccctgaaccacaggacagtgcagagggcctcctggctggcctttggagtgtggctgctggccgccgccctgtgcagcgcccacctgaagttccgcaccaccaggaagtggaatggctgcacccactgctacctggccttcaacagcgacaatgaaacagcccagatctggattgagggcgtggtggagggccacatcatcggcaccatcggccacttcctgctgggcttcctgggccccctggccatcatcggcacctgtgcccacctgatccgggccaagctgctgcgggagggctgggtgcacgccaaccggcccaagaggctgctgctggtgctggtgtctgccttcttcatcttctggagccccttcaacgtggtgctgctggtgcacctgtggaggagagtgatgctgaaggagatctaccaccccaggatgctgctgatcctgcaggccagctttgccctgggctgtgtgaacagcagcctgaaccccttcctgtatgtgtttgtgggccgggacttccaggagaagttcttccagagcctgaccagcgccctggcccgggcctttggagaggaggagttcctgagcagctgccccagaggaaatgccccccgggagtag

SEQ ID NO: 153239 - DNA, 1146 bp, Artificial Sequence
  Description of Artificial Sequence: Synthetic coding sequence
atgaggagccacaccatcaccatgaccaccacctctgtgtcctcctggccctacagcagccacaggatgaggttcatcaccaaccacagcgaccagcccccccagaacttcagcgccacccccaacgtgaccacctgccccatggatgagaagctgctgagcacagtgctgaccaccagctacagcgtcatcttcatcgtgggcctggtgggcaacatcatcgccctgtatgtgttcctgggcatccacaggaagaggaacagcatccagatctacctgctgaatgtggccatcgctgacctgctgctgatcttctgcctgcccttccgcatcatgtaccacatcaaccagaacaagtggaccctgggcgtcatcctgtgcaaggtggtgggcaccctcttctacatgaacatgtacatcagcatcatcctgctgggcttcatcagcctggaccgctacatcaagatcaacagaagcatccagcagaggaaggccatcaccaccaagcagagcatctacgtgtgctgcatcgtgtggatgctggccctgggcggcttcctgaccatgatcatcctgaccctgaagaagggcggccacaacagcaccatgtgcttccactacagagacaagcacaatgccaagggggaggccatcttcaacttcatcctggtggtgatgttctggctgatcttcctgctgatcatcctgagctacatcaagattggcaagaacctgctgcgcatcagcaagagaagaagcaagttccccaacagcggcaagtatgccaccacagccaggaacagcttcatcgtgctgatcatcttcaccatctgctttgtgccctaccacgccttccgcttcatctacatcagcagccagctgaatgtgagcagctgctactggaaggagatcgtgcacaagaccaatgagatcatgctggtgctgagcagcttcaacagctgcctggaccctgtgatgtacttcctgatgagcagcaacatcaggaagatcatgtgccagctgctcttccgccgcttccagggcgagcccagccgctctgagagcaccagcgagttcaagccaggctacagcctgcatgacacctctgtggccgtgaagatccagagcagcagcaagagcacctag

SEQ ID NO: 153240 - DNA, 1146 bp, Artificial Sequence; identical to SEQ ID NO: 153239
  Description of Artificial Sequence: Synthetic coding sequence

SEQ ID NO: 153241 - DNA, 1005 bp, Artificial Sequence
  Description of Artificial Sequence: Synthetic coding sequence
atggatgagaagctgctgagcacagtgctgaccaccagctacagcgtcatcttcatcgtgggcctggtgggcaacatcatcgccctgtatgtgttcctgggcatccacaggaagagaaattccatccagatctacctgctgaatgtggccatcgctgacctgctgctgatcttctgcctgcccttccgcatcatgtaccacatcaaccagaacaagtggaccctgggcgtcatcctgtgcaaggtggtgggcaccctcttctacatgaacatgtacatcagcatcatcctgctgggcttcatcagcctggaccgctacatcaagatcaacagaagcatccagcagaggaaggccatcaccaccaagcagagcatctacgtgtgctgcatcgtgtggatgctggccctgggcggcttcctgaccatgatcatcctgaccctgaagaagggcggccacaacagcaccatgtgcttccactacagagacaagcacaatgccaagggggaggccatcttcaacttcatcctggtggtgatgttctggctgatcttcctgctgatcatcctgagctacatcaagattggcaagaacctgctgcgcatcagcaagaggaggagcaagttccccaacagcggcaagtatgccaccacagccagaaattccttcatcgtgctgatcatcttcaccatctgctttgtgccctaccacgccttccgcttcatctacatcagcagccagctgaatgtgagcagctgctactggaaggagatcgtgcacaagaccaatgagatcatgctggtgctgagcagcttcaacagctgcctggaccctgtgatgtacttcctgatgagcagcaacatcaggaagatcatgtgccagctgctcttccgccgcttccagggcgagcccagccgctctgagagcaccagcgagttcaagccaggctacagcctgcatgacacctctgtggccgtgaagatccagagcagcagcaagagcacctag

SEQ ID NO: 153242 - DNA, 930 bp, Artificial Sequence
  Description of Artificial Sequence: Synthetic coding sequence
atgaatggcacctacaacacctgtggcagcagtgacctgacctggcccccagccatcaagctgggcttctacgcctacctgggcgtgctgctggtgctgggcctgctgctgaacagcctggccctgtgggtgttctgctgcaggatgcagcagtggacagagacccgcatctacatgaccaacctggccgtggccgacctgtgcctgctgtgcaccctgccctttgtgctgcacagcctgcgggacaccagtgacacccccctgtgccagctgagccagggcatctacctgaccaaccgctacatgagcatcagcctggtgacagccatcgctgtggacagatatgtggccgtgcgccaccccctgcgggcccggggcctgcggagcccccggcaggccgctgctgtgtgtgctgtgctgtgggtgctggtgattggcagcctggtggcccgctggctgctgggcatccaggagggcggcttctgcttccgcagcaccaggcacaacttcaacagcatggccttccccctgctgggcttctacctgcccctggccgtggtggtgttctgcagcctgaaggtggtgacagccctggcccagaggcctcccacagatgtgggccaggccgaggccaccaggaaggccgccaggatggtgtgggccaacctgctggtgtttgtggtgtgcttcctgcccctgcacgtgggcctgactgtgcggctggccgtgggctggaatgcctgtgccctgctggagaccatcagaagagccctgtacatcaccagcaagctgagtgatgccaactgctgcctggatgccatctgctactactacatggccaaggagttccaggaggccagcgccctggccgtggcccccagcgccaaggcccacaagagccaggacagcctgtgtgtgaccctggcctag

SEQ ID NO: 153243 - DNA, 930 bp, Artificial Sequence; identical to SEQ ID NO: 153242
  Description of Artificial Sequence: Synthetic coding sequence

SEQ ID NO: 153244 - DNA, 930 bp, Artificial Sequence; identical to SEQ ID NO: 153242
  Description of Artificial Sequence: Synthetic coding sequence

SEQ ID NO: 153245 - DNA, 930 bp, Artificial Sequence; identical to SEQ ID NO: 153242
  Description of Artificial Sequence: Synthetic coding sequence

SEQ ID NO: 153246 - DNA, 1023 bp, Artificial Sequence
  Description of Artificial Sequence: Synthetic coding sequence
atgctgagcggcagcagagctgtgcccaccccccaccggggcagcgaggagctgctgaagtacatgctgcacagcccctgtgtgtccctgaccatgaatggcacctacaacacctgtggcagcagtgacctgacctggcccccagccatcaagctgggcttctacgcctacctgggcgtgctgctggtgctgggcctgctgctgaacagcctggccctgtgggtgttctgctgcaggatgcagcagtggacagagacccgcatctacatgaccaacctggccgtggccgacctgtgcctgctgtgcaccctgccctttgtgctgcacagcctgcgggacaccagtgacacccccctgtgccagctgagccagggcatctacctgaccaaccgctacatgagcatcagcctggtgacagccatcgctgtggaccgctacgtggccgtgcgccaccccctgcgggcccggggcctgcggagcccccggcaggccgctgctgtgtgtgctgtgctgtgggtgctggtgattggcagcctggtggcccgctggctgctgggcatccaggagggcggcttctgcttccgcagcaccaggcacaacttcaacagcatggccttccccctgctgggcttctacctgcccctggccgtggtggtgttctgcagcctgaaggtggtgacagccctggcccagaggcctcccacagatgtgggccaggccgaggccaccaggaaggccgccaggatggtgtgggccaacctgctggtgtttgtggtgtgcttcctgcccctgcacgtgggcctgactgtgcggctggccgtgggctggaatgcctgtgccctgctggagaccatccggcgggccctgtacatcaccagcaagctgagtgatgccaactgctgcctggatgccatctgctactactacatggccaaggagttccaggaggccagcgccctggccgtggcccccagcgccaaggcccacaagagccaggacagcctgtgtgtgaccctggcctag

SEQ ID NO: 153247 - DNA, 1842 bp, Artificial Sequence
  Description of Artificial Sequence: Synthetic coding sequence
atgagggcccctggggccctgctggccaggatgagccggctgctgctgctgctgctgctgaaggtgtctgccagcagcgccctgggcgtggccccagccagcagaaatgagacctgcctgggggagagctgtgcccccaccgtcatccagaggcggggcagagatgcctggggccctggcaacagcgccagagatgtgctgcgggcccgggccccccgggaggagcagggcgccgccttcctggccggccccagctgggacctgcctgctgcccctggccgggaccctgctgctggccgcggggctgaggccagcgctgctggccccccaggcccccccacccggcccccaggcccctggcgctggaagggggcccggggccaggagcccagcgagaccctgggccggggcaaccccacagccctgcagctgttcctgcagatcagcgaggaggaggagaagggccccagaggagctggcatcagcggccgcagccaggagcagagcgtgaagacagtgcctggggccagtgacctcttctactggccccggcgggccggcaagctgcagggcagccaccacaagcccctgagcaagacagccaacggcctggccggccacgagggctggaccatcgccctgcccggccgggccctggcccagaatggcagcctgggggagggcatccacgagcccggcggcccccggcggggcaacagcaccaacagaagagtgcggctgaagaaccccttctaccccctgacccaggagagctatggagcctatgctgtgatgtgcctgtctgtggtgatcttcggcaccggcatcatcggcaacctggccgtgatgtgcatcgtgtgccacaactactacatgaggagcatcagcaacagcctgctggccaacctggccttctgggacttcctgatcatcttcttctgcctgcccctggtgatcttccacgagctgaccaagaagtggctgctggaggacttcagctgcaagatcgtgccctacatcgaggtggccagcctgggcgtgaccaccttcaccctgtgtgccctgtgcatcgaccgcttccgggccgccaccaacgtgcagatgtactatgagatgattgagaactgcagcagcaccacagccaagctggccgtcatctgggtgggcgccctgctgctggccctgcctgaggtggtgctgcggcagctgagcaaggaggacctgggcttcagcggccgggccccagctgagcgctgcatcatcaagatcagcccagacctgcctgacaccatctacgtgctggccctgacctatgacagcgcccggctgtggtggtacttcggctgctacttctgcctgcccaccctcttcaccatcacctgcagcctggtgacagccaggaagatcaggaaggccgagaaggcctgcacccggggcaacaagaggcagatccagctggagagccagatgaactgcaccgtggtggccctgaccatcctgtatggcttctgcatcatccctgagaacatctgcaacatcgtgacagcctacatggccaccggggtgtcccagcagaccatggacctgctgaacatcatcagccagttcctgctcttcttcaagagctgtgtgacccctgtgctgctcttctgcctgtgcaagcccttcagccgggccttcatggagtgctgctgctgctgctgtgaggagtgcatccagaagagcagcacagtgaccagtgatgacaatgacaatgagtacaccacagagctggagctgagccccttcagcaccatccggcgggagatgagcacctttgcctctgtgggcacccactgctag

SEQ ID NO: 153248 - DNA, 1362 bp, Artificial Sequence
  Description of Artificial Sequence: Synthetic coding sequence
atggccagccccagcctgcccggcagtgactgcagccagatcatcgaccacagccacgtgcctgagtttgaggtggccacctggatcaagatcaccctcatcctggtgtacctgatcatctttgtgatgggcctgctgggcaacagcgccaccatccgggtgacccaggtgctgcagaagaagggctacctgcagaaggaggtgacagaccacatggtgtccctggcctgcagcgacatcctggtgttcctgattggcatgcccatggagttctacagcatcatctggaaccccctgaccaccagcagctacaccctgagctgcaagctgcacaccttcctgtttgaggcctgcagctatgccaccctgctgcacgtgctgaccctgagctttgagcgctacatcgccatctgccaccccttccgctacaaggctgtgtctggcccctgccaggtgaagctgctgattggatttgtgtgggtgaccagcgccctggtggccctgcccctgctgtttgccatgggcacagagtaccccctggtgaatgtgcccagccaccggggcctgacctgcaacagaagcagcaccaggcaccacgagcagcctgagaccagcaacatgagcatctgcaccaacctgagcagccgctggacagtgttccagagcagcatctttggagcctttgtggtgtacctggtggtgctgctgtctgtggccttcatgtgctggaacatgatgcaggtgctgatgaagagccagaagggcagcctggccggcggcaccaggcctccccagctgaggaagtctgagagcgaggagagcaggacagcccggcggcagaccatcatcttcctgcggctcatcgtggtgaccctggccgtgtgctggatgcccaaccagatccgccgcatcatggctgctgccaagcccaagcatgactggaccaggagctacttccgggcctacatgatcctgctgcccttcagcgagaccttcttctacctgagcagcgtcatcaaccccctgctgtacacagtgagcagccagcagttccggcgggtgtttgtgcaggtgctgtgctgccgcctgagcctgcagcacgccaaccacgagaagaggctgcgggtgcacgcccacagcaccacagacagcgccaggtttgtgcagaggcccctgctgtttgccagccggcggcagagcagcgccaggagaacagagaagatcttcctgagcaccttccagagcgaggccgagccccagagcaagagccagagcctgagcctggagagcctggagcccaacagcggggccaagccagccaacagcgctgctgaaaatggcttccaggagcacgaggtgtag

SEQ ID NO: 153249 - DNA, 1089 bp, Artificial Sequence
  Description of Artificial Sequence: Synthetic coding sequence
atgggcaaccacacctgggagggctgccacgtggacagccgggtggaccacctgttcccccccagcctgtacatcttcgtcatcggcgtgggcctgcccaccaactgcctggccctgtgggccgcctaccggcaggtgcagcagagaaatgagctgggcgtgtacctgatgaacctgagcattgctgacctgctgtacatctgcaccctgcccctgtgggtggactacttcctgcaccacgacaactggattcatggccctggcagctgcaagctgtttggcttcatcttctacaccaacatctacatcagcatcgccttcctgtgctgcatctctgtggaccgctacctggccgtggcccaccccctgcgctttgcccggctgcggcgggtgaagacagctgtggccgtgtcctctgtggtgtgggccacagagctgggcgccaacagcgcccccctcttccatgatgagctgttccgggaccgctacaaccacaccttctgctttgagaagttccccatggagggctgggtggcctggatgaacctgtacagagtgtttgtgggcttcctgttcccctgggccctgatgctgctgagctaccggggcatcctgcgggctgtgcggggctctgtgtccacagagcggcaggagaaggccaagatcaagaggctggccctgagcctcatcgccatcgtgctggtgtgctttgccccctaccacgtgctgctgctgagccgcagcgccatctacctgggccggccctgggactgtggctttgaggagagggtcttcagcgcctaccacagcagcctggccttcaccagcctgaactgtgtggccgaccccatcctgtactgcctggtgaatgaaggagcccggagtgatgtggccaaggccctgcacaacctgctgcgcttcctggccagtgacaagccccaggagatggccaatgccagcctgaccctggagacccccctgaccagcaagaggaacagcacagccaaggccatgacaggctcctgggccgccaccccacccagccagggcgaccaggtgcagctgaagatgctgcccccagcccagtag

SEQ ID NO: 153250 - DNA, 1041 bp, Artificial Sequence
  Description of Artificial Sequence: Synthetic coding sequence
atggacaccggccctgaccagagctacttcagcggcaaccactggtttgtgttttctgtgtacctgctgaccttcctggtgggcctgcccctgaacctgctggccctggtggtgtttgtgggcaagctgcgctgcaggcctgtggccgtggatgtgctgctgctgaacctgacagccagtgacctgctgctgctgctcttcctgcccttcaggatggtggaggccgccaacggcatgcactggcccctgcccttcatcctgtgccccctgagcggcttcatcttcttcaccaccatctacctgacagccctcttcctggccgctgtgtccattgagcgcttcctgtctgtggcccaccccctgtggtacaagacccggccccggctgggccaggccggcctggtgtctgtggcctgctggctgctggccagcgcccactgcagcgtggtgtatgtgattgagttcagcggggacatcagccacagccagggcaccaacggcacctgctacctggagttctggaaggaccagctggccatcctgctgcctgtgcggctggagatggctgtggtgctgtttgtggtgcccctcatcatcaccagctactgctacagccggctggtgtggatcctgggccggggcggcagccaccggcggcagaggagagtggccggcctggtggccgccaccctgctgaacttcctggtgtgcttcggcccctacaacgtgagccacgtggtgggctacatctgtggggagagccctgtgtggaggatctacgtgaccctgctgagcaccctgaacagctgtgtggacccctttgtgtactacttcagcagcagcggcttccaggccgacttccacgagctgctgcggcggctgtgtggcctgtggggccagtggcagcaggagagctccatggagctgaaggagcagaagggcggggaggagcagagagctgacaggcctgctgagaggaagaccagcgagcacagccagggctgcggcactggaggccaggtggcctgtgctgaaaattag

SEQ ID NO: 153251 - DNA, 1119 bp, Artificial Sequence
  Description of Artificial Sequence: Synthetic coding sequence
atggcctgcaacagcaccagcctggaggcctacacctacctgctgctgaacaccagcaatgccagtgacagcggcagcacccagctgcctgcccccctgcgcatcagcctggccatcgtgatgctgctgatgacagtggtgggcttcctgggcaacacagtggtgtgcatcatcgtgtaccagaggcctgccatgaggtctgccatcaacctgctgctggccaccctggccttcagtgacatcatgctgagcctgtgctgcatgcccttcaccgctgtgaccctcatcaccgtgcgctggcactttggagaccacttctgccgcctgagcgccaccctgtactggttctttgtgctggagggcgtggccatcctgctgatcatctctgtggaccgcttcctgatcatcgtgcagaggcaggacaagctgaacccccggcgggccaaggtgatcatcgctgtgtcctgggtgctgtccttctgcatcgccggccccagcctgaccggctggaccctggtggaggtgcctgcccgggccccccagtgtgtgctgggctacacagagctgcctgctgaccgggcctacgtggtgaccctggtggtggccgtgttctttgcccccttcggcgtgatgctgtgtgcctacatgtgcatcctgaacacagtgaggaagaatgctgtgcgggtgcacaaccagagcgacagcctggacctgcggcagctgacccgggccggcctgcggcggctgcagaggcagcagcaggtgtctgtggacctgtccttcaagaccaaggccttcaccaccatcctgatcctgtttgtgggcttcagcctgtgctggctgccccacagcgtgtacagcctgctgagcgtcttcagccagcgcttctactgcggcagcagcttctacgccaccagcacctgtgtgctgtggctgagctacctgaagtctgtgttcaaccccatcgtgtactgctggaggatcaagaagttccgggaggcctgcatcgagctgctgccccagaccttccagatcctgcccaaggtgcctgagcgcatcagaagacgcatccagcccagcacagtgtatgtgtgcaatgaaaaccagagcgctgtgtag

SEQ ID NO: 153252 - DNA, 837 bp, Artificial Sequence
  Description of Artificial Sequence: Synthetic coding sequence
atgtctgcccctggcagcccagaccaggcctatgacttcctgctgaagttcctgctggtgggggacagagatgtgggcaagtctgagatcctggagagcctgcaggacggcacagctgagagcccctacagccacctgggcggcatcgactacaagaccaccaccatcctgctggatggccagagggtgaagctgaagctgtgggacaccagcggccagggccgcttctgcaccatcttccgcagctacagcagaggagcccagggcgtcatcctggtgtatgacatcgccaaccgctggagctttgagggcatggaccgctggatcaagaagattgaggagcacgcccctggggtgcccaagatcctggtgggcaaccggctgcacctggccttcaagaggcaggtgccccgggagcaggcccaggcctatgcagagcggctgggcgtgaccttctttgaggtgagccccctgtgcaacttcaacatcatcgagagcttcacagagctggccagaattgtgctgctgcggcaccggctgaactggctgggccggcccagcaaggtgctgagcctgcaggacctgtgctgcaggaccatcgtgtcctgcacccctgtgcacctggtggacaagctgcccctgcccatcgccctgcggagccacctgaagagcttctccatggccaagggcctgaatgccaggatgatgaggggcctgagctacagcctgaccaccagcagcacccacaagaggagcagcctgtgcaaggtgaagatcgtgtgccccccccagagcccccccaagaactgcaccaggaacagctgcaagatctcctag

SEQ ID NO: 153253 - DNA, 585 bp, Artificial Sequence
  Description of Artificial Sequence: Synthetic coding sequence
atggtgatcctggccgtgaccaagaacaagaagctgagaaattctggcaacatctttgtggtgtccctgtctgtggccgacatgctggtggccatctacccctaccccctgatgctgcacgccatgagcatcggcggctgggacctgagccagctgcagtgccagatggtgggcttcatcaccggcctgtctgtggtgggcagcatcttcaacatcgtggccatcgccatcaaccgctactgctacatctgccacagcctgcagtatgagcgcatcttctctgtgaggaacacctgcatctacctggtgatcacctggatcatgacagtgctggccgtgctgcccaacatgtacatcggcaccatcgagtatgaccccaggacctacacctgcatcttcaactacctgaacaaccctgtgttcaccgtgaccatcgtgtgcatccactttgtgctgcccctgctgattgtgggcttctgctacgtgcgcatctggaccaaggtgctggccgcccgggaccctgctggccagaacccagacaaccagctggccgagcccaccagcacagctgccagcaccctgtag

SEQ ID NO: 153254 - DNA, 1086 bp, Artificial Sequence
  Description of Artificial Sequence: Synthetic coding sequence
atgaatgaaagccgctggacagagtggaggatcctgaacatgagcagcggcatcgtgaatgtgtctgagcggcacagctgccccctgggcttcggccactacagcgtggtggatgtgtgcatctttgagaccgtggtgattgtgctgctgaccttcctgatcatcgccggcaacctgaccgtcatctttgtgttccactgtgcccccctgctgcaccactacaccaccagctacttcatccagaccatggcctatgctgacctgtttgtgggcgtgtcctgcctggtgcccaccctgagcctgctgcactacagcactggagtgcatgagagcctgacctgccaggtgtttggctacatcatctctgtgctgaagtctgtgtccatggcctgcctggcctgcatctctgtggaccgctacctggccatcaccaagcccctgagctacaaccagctggtgaccccctgccgcctgcgcatctgcatcatcctgatctggatctacagctgcctgatcttcctgcccagcttcttcggctggggcaagccaggctaccacggggacatctttgagtggtgtgccacctcctggctgaccagcgcctacttcaccggcttcatcgtgtgcctgctgtatgccccagctgcctttgtggtgtgcttcacctacttccacatcttcaagatctgccggcagcacaccaaggagatcaatgaccggcgggcccgcttccccagccatgaggtggacagcagccgggagaccggccacagcccagacagaagatatgccatggtgctcttccgcatcaccagcgtcttctacatgctgtggctgccctacatcatctacttcctgctggagagcagccgggtgctggacaaccccaccctgtccttcctgaccacctggctggccatcagcaacagcttctgcaactgtgtgatctacagcctgagcaacagcgtcttccggctgggcctgcggcggctgtctgagaccatgtgcaccagctgcatgtgtgtgaaggaccaggaggcccaggagcccaagcccaggaagagggccaacagctgcagcatctag

SEQ ID NO: 153255 - DNA, 960 bp, Artificial Sequence
  Description of Artificial Sequence: Synthetic coding sequence
atgagccagcagaacaccagcggggactgcctgtttgatggagtgaatgagctgatgaagaccctgcagtttgctgtgcacatccccacctttgtgctgggcctgctgctgaacctgctggccatccacggcttcagcaccttcctgaagaaccgctggccagactatgctgccaccagcatctacatgatcaacctggccgtgtttgacctgctgctggtgctgagcctgcccttcaagatggtgctgagccaggtgcagagccccttccccagcctgtgcaccctggtggagtgcctgtactttgtgtccatgtatggcagcgtcttcaccatctgcttcatctccatggaccgcttcctggccatccgctaccccctgctggtgagccacctgcggagccccaggaagatcttcggcatctgctgcaccatctgggtgctggtgtggacaggcagcatccccatctacagcttccacggcaaggtggagaagtacatgtgcttccacaacatgtctgatgacacctggagcgccaaggtgttcttccccctggaggtgtttggcttcctgctgcccatgggcatcatgggcttctgctgcagccgcagcatccacatcctgctgggcagaagagaccacacccaggactgggtgcagcagaaggcctgcatctacagcattgctgccagcctggccgtgtttgtggtgtccttcctgcctgtgcacctgggcttcttcctgcagttcctggtgagaaattccttcatcgtggagtgccgggccaagcagagcatctccttcttcctgcagctgtccatgtgcttcagcaatgtgaactgctgcctggatgtgttctgctactacttcgtcatcaaggagttcaggatgaacatccgggcccaccggcccagccgggtgcagctggtgctgcaggacaccaccatcagccggggctag

SEQ ID NO: 153256 - DNA, 960 bp, Artificial Sequence; identical to SEQ ID NO: 153255
  Description of Artificial Sequence: Synthetic coding sequence

SEQ ID NO: 153257 - DNA, 729 bp, Artificial Sequence
  Description of Artificial Sequence: Synthetic coding sequence
atgagccagcagaacaccagcggggactgcctgtttgatggagtgaatgagctgatgaagaccctgcagtttgctgtgcacatccccacctttgtgctgggcctgctgctgaacctgctggccatccacggcttcagcaccttcctgaagaaccgctggccagactatgctgccaccagcatctacatgatcaacctggccgtgtttgacctgctgctggtgctgagcctgcccttcaagatggtgctgagccaggtgcagagccccttccccagcctgtgcaccctggtggagtgcctgtactttgtgtccatgtatggcagcgtcttcaccatctgcttcatctccatggaccgcttcctggccatccgctaccccctgctggtgagccacctgcggagccccaggaagatcttcggcatctgctgcaccatctgggtgctggtgtggacaggcagcatccccatctacagcttccacggcaaggtggagaagtacatgtgcttccacaacatgtctgatgacacctggagcgccaaggtgttcttccccctggaggtgtttggcttcctgctgcccatgggcatcatgggcttctgctgcagccgcagcatccacatcctgctgggcagaagagaccacacccaggactgggtgcagcagaaggcctgcatctacagcattgctgccagcctggccgtgtttgtggtgtccttcctgcctgtgtag

SEQ ID NO: 153258 - DNA, 960 bp, Artificial Sequence; identical to SEQ ID NO: 153255
  Description of Artificial Sequence: Synthetic coding sequence

SEQ ID NO: 153259 - DNA, 1572 bp, Artificial Sequence
  Description of Artificial Sequence: Synthetic coding sequence
atgaccccccagagcctgctgcagaccaccctcttcctgctgagcctgctcttcctggtgcagggcgcccacggccggggccaccgggaggacttccgcttctgcagccagcagctgcagagcctggagagcaagctgacctctgtgcgcttcatgggagacatggtgtcctttgaggaggaccgcatcaatgccaccgtgtggaagctgcagcccacagctggcctgcaggacctgcacatccacagccggcaggaggaggagcagagcgagatcatggagtacagcgtgctgctgcccaggaccctcttccagaggaccaagggccgctctggagaggccgagaagaggctgctgctggtggacttcagcagccaggccctcttccaggacaagaacagcagccaggtgctgggggagaaggtgctgggcatcgtggtgcagaacaccaaggtggccaacctgacagagcctgtggtgctgaccttccagcaccagctgcagcccaagaatgtgaccctgcagtgtgtgttctgggtggaggaccccaccctgagcagccctggccactggagcagcgctggctgtgagaccgtgcggcgggagacccagaccagctgcttctgcaaccacctgacctactttgctgtgctgatggtgtcctctgtggaggtggatgctgtgcacaagcactacctgagcctgctgtcctatgtgggctgtgtggtgtctgccctggcctgcctggtgaccatcgccgcctacctgtgcagccgggtgcccctgccctgcaggaggaagccccgggactacaccatcaaggtgcacatgaacctgctgctggccgtgttcctgctggacaccagcttcctgctgtctgagcctgtggccctgactggaagtgaagctggctgccgggccagcgccatcttcctgcacttcagcctgctgacctgcctgtcctggatgggcctggagggctacaacctgtaccgcctggtggtggaggtgtttggcacctacgtgcccggctacctgctgaagctgagcgccatgggctggggcttccccatcttcctggtgaccctggtggccctggtggatgtggacaactacggccccatcatcctggccgtgcacaggaccccagagggcgtcatctaccccagcatgtgctggatccgggacagcctggtgtcctacatcaccaacctgggcctcttcagcctggtgttcctgttcaacatggccatgctggccaccatggtggtgcagatcctgcggctgcggccccacacccagaagtggagccacgtgctgaccctgctgggcctgagcctggtgctgggcctgccctgggccctgatcttcttctcctttgccagcggcaccttccagctggtggtgctgtacctgttcagcatcatcaccagcttccagggcttcctgatcttcatctggtactggagcatgaggctgcaggcccggggcggccccagccccctgaagagcaacagcgacagcgcccggctgcccatcagcagcggcagcaccagcagcagccgcatctag

SEQ ID NO: 153260 - DNA, 2082 bp, Artificial Sequence
  Description of Artificial Sequence: Synthetic coding sequence
atgaccccccagagcctgctgcagaccaccctcttcctgctgagcctgctcttcctggtgcagggcgcccacggccggggccaccgggaggacttccgcttctgcagccagaggaaccagacccacaggagcagcctgcactacaagcccaccccagacctgcgcatcagcattgaaaattctgaggaggccctgactgtgcacgcccccttccctgctgcccacccagccagccgctccttcccagacccccggggcctgtaccacttctgcctgtactggaacagacatgctggccgcctgcacctgctgtatggcaagagggacttcctgctgagtgacaaggccagcagcctgctgtgcttccagcaccaggaggagagcctggcccagggcccccccctgctggccacctctgtgacctcctggtggagcccccagaacatcagcctgcccagcgctgccagcttcaccttctccttccacagccccccccacacagctgcccacaatgcctctgtggacatgtgtgagctgaagagggacctgcagctgctgagccagttcctgaagcacccccagaaggccagccggcggcccagcgctgccccagccagccagcagctgcagagcctggagagcaagctgacctctgtgcgcttcatgggagacatggtgtcctttgaggaggaccgcatcaatgccaccgtgtggaagctgcagcccacagctggcctgcaggacctgcacatccacagccggcaggaggaggagcagagcgagatcatggagtacagcgtgctgctgcccaggaccctcttccagaggaccaagggccgctctggagaggccgagaagaggctgctgctggtggacttcagcagccaggccctcttccaggacaagaacagcagccaggtgctgggggagaaggtgctgggcatcgtggtgcagaacaccaaggtggccaacctgacagagcctgtggtgctgaccttccagcaccagctgcagcccaagaatgtgaccctgcagtgtgtgttctgggtggaggaccccaccctgagcagccctggccactggagcagcgctggctgtgagaccgtgcggcgggagacccagaccagctgcttctgcaaccacctgacctactttgctgtgctgatggtgtcctctgtggaggtggatgctgtgcacaagcactacctgagcctgctgtcctatgtgggctgtgtggtgtctgccctggcctgcctggtgaccatcgccgcctacctgtgcagccgggtgcccctgccctgcaggaggaagccccgggactacaccatcaaggtgcacatgaacctgctgctggccgtgttcctgctggacaccagcttcctgctgtctgagcctgtggccctgactggaagtgaagctggctgccgggccagcgccatcttcctgcacttcagcctgctgacctgcctgtcctggatgggcctggagggctacaacctgtaccgcctggtggtggaggtgtttggcacctacgtgcccggctacctgctgaagctgagcgccatgggctggggcttccccatcttcctggtgaccctggtggccctggtggatgtggacaactacggccccatcatcctggccgtgcacaggaccccagagggcgtcatctaccccagcatgtgctggatccgggacagcctggtgtcctacatcaccaacctgggcctcttcagcctggtgttcctgttcaacatggccatgctggccaccatggtggtgcagatcctgcggctgcggccccacacccagaagtggagccacgtgctgaccctgctgggcctgagcctggtgctgggcctgccctgggccctgatcttcttctcctttgccagcggcaccttccagctggtggtgctgtacctgttcagcatcatcaccagcttccagggcttcctgatcttcatctggtactggagcatgaggctgcaggcccggggcggccccagccccctgaagagcaacagcgacagcgcccggctgcccatcagcagcggcagcaccagcagcagccgcatctag

SEQ ID NO: 153261 - DNA, 2082 bp, Artificial Sequence; identical to SEQ ID NO: 153260
  Description of Artificial Sequence: Synthetic coding sequence

SEQ ID NO: 153262 - DNA, 2064 bp, Artificial Sequence
  Description of Artificial Sequence: Synthetic coding sequence
atgaccccccagagcctgctgcagaccaccctcttcctgctgagcctgctcttcctggtgcagggcgcccacggccggggccaccgggaggacttccgcttctgcagccagaggaaccagacccacaggagcagcctgcactacaagcccaccccagacctgcgcatcagcattgaaaattctgaggaggccctgactgtgcacgcccccttccctgctgcccacccagccagccgctccttcccagacccccggggcctgtaccacttctgcctgtactggaacagacatgctggccgcctgcacctgctgtatggcaagagggacttcctgctgagtgacaaggccagcagcctgctgtgcttccagcaccaggaggagagcctggcccagggcccccccctgctggccacctctgtgacctcctggtggagcccccagaacatcagcctgcccagcgctgccagcttcaccttctccttccacagccccccccacacagctgcccacaatgcctctgtggacatgtgtgagctgaagagggacctgcagctgctgagccagttcctgaagcacccccagaaggccagccggcggcccagcgctgccccagccagccagcagctgcagagcctggagagcaagctgacctctgtgcgcttcatgggagacatggtgtcctttgaggaggaccgcatcaatgccaccgtgtggaagctgcagcccacagctggcctgcaggacctgcacatccacagccggcaggaggaggagcagagcgagatcatggagtacagcgtgctgctgcccaggaccctcttccagaggaccaagggccgctctggagaggccgagaagaggctgctgctggtggacttcagcagccaggccctcttccaggacaagaacagcagccaggtgctgggggagaaggtgctgggcatcgtggtgcagaacaccaaggtggccaacctgacagagcctgtggtgctgaccttccagcaccagctgcagcccaagaatgtgaccctgcagtgtgtgttctgggtggaggaccccaccctgagcagccctggccactggagcagcgctggctgtgagaccgtgcggcgggagacccagaccagctgcttctgcaaccacctgacctactttgctgtgctgatggtgtcctctgtggaggtggatgctgtgcacaagcactacctgagcctgctgtcctatgtgggctgtgtggtgtctgccctggcctgcctggtgaccatcgccgcctacctgtgcagcaggaggaagccccgggactacaccatcaaggtgcacatgaacctgctgctggccgtgttcctgctggacaccagcttcctgctgtctgagcctgtggccctgactggaagtgaagctggctgccgggccagcgccatcttcctgcacttcagcctgctgacctgcctgtcctggatgggcctggagggctacaacctgtaccgcctggtggtggaggtgtttggcacctacgtgcccggctacctgctgaagctgagcgccatgggctggggcttccccatcttcctggtgaccctggtggccctggtggatgtggacaactacggccccatcatcctggccgtgcacaggaccccagagggcgtcatctaccccagcatgtgctggatccgggacagcctggtgtcctacatcaccaacctgggcctcttcagcctggtgttcctgttcaacatggccatgctggccaccatggtggtgcagatcctgcggctgcggccccacacccagaagtggagccacgtgctgaccctgctgggcctgagcctggtgctgggcctgccctgggccctgatcttcttctcctttgccagcggcaccttccagctggtggtgctgtacctgttcagcatcatcaccagcttccagggcttcctgatcttcatctggtactggagcatgaggctgcaggcccggggcggccccagccccctgaagagcaacagcgacagcgcccggctgcccatcagcagcggcagcaccagcagcagccgcatctag

SEQ ID NO: 153263 - DNA, 2082 bp, Artificial Sequence; identical to SEQ ID NO: 153260
  Description of Artificial Sequence: Synthetic coding sequence

SEQ ID NO: 153264 - DNA, 2064 bp, Artificial Sequence; identical to SEQ ID NO: 153262
  Description of Artificial Sequence: Synthetic coding sequence

SEQ ID NO: 153265 - DNA, 2064 bp, Artificial Sequence; identical to SEQ ID NO: 153262
  Description of Artificial Sequence: Synthetic coding sequence

SEQ ID NO: 153266 - DNA, 1539 bp, Artificial Sequence
  Description of Artificial Sequence: Synthetic coding sequence
atgtgtgagctgaagagggacctgcagctgctgagccagttcctgaagcacccccagaaggccagcagaagacccagcgctgccccagccagccagcagctgcagagcctggagagcaagctgacctctgtgcgcttcatgggagacatggtgtcctttgaagaagatcgcatcaatgccaccgtgtggaagctgcagcccacagctggcctgcaggacctgcacatccacagccggcaggaggaggagcagagcgagatcatggagtacagcgtgctgctgcccaggaccctcttccagaggaccaagggccgcagcggggaggccgagaagaggctgctgctggtggacttcagcagccaggccctcttccaggacaagaacagcagccaggtgctgggggagaaggtgctgggcatcgtggtgcagaacaccaaggtggccaacctgacagagcctgtggtgctgaccttccagcaccagctgcagcccaagaatgtgaccctgcagtgtgtgttctgggtggaggaccccaccctgagcagccctggccactggagcagcgctggctgtgaaacagtgagaagagagacccagaccagctgcttctgcaaccacctgacctactttgctgtgctgatggtgtcctctgtggaggtggatgctgtgcacaagcactacctgagcctgctgtcctatgtgggctgtgtggtgtctgccctggcctgcctggtgaccatcgccgcctacctgtgcagcaggaggaagccccgggactacaccatcaaggtgcacatgaacctgctgctggccgtgttcctgctggacaccagcttcctgctgtctgagcctgtggccctgaccggcagcgaggccggctgccgggccagcgccatcttcctgcacttcagcctgctgacctgcctgtcctggatgggcctggagggctacaacctgtaccgcctggtggtggaggtgtttggcacctacgtgcccggctacctgctgaagctgagcgccatgggctggggcttccccatcttcctggtgaccctggtggccctggtggatgtggacaactacggccccatcatcctggccgtgcacaggaccccagagggcgtcatctaccccagcatgtgctggatccgggacagcctggtgtcctacatcaccaacctgggcctcttcagcctggtgttcctgttcaacatggccatgctggccaccatggtggtgcagatcctgcggctgcggccccacacccagaagtggagccacgtgctgaccctgctgggcctgagcctggtgctgggcctgccctgggccctgatcttcttctcctttgccagcggcaccttccagctggtggtgctgtacctgttcagcatcatcaccagcttccagggcttcctgatcttcatctggtactggagcatgaggctgcaggcccggggcggccccagccccctgaagagcaacagcgacagcgcccggctgcccatcagcagcggcagcaccagcagcagccgcatctag

SEQ ID NO: 153267 - DNA, 2064 bp, Artificial Sequence; identical to SEQ ID NO: 153262
  Description of Artificial Sequence: Synthetic coding sequence

SEQ ID NO: 153268 - DNA, 2064 bp, Artificial Sequence; identical to SEQ ID NO: 153262
  Description of Artificial Sequence: Synthetic coding sequence

SEQ ID NO: 153269 - DNA, 1089 bp, Artificial Sequence
  Description of Artificial Sequence: Synthetic coding sequence
atgaatgccagcgctgccagcctgaatgacagccaggtggtggtggtggccgctgagggcgctgctgctgctgccacagctgctgggggccctgacacaggagagtggggccccccagctgctgctgccctgggcgctgggggcggggccaacggcagcctggagctgagcagccagctgtctgctggccccccaggcctgctgctgcctgctgtgaacccctgggatgtgctgctgtgtgtgtctggcaccgtgattgctggagaaaatgccctggtggtggccctgattgccagcaccccagccctgcggacccccatgtttgtgctggtgggcagcctggccacagctgacctgctggccggctgcggcctcatcctgcactttgtgttccagtacctggtgcccagcgagaccgtgtccctgctgactgtgggcttcctggtggccagctttgctgcctctgtgagcagcctgctggccatcaccgtggaccgctacctgagcctgtacaatgccctgacctactacagcaggaggaccctgctgggcgtgcacctgctgctggccgccacctggacagtgtccctgggcctgggcctgctgcctgtgctgggctggaactgcctggccgagcgggccgcctgcagcgtggtgcggcccctggcccggagccacgtggccctgctgtctgctgccttcttcatggtgtttggcatcatgctgcacctgtatgtgcgcatctgccaggtggtgtggaggcatgcccaccagatcgccctgcagcagcactgcctggccccaccccacctggccgccaccaggaagggcgtgggcaccctggccgtggtgctgggcaccttcggggcctcctggctgccctttgccatctactgtgtggtgggcagccatgaagatcctgctgtgtacacctacgccaccctgctgcctgccacctacaacagcatgatcaaccccatcatctatgccttcaggaaccaggagatccagagggccctgtggctgctgctgtgtggctgcttccagagcaaggtgcccttccgcagccgcagccccagcgaggtgtag

SEQ ID NO: 153270 - DNA, 1134 bp, Artificial Sequence
  Description of Artificial Sequence: Synthetic coding sequence
atgaccctgctggcctggtgcaccaggggggccaacccagctgccatgaatgccagcgctgccagcctgaatgacagccaggtggtggtggtggccgctgagggcgctgctgctgctgccacagctgctgggggccctgacaccggggagtggggccccccagctgctgctgccctgggcgccggcggcggggccaacggcagcctggagctgagcagccagctgtctgctggccccccaggcctgctgctgcctgctgtgaacccctgggatgtgctgctgtgtgtgtctggaacagtgattgctggggagaatgccctggtggtggccctgattgccagcaccccagccctgcggacccccatgtttgtgctggtgggcagcctggccacagctgacctgctggccggctgcggcctcatcctgcactttgtgttccagtacctggtgcccagcgagaccgtgtccctgctgactgtgggcttcctggtggccagctttgctgcctctgtgagcagcctgctggccatcaccgtggaccgctacctgagcctgtacaatgccctgacctactacagcaggaggaccctgctgggcgtgcacctgctgctggccgccacctggacagtgtccctgggcctgggcctgctgcctgtgctgggctggaactgcctggccgagagagctgcctgcagcgtggtgcggcccctggcccggagccacgtggccctgctgtctgctgccttcttcatggtgtttggcatcatgctgcacctgtatgtgcgcatctgccaggtggtgtggaggcatgcccaccagatcgccctgcagcagcactgcctggccccaccccacctggccgccaccaggaaaggagtgggcaccctggccgtggtgctgggcacctttggagcctcctggctgccctttgccatctactgtgtggtgggcagccatgaggaccctgctgtgtacacctacgccaccctgctgcctgccacctacaacagcatgatcaaccccatcatctatgccttcaggaaccaggagatccagagggccctgtggctgctgctgtgtggctgcttccagagcaaggtgcccttccgcagccgcagccccagcgaggtgtag

SEQ ID NO: 153271 - DNA, 1023 bp, Artificial Sequence
  Description of Artificial Sequence: Synthetic coding sequence
atgaatgccagcgctgccagcctgaatgacagccaggtggtggtggtggccgctgagggcgctgctgctgctgccacagctgctgggggccctgacacaggagagtggggccccccagctgctgctgccctgggcgctgggggcggggccaacggcagcctggagctgagcagccagctgtctgctggccccccaggcctgctgctgcctgctgtgaacccctgggatgtgctgctgtgtgtgtctggcaccgtgattgctggagaaaatgccctggtggtggccctgattgccagcaccccagccctgcggacccccatgtttgtgctggtgggcagcctggccacagctgacctgctggccggctgcggcctcatcctgcactttgtgttccagtacctggtgcccagcgagaccgtgtccctgctgactgtgggcttcctggtggccagctttgctgcctctgtgagcagcctgctggccatcaccgtggaccgctacctgagcctgtacaatgccctgacctactacagcaggaggaccctgctgggcgtgcacctgctgctggccgccacctggacagtgtccctgggcctgggcctgctgcctgtgctgggctggaactgcctggccgagcgggccgcctgcagcgtggtgcggcccctggcccggagccacgtggccctgctgtctgctgccttcttcatggtgtttggcatcatgctgcacctgtatgtgcgcatctgccaggtggtgtggaggcatgcccaccagatcgccctgcagcagcactgcctggccccaccccacctggccgccaccaggaagggcgtgggcaccctggccgtggtgctgggcaccttcggggcctcctggctgccctttgccacctacaacagcatgatcaaccccatcatctatgccttcaggaaccaggagatccagagggccctgtggctgctgctgtgtggctgcttccagagcaaggtgcccttccgcagccgcagccccagcgaggtgtag

SEQ ID NO: 153272 - DNA, 1740 bp, Artificial Sequence
  Description of Artificial Sequence: Synthetic coding sequence
aacccccggctgactgtgctggagcgggtggagggctatggagagcaggagtggcagaagggagatggcaagggccgcggggagggccacagcgagagcggcgtgctgagcggcagcggcagctgcaccagccacgtgtcctgcttcctggccgtgaccaaggctgaccctgctgccaccagcggccagaagggagatgagctgctgatcctgcagctgcccggcctggccctgtgcacccagaccaacctgcccaagaggctgcagtgggaggtgccccccaccaagccaggcagcctgggcctgggcagccccagccagggccgctggaccaggatgggagatggcccccaggaggtgccctgggtgcccagctttggccccatggagagcagccccatcccccagagcagcggcaacagcagcaccctgggccgggtgccccagaccccaggccccagcacagccagcggcgtgcctgaggtgggcctgagagatgtggccagcgagagcgtggccctcttcttcatgctgctgctggacctgacagctgtggccggaaatgctgctgtgatggctgtgattgccaagaccccagccctgaggaagtttgtgtttgtgttccacctgtgcctggtggacctgctggccgccctgaccctgatgcccctggccatgctgagcagcagcgccctgtttgaccacgccctgtttggagaggtggcctgccgcctgtacctgttcctgtctgtgtgctttgtgtccctggccatcctgtctgtgtctgccatcaacgtggagcgctactactacgtggtgcaccccatgagatatgaggtgaggatgaccctgggcctggtggcctctgtgctggtgggcgtgtgggtgaaggccctggccatggcctctgtgcctgtgctgggccgggtgtcctgggaggagggcgcccccagcgtgcccccaggctgcagcctgcagtggagccacagcgcctactgccagctgtttgtggtggtgtttgctgtgctgtacttcctgctgcccctgctgctgatcctggtggtgtactgcagcatgttccgggtggcccgggtggccgccatgcagcacggccccctgcccacctggatggagaccccccggcagaggtctgagagcctgagcagccgcagcaccatggtgaccagcagcggggccccccagaccaccccccacaggaccttcggcggcggcaaggctgctgtggtgctgctggccgtgggcggccagttcctgctgtgctggctgccctacttctccttccacctgtatgtggccctgagcgcccagcccatcagcacaggccaggtggagagcgtggtgacctggattggctacttctgcttcaccagcaaccccttcttctacggctgcctgaaccggcagatccggggggagctgagcaagcagtttgtgtgcttcttcaagccagcccctgaggaggagctgcggctgcccagccgggagggcagcattgaggagaacttcctgcagttcctgcagggcaccggctgccccagcgagagctgggtgtcccggcccctgcccagccccaagcaggagcccccagctgtggacttccgcatccctggccagattgctgaggagaccagcgagttcctggagcagcagctgaccagtgacatcatcatgtctgacagctacctgcggcctgctgccagcccccggctggagagctag

SEQ ID NO: 153273 - DNA, 1356 bp, Artificial Sequence
  Description of Artificial Sequence: Synthetic coding sequence
atggagagcagccccatcccccagagcagcggcaacagcagcaccctgggccgggtgccccagaccccaggccccagcacagccagcggcgtgcctgaggtgggcctgagagatgtggccagcgagagcgtggccctcttcttcatgctgctgctggacctgacagctgtggccggaaatgctgctgtgatggctgtgattgccaagaccccagccctgaggaagtttgtgtttgtgttccacctgtgcctggtggacctgctggccgccctgaccctgatgcccctggccatgctgagcagcagcgccctgtttgaccacgccctgtttggagaggtggcctgccgcctgtacctgttcctgtctgtgtgctttgtgtccctggccatcctgtctgtgtctgccatcaacgtggagcgctactactacgtggtgcaccccatgagatatgaggtgaggatgaccctgggcctggtggcctctgtgctggtgggcgtgtgggtgaaggccctggccatggcctctgtgcctgtgctgggccgggtgtcctgggaggagggcgcccccagcgtgcccccaggctgcagcctgcagtggagccacagcgcctactgccagctgtttgtggtggtgtttgctgtgctgtacttcctgctgcccctgctgctgatcctggtggtgtactgcagcatgttccgggtggcccgggtggccgccatgcagcacggccccctgcccacctggatggagaccccccggcagaggtctgagagcctgagcagccgcagcaccatggtgaccagcagcggggccccccagaccaccccccacaggaccttcggcggcggcaaggctgctgtggtgctgctggccgtgggcggccagttcctgctgtgctggctgccctacttctccttccacctgtatgtggccctgagcgcccagcccatcagcacaggccaggtggagagcgtggtgacctggattggctacttctgcttcaccagcaaccccttcttctacggctgcctgaaccggcagatccggggggagctgagcaagcagtttgtgtgcttcttcaagccagcccctgaggaggagctgcggctgcccagccgggagggcagcattgaggagaacttcctgcagttcctgcagggcaccggctgccccagcgagagctgggtgtcccggcccctgcccagccccaagcaggagcccccagctgtggacttccgcatccctggccagattgctgaggagaccagcgagttcctggagcagcagctgaccagtgacatcatcatgtctgacagctacctgcggcctgctgccagcccccggctggagagctag

SEQ ID NO: 153274 - DNA, 1356 bp, Artificial Sequence; identical to SEQ ID NO: 153273
  Description of Artificial Sequence: Synthetic coding sequence

SEQ ID NO: 153275 - DNA, 1356 bp, Artificial Sequence; identical to SEQ ID NO: 153273
  Description of Artificial Sequence: Synthetic coding sequence

SEQ ID NO: 153276 - DNA, 1107 bp, Artificial Sequence
  Description of Artificial Sequence: Synthetic coding sequence
atggccaacagcacaggcctgaatgccagcgaggtggccggcagcctgggcctcatcctggccgctgtggtggaggtgggcgccctgctgggcaatggagccctgctggtggtggtgctgcggaccccaggcctgagagatgccctgtacctggcccacctgtgtgtggtggacctgctggccgccgccagcatcatgcccctgggcctgctggccgcccctcctcctggcctgggccgggtgcggctgggccctgccccctgccgggccgcccgcttcctgtctgctgccctgctgcctgcctgcaccctgggcgtggccgccctgggcctggcccgctaccgcctgattgtgcaccccctgcggcccggcagcaggcctcctcctgtgctggtgctgacagctgtgtgggccgccgccggcctgctgggcgccctgagcctgctgggcaccccaccagcccctcctccagccccagcccgctgcagcgtgctggccggcggcctgggccccttccggcccctgtgggccctgctggcctttgccctgcctgccctgctgctgctgggcgcctacggcggcatctttgtggtggcccggcgggccgccctgcggccccccaggcctgcccggggcagccggctgcacagcgacagcctggacagccggctgagcatcctgccccccctgcggccccggctgcccggcggcaaggccgccctggccccagccctggccgtgggccagtttgctgcctgctggctgccctacggctgtgcctgcctggccccagctgcccgggctgctgaggccgaggccgctgtgacctgggtggcctacagcgcctttgctgcccaccccttcctgtatggcctgctgcagaggcctgtgcggctggccctgggccgcctgagccggcgggccctgcccggccctgtgcgggcctgcaccccccaggcctggcacccccgggccctgctgcagtgcctgcagaggcctcctgagggccctgctgtgggccccagcgaggcccctgagcagaccccagagctggccggcggccgcagccctgcctaccagggccccccagagagcagcctgtcctag

SEQ ID NO: 153277 - DNA, 1434 bp, Artificial Sequence
  Description of Artificial Sequence: Synthetic coding sequence
atggccaacatgcagggcctggtggagcggctggagagagctgtgtcccggctggagagcctgtctgctgagagccaccggcccccaggcaactgtggggaggtgaatggagtgattgctggggtggcccccagcgtggaggcctttgacaagctgatggacagcatggtggccgagttcctgaagaacagccgcatcctggccggagatgtggagacccatgctgagatggtgcacagcgccttccaggcccagagggccttcctgctgatggccagccagtaccagcagccccatgaaaatgatgtggccgccctgctgaagcccatcagcgagaagatccaggagatccagaccttccgggagaggaacagaggcagcaacatgttcaaccacctgtctgctgtgtctgagagcatcccagccctgggctggattgctgtgagccccaagccaggcccctacgtgaaggagatgaatgatgctgccaccttctacaccaacagagtgctgaaggactacaagcacagcgacctgcggcacgtggactgggtgaagagctacctgaacatctggagcgagctgcaggcctacatcaaggagcaccacaccaccggcctgacctggagcaagacaggccctgtggccagcacagtgtctgccttctctgtgctgagcagcggccctggcctgcccccacctcctccacccctgcccccacctggccccccacccctgtttgaaaatgaaggcaagaaggaggagagcagccccagccgcagcgccctgtttgcccagctgaaccagggcgaggccatcaccaagggcctgcggcacgtgacagatgaccagaagacctacaagaaccccagcctgcgggcccagggcggccagacccagagccccaccaagagccacacccccagccccaccagccccaagagctaccccagccagaagcacgcccctgtgctggagctggagggcaagaagtggagggtggagtaccaggaggacagaaatgacctggtgatcagcgagacagagctgaagcaggtggcctacatcttcaagtgtgagaagagcaccatccagatcaagggcaaggtgaacagcatcatcatcgacaactgcaagaagctgggcctggtgtttgacaacgtggtgggcatcgtggaggtgatcaacagccaggacatccagatccaggtgatgggccgggtgcccaccatcagcatcaacaagacagagggctgccacatctacctgtctgaagatgccctggactgtgagatcgtgtctgccaagagcagcgagatgaacatcctgatcccccaggatggagactaccgggagttccccatccctgagcagttcaagacagcctgggatggcagcaagctgatcacagagcctgctgagatcatggcctag

SEQ ID NO: 153278 - DNA, 1260 bp, Artificial Sequence; identical to SEQ ID NO: 152154
  Description of Artificial Sequence: Synthetic coding sequence

SEQ ID NO: 153279 - DNA, 1260 bp, Artificial Sequence; identical to SEQ ID NO: 152154
  Description of Artificial Sequence: Synthetic coding sequence

SEQ ID NO: 153280 - DNA, 1332 bp, Artificial Sequence
  Description of Artificial Sequence: Synthetic coding sequence
tactgctgcagcgtgctgaagtgcctgaagaacagctgcatcagcgcctgcatcttccaccccacagagaccatggtgttttctgctgtgctgacagccttccacacaggcaccagcaacaccacctttgtggtgtatgagaacacctacatgaacatcaccctgcccccacccttccagcacccagacctgagccccctgctgcgctacagctttgagaccatggcccccaccggcctgagcagcctgactgtgaacagcacagctgtgcccaccaccccagctgccttcaagagcctgaacctgcccctgcagatcaccctgagcgccatcatgatcttcatcctgtttgtgtccttcctgggcaacctggtggtgtgcctgatggtgtaccagaaggccgccatgaggtctgccatcaacatcctgctggccagcctggcctttgctgacatgctgctggccgtgctgaacatgccctttgccctggtgaccatcctgaccacccgctggatctttgggaagttcttctgccgggtgtctgccatgttcttctggctgtttgtgattgagggcgtggccatcctgctgatcatcagcattgaccgcttcctgatcatcgtgcagaggcaggacaagctgaacccctaccgggccaaggtgctgattgctgtgtcctgggccaccagcttctgtgtggccttccccctggccgtgggcaacccagacctgcagatccccagccgggccccccagtgtgtgtttggctacaccaccaaccctggctaccaggcctacgtgatcctgatcagcctcatctccttcttcatccccttcctggtgatcctgtacagcttcatgggcatcctgaacaccctgcggcacaatgccctgcgcatccacagctacccagagggcatctgcctgagccaggccagcaagctgggcctgatgagcctgcagaggcccttccagatgagcattgacatgggcttcaagacccgggccttcaccaccatcctgatcctgtttgctgtgttcatcgtgtgctgggcccccttcaccacctacagcctggtggccaccttcagcaagcacttctactaccagcacaacttctttgagatcagcacctggctgctgtggctgtgctacctgaagagcgccctgaaccccctcatctactactggaggatcaagaagttccatgatgcctgcctggacatgatgcccaagagcttcaagttcctgccccagctgcccggccacaccaagaggcgcatccggcccagcgctgtgtatgtgtgtggggagcacaggacagtggtgtag

SEQ ID NO: 153281 - DNA, 2697 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccacctgaggtggagaccaccagcctgaatgatgtgaccctgagcctgctgcccagcaatgaaacaggagtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatccggcgggactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgtttattgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggccgagaacagcgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggcaagggccgcatggccctgcggaggaccagcaagaggggcagcctgcacttcatcgagcagatgtag

SEQ ID NO: 153282 - DNA, 3006 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagatgaggagactggagcctgcagtgatgtgaccctgagcctgctgcccagcaatgaaacagagaagaccaagatcaccatcgtgaagaccttcaatgccagcggcgtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153283 - DNA, 3012 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagccaagctgtctgtggtgtcctttgcccccagcagcaatggcaccccagaggtggagaccaccagcctgaatgatgtgaccctgagcctgctgcccagcaatgaaacaggagtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153284 - DNA, 2964 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccacctgaggtggagaccaccagcctgaatgatgtgaccctgagcctgctgcccagcaatgaaacaggagtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153285 - DNA, 3045 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagccaagctgtctgtggtgtcctttgcccccagcagcaatgaggtggagaccaccagcctgaatgatgtgaccctgagcctgctgcccagcaatgaaacagagaagaccaagatcaccatcgtgaagaccttcaatgccagcggcgtgaagccccagaggaacatctgcaacctgagcagcatctgcaatgacagcgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggcccctgagaacagcatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatccggcgggactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgtttattgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggccgagaacagcgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggcaagggccgcatggccctgcggaggaccagcaagaggggcagcctgcacttcatcgagcagatgtag

SEQ ID NO: 153286 - DNA, 2988 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagccaagctgtctgtggtgtcctttgcccccagcagcaatggcaccccagatgtgaccctgagcctgctgcccagcaatgaaacaggagtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153287 - DNA, 3054 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagccaagctgtctgtggtgtcctttgcccccagcagcaatggcaccccagaggtggagaccaccagcctgaatgatgtgaccctgagcctgctgcccagcaatgaaacagagaagaccaagatcaccatcgtgaagaccttcaatgccagcggcgtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153288 - DNA, 2901 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagccaagctgtctgtggtgtcctttgcccccagcagcaatggcaccccagaggtggagaccaccagcctgaatgatgtgaccctgagcctgctgcccagcaatgaaacagagaagaccaagatcaccatcgtgaagaccttcaatgccagcggcgtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctggaaatgccagcacagaaagaaatggagtgtccttctctgtgcagaatggagatgtgtgcctgcatgacttcaccgggaagcagcacatgtttaatgagaaggaggacagctgcaatggcaagggccgcatggccctgcggaggaccagcaagaggggcagcctgcacttcatcgagcagatgtag

SEQ ID NO: 153289 - DNA, 2982 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccaccagatgtgaccctgagcctgctgcccagcaatgaaacagagaagaccaagatcaccatcgtgaagaccttcaatgccagcggcgtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153290 - DNA, 3006 bp, Artificial Sequence
  Description of Artificial Sequence: Synthetic coding sequence
atggtgttttctgtgcggcagtgtggccacgtgggccgcacagaggaggtgctgctgaccttcaagatcttcctggtgatcatctgcctgcacgtggtgctggtgaccagcctggaggaggacacagacaacagcagcctgagccccccacctgaggtggagaccaccagcctgaatgatgtgaccctgagcctgctgcccagcaatgaaacagagaagaccaagatcaccatcgtgaagaccttcaatgccagcggcgtgaagccccagaggaacatctgcaacctgagcagcatctgcaatgattctgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagagcaccctgaactgcaccttcaccatcaagctgaacaacaccatgaatgcctgtgctgtgattgctgccctggagcgggtgaagatccggcccatggagcactgctgctgcagcgtgcgcatcccctgccccagcagccctgaggagctggagaagctgcagtgtgacctgcaggaccccatcgtgtgcctggccgaccacccccggggcccccccttcagcagcagccagagcatccctgtggtgccccgggccaccgtgctgagccaggtgcccaaggccaccagctttgctgagcccccagactacagccctgtgacccacaacgtgcccagccccatcggggagatccagcccctgagcccccagcccagcgcccccatcgccagcagccctgccatcgacatgccaccccagagcgagaccatcagcagccccatgccccagacccacgtgtctggcaccccacctcctgtgaaggccagcttcagcagccccaccgtgtctgccccagccaacgtgaacaccaccagcgcccctcctgtgcagacagacatcgtgaacaccagcagcatcagtgacctggagaaccaggtgctgcagatggagaaggccctgagcctgggcagcctggagcccaacctggccggggagatgatcaaccaggtgtcccggctgctgcacagccccccagacatgctggcccccctggcccagaggctgctgaaggtggtggatgacatcggcctgcagctgaacttcagcaacaccaccatcagcctgaccagccccagcctggccctggccgtcatccgggtgaatgccagcagcttcaacaccaccacctttgtggcccaggaccctgccaacctgcaggtgtccctggagacccaggccccagaaaattccatcggcaccatcaccctgcccagcagcctgatgaacaacctgcctgcccatgacatggagctggccagccgggtgcagttcaacttctttgagaccccagccctcttccaggaccccagcctggagaacctgagcctcatctcctatgtgatcagcagctctgtggccaacctgactgtgaggaacctgaccagaaatgtgacagtgaccctgaagcacatcaaccccagccaggatgagctgactgtgcgctgtgtgttctgggacctgggcagaaatggaggccggggcggctggagcgacaatggctgcagcgtgaaggaccggcggctgaatgagaccatctgcacctgcagccacctgaccagctttggagtgctgctggacctgagcaggacctctgtgctgcctgcccagatgatggccctgaccttcatcacctacatcggctgcggcctgagcagcatcttcctgtctgtgaccctggtgacctacatcgcctttgagaagatcagaagagactaccccagcaagatcctgatccagctgtgtgccgccctgctgctgctgaacctggtgttcctgctggacagctggatcgccctgtacaagatgcagggcctgtgcatctctgtggccgtgttcctgcactacttcctgctggtgtccttcacctggatgggcctggaggccttccacatgtacctggccctggtgaaggtgttcaacacctacatcaggaagtacatcctgaagttctgcatcgtgggctggggcgtgcctgctgtggtggtgaccatcatcctgaccatcagcccagacaactacggcctgggcagctatggcaagttccccaacggcagcccagatgacttctgctggatcaacaacaatgctgtgttctacatcaccgtggtgggctacttctgtgtgatcttcctgctgaatgtgtccatgttcatcgtggtgctggtgcagctgtgccgcatcaagaagaagaagcagctgggcgcccagaggaagaccagcatccaggacctgcggagcattgctggcctgaccttcctgctgggcatcacctggggctttgccttctttgcctggggccctgtgaatgtgaccttcatgtacctgtttgccatcttcaacaccctgcagggcttcttcatcttcatcttctactgtgtggccaaggaaaatgtgaggaagcagtggaggcgctacctgtgctgcggcaagctgcggctggctgaaaattctgactggagcaagacagccaccaacggcctgaagaagcagacagtgaaccagggcgtgagcagcagcagcaacagcctgcagagcagcagcaacagcaccaacagcaccaccctgctggtgaacaatgactgcagcgtgcacgccagcggaaatggaaatgccagcacagaaagaaatggagtgtccttctctgtgcagaatggagatgtgtgcctgcatgacttcaccgggaagcagcacatgtttaatgagaaggaggacagctgcaatggaaaaggaaggatggccctgcggaggaccagcaagaggggcagcctgcacttcatcgagcagatgtag

SEQ ID NO: 153291 - DNA, 354 bp, Artificial Sequence
  Description of Artificial Sequence: Synthetic coding sequence
atcctgctgaccatgcagcacatcaacacaggcatcgacatgctgaaccagctgggctgtgtgttctttgctggggtgaagccccagaggaacatctgcaacctgagcagcatctgcaatgacagcgccttcttccggggggagatcatgttccagtatgacaaggagagcacagtgccccagaaccagcacatcaccaacggcaccctgactggagtgctgagcctgtctgagctgaagaggtctgagctgaacaagaccctgcagaccctgtctgagacctacttcatcatgtgtgccacagctgaggcccagaggcacatcaagctgtacatccacaacaagacagaatag

SEQ ID NO: 153292 - DNA, 1014 bp, Artificial Sequence
  Description of Artificial Sequence: Synthetic coding sequence
atgaacagcacctgcatcgaggagcagcacgacctggaccactacctgttccccatcgtgtacatctttgtgatcatcgtgtccatcccagccaacatcggcagcctgtgtgtgtccttcctgcaggccaagaaggagagcgagctgggcatctacctgttcagcctgagcctgagtgacctgctgtatgccctgaccctgcccctgtggattgactacacctggaacaaggacaactggaccttcagccctgccctgtgcaagggcagcgccttcctgatgtacatgaacttctacagcagcacagccttcctgacctgcatcgctgtggaccgctacctggccgtggtgtaccccctgaagttcttcttcctgcggaccaggagatttgccctgatggtgtccctgagcatctggatcctggagaccatcttcaatgctgtgatgctgtgggaggatgaaacagtggtggagtactgtgatgctgagaagagcaacttcaccctgtgctatgacaagtaccccctggagaagtggcagatcaacctgaacctcttccgcacctgcaccggctacgccatccccctggtgaccatcctgatctgcaacaggaaggtgtaccaggccgtgcgccacaacaaggccacagagaacaaggagaagaagaggatcatcaagctgctggtgtccatcaccgtgacctttgtgctgtgcttcacccccttccacgtgatgctgctgatccgctgcatcctggagcacgctgtgaactttgaggaccacagcaacagcggcaagaggacctacaccatgtaccgcatcaccgtggccctgaccagcctgaactgtgtggccgaccccatcctgtactgctttgtgacagagaccggccgctatgacatgtggaacatcctgaagttctgcaccggccgctgcaacaccagccagaggcagaggaagaggatcctgtctgtgtccaccaaggacaccatggagctggaggtgctggagtag

SEQ ID NO: 153293 - DNA, 1623 bp, Artificial Sequence
  Description of Artificial Sequence: Synthetic coding sequence
atgaacagcacaggccacctgcaggatgccccaaatgccaccagcctgcacgtgccccacagccaggagggcaacagcaccagcctgcaggagggcctgcaggacctgatccacacagccaccctggtgacctgcaccttcctgctggccgtcatcttctgcctgggcagctatggcaacttcatcgtgttcctgtccttctttgatcctgccttcaggaagttccgcaccaactttgacttcatgatcctgaacctgtccttctgtgacctcttcatctgtggggtgacagcccccatgttcacctttgtgctcttcttcagcagcgccagcagcatcccagatgccttctgcttcaccttccacctgaccagcagcggcttcatcatcatgagcctgaagacagtggccgtgattgccctgcaccggctgaggatggtgctgggcaagcagcccaacagaacagccagcttcccctgcaccgtgctgctgaccctgctgctgtgggccaccagcttcaccctggccaccctggccaccctgaagaccagcaagagccacctgtgcctgcccatgagcagcctgattgctgggaagggcaaggccatcctgagcctgtatgtggtggacttcaccttctgtgtggccgtggtgtctgtgtcctacatcatgattgcccagaccctgaggaagaatgcccaggtgaggaaatgtcctcctgtgatcaccgtggatgccagccggccccagcccttcatgggcgtgcctgtgcagggcggcggggaccccatccagtgtgccatgcctgccctgtacagaaaccagaactacaacaagctgcagcacgtgcagacccggggctacaccaagagccccaaccagctggtgaccccagctgccagccggctgcagctggtgtctgccatcaacctgagcacagccaaggacagcaaggctgtggtgacctgtgtgatcatcgtgctgtctgtgctggtgtgctgcctgcccctgggcatcagcctggtgcaggtggtgctgagcagcaatggcagcttcatcctgtaccagtttgagctgtttggcttcaccctcatcttcttcaagagcggcctgaaccccttcatctacagcaggaacagcgctggcctgcggaggaaggtgctgtggtgcctgcagtacatcggcctgggcttcttctgctgcaagcagaagacccggctgcgggccatgggcaagggcaacctggaggtgaacagaaacaagagcagccaccacgagaccaacagcgcctacatgctgagccccaagccccagaagaagtttgtggaccaggcctgtggccccagccacagcaaggagagcatggtgagccccaagatctctgctggccaccagcactgcggccagagcagcagcacccccatcaacaccagaattgagccctactacagcatctacaacagcagccccagccaggaggagagcagcccctgcaacctgcagcctgtgaacagctttggatttgccaacagctacatcgccatgcactaccacaccaccaatgacctggtgcaggagtatgacagcaccagcgccaagcagatccctgtgcccagcgtgtag

SEQ ID NO: 153294 - DNA, 1092 bp, Artificial Sequence
  Description of Artificial Sequence: Synthetic coding sequence
atgggccctggagaggccctgctggccggcctgctggtgatggtgctggccgtggccctgctgagcaatgccctggtgctgctgtgctgtgcctacagcgctgagctgcggacccgggccagcggcgtgctgctggtgaacctgagcctgggccacctgctgctggccgccctggacatgcccttcaccctgctgggcgtgatgaggggccgcacccccagcgcccctggggcctgccaggtgattggcttcctggacaccttcctggccagcaatgctgccctgtctgtggccgccctgtctgctgaccagtggctggccgtgggcttccccctgcgctatgccggccgcctgcggcccaggtatgccggcctgctgctgggctgtgcctggggccagagcctggccttcagcggggccgccctgggctgctcctggctgggctacagcagcgcctttgccagctgcagcctgcggctgcccccagagcctgagcggcccaggtttgctgccttcaccgccaccctgcatgctgtgggctttgtgctgcccctggccgtgctgtgcctgaccagcctgcaggtgcaccgggtggcccggcggcactgccagaggatggacacagtgaccatgaaggccctggccctgctggccgacctgcaccccagcgtgcggcagcgctgcctgatccagcagaagagaagaagacaccgggccaccaggaagattggaattgccatcgccaccttcctgatctgctttgccccctacgtgatgacccggctggccgagctggtgccctttgtgacagtgaatgcccagtggggcatcctgagcaagtgcctgacctacagcaaggctgtggccgaccccttcacctacagcctgctgcggcggcccttccggcaggtgctggccggcatggtgcaccggctgctgaagaggacccccaggcctgccagcacccatgacagcagcctggatgtggccggcatggtgcaccagctgctgaagaggacccccaggcctgccagcacccacaacggctctgtggacacagaaaatgacagctgcctgcagcagacccactag

SEQ ID NO: 153295 - DNA, 1011 bp, Artificial Sequence
  Description of Artificial Sequence: Synthetic coding sequence
atgaacaacaacaccacctgcatccagcccagcatgatcagctccatggccctgcccatcatctacatcctgctgtgcatcgtgggcgtgtttggaaacaccctgagccagtggatcttcctgaccaagattggcaagaagaccagcacccacatctacctgagccacctggtgacagccaacctgctggtgtgcagcgccatgcccttcatgagcatctacttcctgaagggcttccagtgggagtaccagagcgcccagtgccgggtggtgaacttcctgggcaccctgtccatgcacgcctccatgtttgtgtccctgctgatcctgtcctggatcgccatcagccgctatgccaccctgatgcagaaggacagcagccaggagaccaccagctgctatgagaagatcttctacggccacctgctgaagaagttccggcagcccaactttgccaggaagctgtgcatctacatctggggcgtggtgctgggcatcatcatccctgtgacagtgtactacagcgtgattgaggccacagaaggagaggagagcctgtgctacaaccggcagatggagctgggcgccatgatcagccagattgctggcctgattggcaccaccttcatcggcttctccttcctggtggtgctgaccagctactacagctttgtgagccacctgaggaagatccgcacctgcaccagcatcatggagaaggacctgacctacagctctgtgaagaggcacctgctggtgatccagatcctgctgattgtgtgcttcctgccctacagcatcttcaagcccatcttctacgtgctgcaccagagggacaactgccagcagctgaactacctgattgagaccaagaacatcctgacctgcctggccagcgcccggagcagcacagaccccatcatcttcctgctgctggacaagaccttcaagaagaccctgtacaacctcttcaccaagagcaacagcgcccacatgcagagctatggatag

SEQ ID NO: 153296 - DNA, 1272 bp, Artificial Sequence
  Description of Artificial Sequence: Synthetic coding sequence
atggtgccccacctgctgctgctgtgcctgctgcccctggtgcgggccacagagccccatgagggccgggcagatgagcagagcgctgaggccgccctggccgtgcccaatgccagccacttcttctcctggaacaactacaccttcagtgactggcagaactttgtgggcagaagaagatatggagctgagagccagaaccccaccgtgaaggccctgctgattgtggcctacagcttcatcatcgtgttcagcctgtttggaaatgtgctggtgtgccacgtgatcttcaagaaccagaggatgcacagcgccaccagcctcttcatcgtgaacctggccgtggccgacatcatgatcaccctgctgaacacccccttcaccctggtgcgctttgtgaacagcacctggatctttgggaagggcatgtgccacgtgtccagatttgcccagtactgcagcctgcacgtgtctgccctgaccctgacagccatcgctgtggacagacaccaggtgatcatgcaccccctgaagccccgcatcagcatcaccaagggcgtcatctacatcgctgtgatctggaccatggccaccttcttcagcctgccccacgccatctgccagaagctgttcaccttcaagtacagtgaagatattgtgcgcagcctgtgcctgcctgacttccctgagcctgctgacctcttctggaagtacctggacctggccaccttcatcctgctgtacatcctgcccctgctgatcatctctgtggcctatgcccgggtggccaagaagctgtggctgtgcaacatgattggagatgtgaccacagagcagtactttgccctgcggaggaagaagaagaagaccatcaagatgctgatgctggtggtggtgctgtttgccctgtgctggttccccctgaactgctacgtgctgctgctgagcagcaaggtgatccgcaccaacaatgccctgtactttgccttccactggtttgccatgagcagcacctgctacaaccccttcatctactgctggctgaatgaaaacttccgcatcgagctgaaggccctgctgtccatgtgccagaggcctcccaagccccaggaggaccggccccccagccctgtgcccagcttccgggtggcctggacagagaagaatgatggccagagggcccccctggccaacaacctgctgcccaccagccagctgcagagcggcaagacagacctgagctctgtggagcccatcgtgaccatgtcctag

SEQ ID NO: 153297 - DNA, 1191 bp, Artificial Sequence
  Description of Artificial Sequence: Synthetic coding sequence
atgtggaacagcagtgatgccaacttcagctgctaccatgaatctgtgctgggctaccgctacgtggccgtgtcctggggcgtggtggtggccgtgactggaacagtgggcaatgtgctgaccctgctggccctggccatccagcccaagctgcggacccgcttcaacctgctgattgccaacctgaccctggccgacctgctgtactgcaccctgctgcagcccttctctgtggacacctacctgcacctgcactggaggactggagccaccttctgccgggtgtttggcctgctgctgtttgccagcaacagcgtgtccatcctgaccctgtgcctgattgccctgggccgctacctgctgattgcccaccccaagctgttcccccaggtgttttctgccaagggcatcgtgctggccctggtgtccacctgggtggtgggcgtggccagctttgcccccctgtggcccatctacatcctggtgcctgtggtgtgcacctgcagctttgaccgcatccggggccggccctacaccaccatcctgatgggcatctactttgtgctgggcctgagctctgtgggcatcttctactgcctgatccaccggcaggtgaagagagctgcccaggccctggaccagtacaagctgcggcaggccagcatccacagcaaccacgtggccaggacagatgaggccatgcctggccgcttccaggagctggacagccggctggccagcggcggccccagcgagggcatcagcagcgagcctgtgtctgctgccaccacccagaccctggagggggacagcagcgaggtgggggaccagatcaacagcaagagggccaagcagatggccgagaagagccccccagaggccagcgccaaggcccagcccatcaagggggcccggcgggccccagacagcagcagcgagtttgggaaggtgaccaggatgtgctttgctgtgttcctgtgctttgccctgagctacatccccttcctgctgctgaacatcctggatgcccgggtgcaggccccccgggtggtgcacatgctggccgccaacctgacctggctgaatggctgcatcaaccctgtgctgtatgctgccatgaaccggcagttccggcaggcctacggcagcatcctgaagaggggccccaggagcttccaccggctgcactag

SEQ ID NO: 153298 - DNA, 1191 bp, Artificial Sequence; identical to SEQ ID NO: 153297
  Description of Artificial Sequence: Synthetic coding sequence

SEQ ID NO: 153299 - DNA, 1113 bp, Artificial Sequence
  Description of Artificial Sequence: Synthetic coding sequence
atggccaactacagccatgctgctgacaacatcctgcagaacctgagccccctgacagccttcctgaagctgaccagcctgggcttcatcattggagtgtctgtggtgggcaacctgctgatcagcatcctgctggtgaaggacaagaccctgcaccgggccccctactacttcctgctggacctgtgctgcagcgacatcctgcggagcgccatctgcttcccctttgtgttcaacagcgtgaagaatggcagcacctggacctacggcaccctgacctgcaaggtgattgccttcctgggcgtgctgagctgcttccacacagccttcatgctgttctgcatctctgtgacccgctacctggccatcgcccaccaccgcttctacaccaagaggctgaccttctggacctgcctggccgtcatctgcatggtgtggaccctgtctgtggccatggccttcccccctgtgctggatgtgggcacctacagcttcatccgggaggaggaccagtgcaccttccagcacaggagcttccgggccaatgacagcctgggcttcatgctgctgctggccctgatcctgctggccacccagctggtgtacctgaagctgatcttctttgtgcatgacaggaggaagatgaagcctgtgcagtttgtggccgctgtgtcccagaactggaccttccacggccctggggccagcggccaggccgccgccaactggctggccggcttcggccggggccccaccccacccaccctgctgggcatccggcagaatgccaacaccaccggcagaagaaggctgctggtgctggatgagttcaagatggagaagaggatcagcaggatgttctacatcatgaccttcctgttcctgaccctgtggggcccctacctggtggcctgctactggagggtgtttgcccggggccctgtggtgcctgggggcttcctgacagctgctgtgtggatgagctttgcccaggccggcatcaacccctttgtgtgcatcttcagcaaccgggagctgcggcgctgcttcagcaccaccctgctgtactgcaggaagagccggctgccccgggagccctactgcgtcatctag

SEQ ID NO: 153300 - DNA, 1113 bp, Artificial Sequence; identical to SEQ ID NO: 153299
  Description of Artificial Sequence: Synthetic coding sequence

SEQ ID NO: 153301 - DNA, 216 bp, Artificial Sequence
  Description of Artificial Sequence: Synthetic coding sequence
atggccaactacagccatgctgctgacaacatcctgcagaacctgagccccctgacagccttcctgaagctgaccagcctgggcttcatcattggagtgtctgtggtgggcaacctgctgatcagcatcctgctggtgaaggacaagaccctgcaccgggccccctactacttcctgctggacctgtgctgcagcgacatcctgcggagcgcctag

SEQ ID NO: 153302 - DNA, 1113 bp, Artificial Sequence; identical to SEQ ID NO: 153299
  Description of Artificial Sequence: Synthetic coding sequence

SEQ ID NO: 153303 - DNA, 366 bp, Artificial Sequence
  Description of Artificial Sequence: Synthetic coding sequence
atggccaactacagccatgctgctgacaacatcctgcagaacctgagccccctgacagccttcctgaagctgaccagcctgggcttcatcattggagtgtctgtggtgggcaacctgctgatcagcatcctgctggtgaaggacaagaccctgcaccgggccccctactacttcctgctggacctgtgctgcagcgacatcctgcggagcgccatctgcttcccctttgtgttcaacagcgtgaagaatggcagcacctggacctacggcaccctgacctgcaaggtgattgccttcctgggcgtgctgagctgcttccacacagccttcatgctgttctgcatctctgtgacccgctacctgtag

SEQ ID NO: 153304 - DNA, 1113 bp, Artificial Sequence; identical to SEQ ID NO: 153299
  Description of Artificial Sequence: Synthetic coding sequence

SEQ ID NO: 153305 - DNA, 1077 bp, Artificial Sequence
  Description of Artificial Sequence: Synthetic coding sequence
atgggcttcaacctgaccctggccaagctgcccaacaatgagctgcacggccaggagagccacaacagcggcaacagaagtgatggccctgggaagaacaccaccctgcacaatgaatttgacaccatcgtgctgcctgtgctgtacctgatcatctttgtggccagcatcctgctgaatggcctggccgtgtggatcttcttccacatccggaacaagaccagcttcatcttctacctgaagaacatcgtggtggccgacctgatcatgaccctgaccttccccttccgcatcgtgcatgatgctggcttcggcccctggtacttcaagttcatcctgtgccgctacacctctgtgctcttctacgccaacatgtacaccagcatcgtgttcctgggcctcatcagcattgaccgctacctgaaggtggtgaagccctttggagacagcaggatgtacagcatcaccttcaccaaggtgctgtctgtgtgtgtgtgggtgatcatggctgtgctgagcctgcccaacatcatcctgaccaacggccagcccacagaggacaacatccatgactgcagcaagctgaagagccccctgggcgtgaagtggcacacagctgtgacctacgtgaacagctgcctgtttgtggccgtgctggtgatcctgattggctgctacatcgccatcagccgctacatccacaagagcagccggcagttcatcagccagagcagcaggaagaggaagcacaaccagagcatccgggtggtggtggccgtgttcttcacctgcttcctgccctaccacctgtgccgcatccccttcaccttcagccacctggaccggctgctggatgaaagtgcccagaagatcctgtactactgcaaggagatcaccctcttcctgagcgcctgcaatgtgtgcctggaccccatcatctacttcttcatgtgccgctccttcagcagaagactcttcaagaagagcaacatccgcaccaggtctgagagcatccgcagcctgcagagcgtgagaagaagtgaggtgcgcatctactatgactacacagatgtgtag

SEQ ID NO: 153306 - DNA, 1368 bp, Artificial Sequence
  Description of Artificial Sequence: Synthetic coding sequence
atgtccttcctgattgacagcagcatcatgatcaccagccagatcctcttcttcggcttcggctggctgttcttcatgaggcagctgttcaaggactatgagatccggcagtatgtggtgcaggtgatcttctctgtgacctttgccttcagctgcaccatgtttgagctgatcatctttgagatcctgggcgtgctgaacagcagcagccgctacttccactggaagatgaacctgtgtgtgatcctgctgatcctggtgttcatggtgcccttctacatcggctacttcatcgtgagcaacatccggctgctgcacaagcagaggctgctcttcagctgcctgctgtggctgaccttcatgtacttcttctggaagctgggggaccccttccccatcctgagccccaagcacggcatcctgagcattgagcagctgatcagccgggtgggcgtgattggagtgaccctgatggccctgctgagcggctttggagctgtgaactgcccctacacctacatgagctacttcctgagaaatgtgacagacacagacatcctggccctggagcggcggctgctgcagaccatggacatgatcatcagcaagaagaagaggatggccatggcccggaggaccatgttccagaagggggaggtgcacaacaagcccagcggcttctggggcatgatcaagtctgtgaccaccagcgccagcggcagcgagaacctgaccctcatccagcaggaggtggatgccctggaggagctgagccggcagctgttcctggagacagctgacctgtatgccaccaaggagagaattgagtacagcaagaccttcaagggcaagtacttcaacttcctgggctacttcttcagcatctactgtgtgtggaagatcttcatggccaccatcaacatcgtgtttgacagagtgggcaagacagatcctgtgacccggggcatcgagatcaccgtgaactacctgggcatccagtttgatgtgaagttctggagccagcacatctccttcatcctggtgggcatcatcatcgtgaccagcatccggggcctgctgatcaccctgaccaagttcttctacgccatcagcagcagcaagagcagcaatgtgattgtgctgctgctggcccagatcatgggcatgtactttgtgtcctctgtgctgctgatccgcatgtccatgcccctggagtaccgcaccatcatcacagaggtgctgggggagctgcagttcaacttctaccaccgctggtttgatgtgatcttcctggtgtctgccctgagcagcatcctcttcctgtacctggcccacaagcaggcccctgagaagcagatggccccctag

SEQ ID NO: 153307 - DNA, 1008 bp, Artificial Sequence
  Description of Artificial Sequence: Synthetic coding sequence
atgtacttcttctggaagctgggggaccccttccccatcctgagccccaagcacggcatcctgagcattgagcagctgatcagccgggtgggcgtgattggagtgaccctgatggccctgctgagcggctttggagctgtgaactgcccctacacctacatgagctacttcctgagaaatgtgacagacacagacatcctggccctggagcggcggctgctgcagaccatggacatgatcatcagcaagaagaagaggatggccatggcccggaggaccatgttccagaagggggaggtgcacaacaagcccagcggcttctggggcatgatcaagtctgtgaccaccagcgccagcggcagcgagaacctgaccctcatccagcaggaggtggatgccctggaggagctgagccggcagctgttcctggagacagctgacctgtatgccaccaaggagagaattgagtacagcaagaccttcaagggcaagtacttcaacttcctgggctacttcttcagcatctactgtgtgtggaagatcttcatggccaccatcaacatcgtgtttgacagagtgggcaagacagatcctgtgacccggggcatcgagatcaccgtgaactacctgggcatccagtttgatgtgaagttctggagccagcacatctccttcatcctggtgggcatcatcatcgtgaccagcatccggggcctgctgatcaccctgaccaagttcttctacgccatcagcagcagcaagagcagcaatgtgattgtgctgctgctggcccagatcatgggcatgtactttgtgtcctctgtgctgctgatccgcatgtccatgcccctggagtaccgcaccatcatcacagaggtgctgggggagctgcagttcaacttctaccaccgctggtttgatgtgatcttcctggtgtctgccctgagcagcatcctcttcctgtacctggcccacaagcaggcccctgagaagcagatggccccctag

SEQ ID NO: 153308 - DNA, 1368 bp, Artificial Sequence; identical to SEQ ID NO: 153306
  Description of Artificial Sequence: Synthetic coding sequence

SEQ ID NO: 153309 - DNA, 18921 bp, Artificial Sequence
  Description of Artificial Sequence: Synthetic coding sequence
atggacatcttcctggtgctgggcatgcccagcgccagcctgctggtgaacctgctgagcgccctgctgatcctgtttgtgtttggagaaacagagatccgcttcaccggccagacagaatttgtggtgaatgagaccagcaccaccgtcatccgcctcatcatcgagcgcatcggggagcccgccaacgtgacagccatcgtgtccctgtatggagaagatgctggggacttctttgacacctatgctgctgccttcatcccagctggggagaccaacagaacagtgtacatcgctgtgtgtgatgatgacctgcctgagccagatgagaccttcatcttccacctgaccctgcagaagcccagcgccaacgtgaagctgggctggcccaggacagtgacagtgaccatcctgagcaatgacaatgccttcggcatcatctccttcaacatgctgcccagcattgctgtgtctgagcccaagggcagaaatgaatccatgcccctgaccctcatccgggagaagggcacctacggcatggtgatggtgacctttgaggtggagggcggccccaaccccccagatgaggacctgagccctgtgaagggcaacatcaccttccccccaggccgggccaccgtcatctacaacctgactgtgctggatgatgaggtgcctgaaaatgatgagatcttcctgatccagctgaagtctgtggagggcggcgctgagatcaacaccagcagaaattccattgagatcatcatcaagaagaatgacagccctgtgcgcttcctgcagagcatctacctggtgcctgaggaggaccacatcctgatcatccctgtggtgcggggcaaggacaacaacggcaacctgattggaagtgatgaatatgaggtgtccatctcctatgctgtgaccactggaaacagcacagcccacgcccagcagaacctggacttcatcgacctgcagcccaacaccaccgtggtgttcccccccttcatccacgagagccacctgaagttccagatcgtggatgacaccatccctgagattgctgagagcttccacatcatgctgctgaaggacaccctgcagggagatgctgtgctgatcagccccagcgtggtgcaggtgaccatcaagcccaatgacaagccctacggcgtgctgtccttcaacagcgtgctgtttgagaggacagtcatcattgatgaggaccgcatcagccgctatgaggagatcaccgtggtgagaaatggaggcacccacggcaatgtgtctgccaactgggtgctgaccaggaacagcacagaccccagccctgtgacagctgacatccggcccagcagtggagtgctgcactttgcccagggccagatgctggccaccatccccctgactgtggtggatgatgacctgcctgaggaggccgaggcctacctgctgcagatcctgccccacaccatccggggcggcgctgaggtgtctgagcctgctgagctgctcttctacatccaggacagtgatgatgtgtatggcctcatcaccttcttccccatggagaaccagaagattgagagcagccctggagagcgctacctgagcctgtccttcacccggctgggcggcaccaagggagatgtgcggctgctgtacagcgtgctgtacatcccagctggagctgtggaccccctgcaggccaaggagggcatcctgaacatcagcagaagaaatgacctgatcttccctgagcagaagacccaggtgaccaccaagctgcccatcagaaatgatgccttcctgcagaatggagcccacttcctggtgcagctggagaccgtggagctgctgaacatcatccccctcatcccccccatcagccccaggtttggagagatctgcaacatcagcctgctggtgaccccagccatcgccaatggagagatcggcttcctgagcaacctgcccatcatcctgcacgagcctgaggactttgctgctgaggtggtgtacatccccctgcacagagatggaacagatggccaggccaccgtgtactggagcctgaagcccagcggcttcaacagcaaggctgtgaccccagatgacatcggccccttcaatggatctgtgctcttcctgagcggccagagcgacaccaccatcaacatcaccatcaagggagatgacatccctgagatgaatgagaccgtgaccctgagcctggacagagtgaatgtggagaaccaggtgctgaagagcggctacaccagccgggacctgatcatcctggagaatgatgaccccggcggcgtgtttgagttcagccctgccagccggggcccctacgtgatcaaggagggggagagcgtggagctgcacatcatccgcagccggggcagcctggtgaagcagttcctgcactacagagtggagccccgggacagcaatgagttctacggcaacacaggagtgctggagttcaagccaggagagcgggagatcgtcatcaccctgctggcccggctggatggcatccctgagctggatgagcactactgggtggtgctgagcagccatggagagcgggagagcaagctgggcagcgccaccatcgtgaacatcaccatcctgaagaatgatgacccccacggcatcatcgagtttgtgtctgatggcctcatcgtgatgatcaatgaaagcaaaggagatgccatctacagcgctgtgtatgatgtggtgaggaacagaggcaactttggagatgtgtctgtgtcctgggtggtgtccccagacttcacccaggatgtgtttcctgtgcagggcaccgtggtgtttggagaccaggagttcagcaagaacatcaccatctacagcctgcctgatgagatccctgaggagatggaggagttcaccgtcatcctgctgaatggcaccggcggggccaaggtgggcaacagaaccacagccaccctgcgcatcagaagaaatgatgaccccatctactttgctgagccccgggtggtgcgggtgcaggagggggagacagccaacttcaccgtgctgagaaatggatctgtggatgtgacctgcatggtgcagtatgccaccaaggatggcaaggccacagcccgggagcgggacttcatccctgtggagaagggggagaccctcatctttgaggtgggcagccggcagcagagcatcagcatctttgtgaatgaagatggcatccctgagacagatgagcccttctacatcatcctgctgaacagcactggagacacagtggtgtaccagtatggagtggccaccgtcatcatcgaggccaatgatgaccccaacggcatcttcagcctggagcccatcgacaaggctgtggaggagggcaagaccaatgccttctggatcctgcggcaccggggctactttggatctgtgtctgtgtcctggcagctgttccagaatgattctgccctgcagcccggccaggagttctatgagaccagcggcaccgtgaacttcatggatggagaggaggccaagcccatcatcctgcacgccttcccagacaagatccctgagttcaatgagttctacttcctgaagctggtgaacatcagcggcggcagccctggccctgggggccagctggccgagaccaacctgcaggtgacagtgatggtgcccttcaatgatgacccctttggagtcttcatcctggaccctgaatgtctggagcgggaggtggctgaagatgtgctgtctgaagatgacatgagctacatcaccaacttcaccatcctgcggcagcagggcgtgtttggagatgtgcagctgggctgggagatcctgagcagcgagttccctgctggcctgccccccatgattgacttcctgctggtgggcatcttccccaccaccgtgcacctgcagcagcacatgagaagacaccacagcggcacagatgccctgtacttcaccggcctggagggcgcctttggaacagtgaaccccaagtaccaccccagcaggaacaacaccatcgccaacttcaccttcagcgcctgggtgatgcccaatgccaacaccaacggcttcatcatcgccaaggatgatggaaatggcagcatctactatggagtgaagatccagaccaatgaaagccacgtgaccctgagcctgcactacaagaccctgggcagcaatgccacctacatcgccaagaccaccgtgatgaagtacctggaggagagcgtgtggctgcacctgctgatcatcctggaggatggcatcatcgagttctacctggatggaaatgccatgccccggggcatcaagagcctgaagggggaggccatcacagatggccctggcatcctgcgcatcggggccggcatcaatggaaatgaccgcttcaccggcctgatgcaggatgtgcgctcctatgaaaggaagctgaccctggaggagatctatgagctgcacgccatgcctgccaagagtgacctgcaccccatcagcggctacctggagttccggcagggcgagaccaacaagagcttcatcatcagcgccagagatgacaatgatgaggagggggaggagctgttcatcctgaagctggtgtctgtgtatggaggagcccgcatcagcgaggagaacaccacagcccggctgaccatccagaagagtgacaatgccaacggcctgtttggcttcaccggggcctgcatccctgagattgctgaggagggcagcaccatcagctgtgtggtggagaggaccaggggggccctggactatgtgcacgtgttctacaccatcagccagattgaaacagatggcatcaactacctggtggatgactttgccaatgccagcggcaccatcaccttcctgccctggcagaggtctgaggtgctgaacatctacgtgctggatgatgacatccctgagctgaatgagtacttccgggtgaccctggtgtctgccatccctggagatggcaagctgggcagcacccccaccagcggggccagcattgatcctgagaaggagaccacagacatcaccatcaaggccagtgaccacccctacggcctgctgcagttcagcacaggcctgcccccccagcccaaggatgccatgaccctgcctgccagctctgtgccccacatcaccgtggaggaggaggatggagagatccggctgctggtgatccgggcccagggcctgctgggccgggtgacagctgagttcagaacagtgtccctgacagccttcagccctgaggactaccagaatgtggccggcaccctggagttccagcctggagagcgctacaagtacatcttcatcaacatcacagacaacagcatccctgagctggagaagagcttcaaggtggagctgctgaacctggagggcggcgtggccgagctgttccgggtggatggcagcggcagcggagatggagacatggagttcttcctgcccaccatccacaagagggccagcctgggcgtggccagccagatcctggtgaccatcgccgccagtgaccacgcccatggagtgtttgagttcagccctgagagcctgtttgtgtctggaacagagccagaagatggctacagcacagtgaccctgaatgtcatccgccaccacggcaccctgagccctgtgaccctgcactggaacatcgacagcgaccctgatggagacctggccttcaccagcggcaacatcacctttgagatcggccagaccagcgccaacatcaccgtggagatcctgcctgatgaagatcctgagctggacaaggccttctctgtgtctgtgctgtctgtgagcagcggcagcctgggcgcccacatcaatgccaccctgactgtgctggccagtgatgacccctacggcatcttcatcttcagcgagaagaacagacctgtgaaggtggaggaggccacccagaacatcaccctgagcatcatccggctgaagggcctgatgggcaaggtgctggtgtcctatgccaccctggatgacatggagaagccaccctacttcccccccaacctggcccgggccacccagggccgggactacatcccagccagcggctttgccctgtttggagccaaccagagcgaggccaccatcgccatcagcatcctggatgatgatgagcctgagaggtctgagagcgtcttcatcgagctgctgaacagcaccctggtggccaaggtgcagagccgcagcatccccaacagcccccggctgggccccaaggtggagaccatcgcccagctgatcatcatcgccaatgatgatgccttcggcaccctgcagctgagcgcccccatcgtgcgggtggctgaaaatcatgtgggccccatcatcaacgtgaccaggactggaggagcctttgctgatgtgtctgtgaagttcaaggctgtgcccatcacagccatcgccggggaggactacagcatcgccagcagtgatgtggtgctgctggagggggagaccagcaaggctgtgcccatctacgtgatcaatgacatctacccagagctggaggagagcttcctggtgcagctgatgaatgagaccaccggcggggcccggctgggcgccctgacagaagctgtgatcatcatcgaggccagtgatgacccctacggcctgtttggcttccagatcaccaagctgattgtggaggagcctgagttcaacagcgtgaaggtgaacctgcccatcatccggaacagcggcaccctgggcaatgtgacagtgcagtgggtggccaccatcaatggccagctggccaccggggacctgcgggtggtgtctggaaatgtgacctttgcccctggagagaccatccagaccctgctgctggaggtgctggctgatgatgtgcctgagattgaggaggtgatccaggtgcagctgacagatgccagcggcggcggcaccatcggcctggacagaattgccaacatcatcatcccagccaatgatgacccctatggaacagtggcctttgcccagatggtgtacagagtgcaggagcccctggagaggagcagctgtgccaacatcaccgtgcggcgcagcggcggccacttcggccgcctgctgctcttctacagcaccagtgacattgatgtggtggccctggccatggaggagggccaggacctgctgagctactatgagagccccatccagggcgtgcctgaccccctgtggaggacctggatgaatgtgtctgctgtgggggagcccctgtacacctgtgccaccctgtgcctgaaggagcaggcctgcagcgccttctccttcttcagcgccagcgagggcccccagtgcttctggatgacctcctggatcagccctgctgtgaacaacagcgacttctggacctacaggaagaacatgaccagggtggccagcctcttcagcggccaggccgtggccggcagtgactatgagcctgtgacccggcagtgggccatcatgcaggagggagatgaatttgccaacctgactgtgtccatcctgcctgatgacttccctgagatggatgagagcttcctgatcagcctgctggaggtgcacctgatgaacatcagcgccagcctgaagaaccagcccaccatcggccagcccaacatcagcacagtggtgattgccctgaatggagatgcctttggagtgtttgtgatctacaacatcagccccaacaccagtgaagatggcctgtttgtggaggtgcaggagcagccccagaccctggtggagctgatgatccacaggactggaggcagcctgggccaggtggccgtggagtggagggtggtgggcggcacagccacagagggcctggacttcatcggggccggggagatcctgacctttgctgagggggagaccaagaagacagtcatcctgaccatcctggatgattctgagccagaagatgatgagagcatcatcgtgtccctggtgtacacagagggcggcagccgcatcctgcccagcagtgacacagtgcgggtgaacatcctggccaatgacaacgtggccggcatcgtgtccttccagacagccagccgctctgtgattggacatgaaggagagatcctgcagttccacgtgatccgcaccttccctggaagaggaaatgtgacagtgaactggaagatcatcggccagaacctggagctgaactttgccaacttcagcggccagctgttcttccctgagggcagcctgaacaccaccctgtttgtgcacctgctggatgacaacatccctgaggagaaggaggtgtaccaggtgatcctgtatgatgtgaggacccagggcgtgcccccagctggcatcgccctgctggatgcccagggctatgctgctgtgctgactgtggaggccagtgatgagccccatggagtgctgaactttgccctgagcagcagatttgtgctgctgcaggaggccaacatcaccatccagctgttcatcaaccgggagtttggcagcctgggcgccatcaacgtgacctacaccaccgtgcccggcatgctgagcctgaagaaccagacagtgggcaacctggccgagcctgaggtggactttgtgcccatcatcggcttcctgatcctggaggagggggagacagctgctgccatcaacatcaccatcctggaggatgatgtgcctgagctggaggagtacttcctggtgaacctgacctacgtgggcctgaccatggccgccagcaccagcttccccccccggctggacagcgagggcctgacagcccaggtgatcattgatgccaatgatggagcccggggcgtcatcgagtggcagcagagcagatttgaggtgaatgagacccacggcagcctgaccctggtggcccagaggagccgggagcccctgggccacgtgtccctgtttgtgtatgcccagaacctggaggcccaggtgggcctggactacatcttcacccccatgatcctgcactttgctgatggagagcgctacaagaatgtgaacatcatgatcctggatgatgacatcccagaaggagatgagaagttccagctgatcctgaccaaccccagccctggcctggagctgggcaagaacaccatcgccctgatcatcgtgctggccaatgatgatggccctggggtgctgtccttcaacaacagcgagcacttcttcctgcgggagcccacagccctgtatgtgcaggagagcgtggccgtgctgtacatcgtgcgggagcccgcccagggcctgtttggcaccgtgacagtgcagttcatcgtgacagaggtgaacagcagcaatgaaagcaaggacctgacccccagcaagggctacatcgtgctggaggagggcgtgcgcttcaaggccctgcagatcagcgccatcctggacacagagcctgagatggatgagtactttgtgtgcaccctcttcaaccccactggaggagcccggctgggcgtgcacgtgcagaccctcatcaccgtgctgcagaaccaggcccccctgggcctcttcagcatctctgctgtggagaacagagccaccagcattgacatcgaggaggccaacagaacagtgtacctgaatgtgtccaggaccaatggaattgacctggccgtgtctgtgcagtgggagaccgtgtctgaaacagccttcggcatgaggggcatggatgtggtgttttctgtgttccagagcttcctggatgagagcgccagcggctggtgcttcttcaccctggagaacctgatctacggcatcatgctgaggaagagctctgtgacagtgtaccgctggcagggcatcttcatccctgtggaggacctgaacatcgagaaccccaagacctgtgaggccttcaacatcggcttcagcccctactttgtgatcacccatgaggagagaaatgaggagaagcccagcctgaacagcgtcttcaccttcaccagcggcttcaagctgttcctggtgcagaccatcatcatcctggagagcagccaggtgcgctacttcaccagtgacagccaggactacctgatcatcgccagccagagagatgattctgagctgacccaggtgttccgctggaatggaggcagctttgtgctgcaccagaagctgcctgtgcggggcgtgctgactgtggccctcttcaacaagggcggcagcgtcttcctggccatcagccaggccaatgcccggctgaacagcctgctcttccgctggagcggcagcggcttcatcaacttccaggaggtgcctgtgtctggcaccacagaggtggaggccctgagcagcgccaatgacatctacctgatctttgctgaaaatgtgttcctgggggaccagaacagcattgacatcttcatctgggagatgggccagagcagcttccgctacttccagagcgtggactttgctgctgtgaaccgcatccacagcttcaccccagccagcggcatcgcccacatcctgctgattggccaggacatgtctgccctgtactgctggaacagcgagaggaaccagttctcctttgtgctggaggtgcccagcgcctatgatgtggcctctgtgacagtgaagagcctgaacagcagcaagaacctgattgccctggtgggcgcccacagccacatctatgagctggcctacatcagcagccacagcgacttcatccccagcagtggagagctgatctttgagcccggggagcgggaggccaccatcgctgtgaacatcctggatgacacagtgcctgagaaggaggagagcttcaaggtgcagctgaagaaccccaagggcggcgctgagatcggcatcaatgattctgtgaccatcaccatcctgagcaatgatgatgcctatggaattgtggcctttgcccagaacagcctgtacaagcaggtggaggagatggagcaggacagcctggtgaccctgaatgtggagcggctgaagggcacctacggccgcatcaccatcgcctgggaggctgatggcagcatcagtgacatcttccccaccagcggggtcatcctcttcacagagggccaggtgctgagcaccatcaccctgaccatcctggccgacaacatccctgagctgtctgaggtggtgattgtgaccctgacccgcatcaccacagagggcgtggaggacagctacaagggggccaccatcgaccaggacaggagcaagagcgtcatcaccaccctgcccaatgacagccccttcggcctggtgggctggagggctgcctctgtgttcatccgggtggccgagcccaaggagaacaccaccaccctgcagctgcagatcgcccgggacaagggcctgctgggggacatcgccatccacctgcgggcccagcccaacttcctgctgcacgtggacaaccaggccacagaaaatgaagattatgtgctgcaggagaccatcatcatcatgaaggagaacatcaaggaggcccacgccgaggtgtccatcctgcctgatgacctgcctgagctggaggagggcttcatcgtgaccatcacagaggtgaacctggtgaacagcgacttcagcacaggccagcccagcgtgcggcggcccggcatggagattgctgagatcatgattgaagaaaatgatgacccccggggcatcttcatgttccacgtgaccagaggagctggggaggtgatcacagcctatgaggtgcccccacccctgaatgtgctgcaggtgcctgtggtgcggctggccggcagctttggagctgtgaatgtgtactggaaggccagcccagattctgctggcctggaggacttcaagcccagccacggcatcctggagtttgctgacaagcaggtgacagccatgattgagatcaccatcattgatgatgctgagtttgagctgacagagaccttcaacatcagcctcatctctgtggccggcggcggccgcctgggagatgatgtggtggtgacagtggtgatcccccagaatgacagcccctttggagtgtttggatttgaggagaagacagtgatgattgatgagagcctgagcagtgatgatcctgacagctatgtgaccctgactgtggtgcgcagccctgggggcaaaggaacagtgcggctggagtggaccattgatgagaaggccaagcacaacctgagccccctgaatggcaccctgcactttgatgaaacagagagccagaagaccatcgtgctgcacaccctgcaggacacagtgctggaggaggaccggcgcttcaccatccagctgatcagcattgatgaggtggagatcagccctgtgaagggcagcgccagcatcatcatccggggggacaagagggccagcggggaggtgggcatcgcccccagcagccgccacatcctgattggagagcccagcgccaagtacaacggcacagccatcatcagcctggtgcggggccctggcatcctgggggaggtgaccgtcttctggaggatcttccccccatctgtgggggagtttgctgagaccagcggcaagctgaccatgagagatgagcagagcgctgtgattgtggtgatccaggccctgaatgatgacatccctgaggagaagagcttctatgagttccagctgacagctgtgtctgagggcggcgtgctgtctgagagcagcagcacagccaacatcaccgtggtggccagtgacagcccctacggccgctttgccttcagccatgagcagctgcgggtgtctgaggcccagagggtgaacatcaccatcatccgcagcagcggggactttggacatgtgcggctgtggtacaagaccatgagcggcacagctgaggccggcctggactttgtgcctgctgctggggagctgctgtttgaggccggggagatgaggaagagcctgcacgtggagatcctggatgatgactacccagagggccctgaggagttcagcctgaccatcaccaaggtggagctgcagggccggggctatgacttcaccatccaggagaatggcctgcagattgaccagcccccagagatcggcaacatcagcatcgtgcgcatcatcatcatgaagaatgacaatgctgagggcatcatcgagtttgaccccaagtacacagcctttgaggtggaggaggatgtgggcctcatcatgatccctgtggtgcggctgcacggcacctacggctacgtgacagctgacttcatcagccagagcagcagcgccagccctggaggagtggactacatcctgcacggcagcacagtgaccttccagcacggccagaacctgtccttcatcaacatcagcatcattgatgacaatgaaagtgaatttgaggagcccatcgagatcctgctgactggagccaccggcggcgctgtgctgggccgccacctggtgagccgcatcatcatcgccaagagtgacagcccctttggagtcatccgcttcctgaaccagagcaagatcagcatcgccaaccccaacagcaccatgatcctgagcctggtgctggagaggactggaggcctgctgggggagatccaggtgaactgggagaccgtgggccccaacagccaggaggccctgctgccccagaacagagacattgctgaccctgtgtctggcctcttctactttggagagggggagggcggcgtgaggaccatcatcctgaccatctacccccatgaggagattgaggtggaggagaccttcatcatcaagctgcacctggtgaagggggaggccaagctggacagccgggccaaggatgtgaccctgaccatccaggagtttggagaccccaatggagtggtgcagtttgcccctgagaccctgagcaagaagacctacagcgagcccctggccctggagggccccctgctgatcaccttctttgtgagaagagtgaagggcacctttggagagatcatggtgtactgggagctgagcagcgagtttgacatcacagaggacttcctgagcaccagcggcttcttcaccatcgcagatggagagagcgaggccagctttgatgtgcacctgctgcctgatgaggtgcctgagattgaggaggactatgtgatccagctggtgtctgtggagggcggcgctgagctggacctggagaagagcatcacctggttctctgtgtatgccaatgatgacccccatggagtgtttgccctgtacagcgaccggcagagcatcctgattggccagaacctgatccgcagcatccagatcaacatcacccggctggccggcacctttggagatgtggccgtgggcctgcgcatcagcagtgaccacaaggagcagcccatcgtgacagaaaatgctgagcggcagctggtggtgaaggatggagccacctacaaggtggatgtggtgcccatcaagaaccaggtgttcctgagcctgggcagcaacttcaccctgcagctggtgacagtgatgctggtgggcggccgcttctacggcatgcccaccatcctgcaggaggccaagtctgctgtgctgcctgtgtctgagaaggccgccaacagccaggtgggctttgagagcacagccttccagctgatgaacatcacagctggcaccagccacgtgatgatcagcagaagaggcacctatggagccctgtctgtggcctggaccaccggctacgcccctggcctggagatccctgagttcatcgtggtgggcaacatgacccccaccctgggcagcctgtccttcagccacggggagcagaggaaaggagtcttcctgtggaccttccccagccctggctggccagaggcctttgtgctgcacctgagcggcgtgcagagcagcgcccctggaggagcccagctgcggagcggcttcatcgtggccgagattgagcccatgggcgtcttccagttcagcaccagcagcaggaacatcatcgtgtctgaggacacccagatgatccggctgcacgtgcagaggctgtttggcttccacagcgacctgatcaaggtgtcctaccagaccacagctggcagcgccaagcccctggaggactttgagcctgtgcagaatggagagctgttcttccagaagttccagacagaggtggactttgagatcaccatcatcaatgaccagctgtctgaaattgaggagttcttctacatcaacctgacctctgtggagatccggggcctgcagaagtttgatgtgaactggagcccccggctgaacctggacttctctgtggccgtcatcaccatcctggacaatgatgacctggccggcatggacatctccttccctgagaccaccgtggccgtggccgtggacaccaccctcatccctgtggagacagagagcaccacctacctgagcaccagcaagaccaccaccatcctgcagcccaccaacgtggtggccatcgtgacagaggccactggagtgtctgccatccctgagaagctggtgaccctgcacggcaccccagctgtgtctgagaagccagatgtggccaccgtgacagccaacgtgtccatccacggcaccttcagcctgggccccagcatcgtgtacatcgaggaggagatgaagaatggcaccttcaacacagctgaggtgctgatccggaggactggaggcttcaccggaaatgtgtccatcaccgtgaagaccttcggggagcgctgtgcccagatggagcccaatgccctgcccttccggggcatctacggcatcagcaacctgacctgggccgtggaggaggaggactttgaggagcagaccctgaccctcatcttcctggatggagagcgggagaggaaggtgtctgtgcagatcctggatgatgatgagcctgagggccaggagttcttctacgtgttcctgaccaacccccagggcggggcccagatcgtggaggagaaggatgacaccggctttgctgcctttgccatggtgatcatcactggaagtgacctgcacaacggcatcatcggcttcagcgaggagagccagagcggcctggagctgcgggagggcgctgtgatgaggcggctgcacctgattgtgacccggcagcccaacagagcctttgaagatgtgaaggtgttctggagggtgaccctgaacaagacagtggtggtgctgcagaaggatggagtgaacctggtggaggagctgcagagcgtgtctggcaccaccacctgcaccatgggccagaccaagtgcttcatcagcattgagctgaagccagagaaggtgccccaggtggaggtgtacttctttgtggagctgtatgaggccacagctggagctgccatcaacaacagcgccaggtttgcccagatcaagatcctggagagtgatgagagccagagcctggtgtacttctctgtgggcagccggctggccgtggcccacaagaaggccaccctcatcagcctgcaggtggcccgggacagcggcaccggcctgatgatgtctgtgaacttcagcacccaggagctgcggtctgctgagaccatcggccgcaccatcatcagccctgccatcagcggcaaggactttgtgatcacagagggcaccctggtgtttgagcccggccagaggagcacagtgctggatgtgatcctgaccccagagaccggcagcctgaacagcttccccaagcgcttccagatcgtgctgtttgaccccaagggcggggccagaattgacaaggtgtatggaacagccaacatcaccctggtgtctgatgctgacagccaggccatctggggcctggccgaccagctgcaccagcctgtgaatgatgacatcctgaacagagtgctgcacaccatctccatgaaggtggccacagagaacacagatgagcagctgagcgccatgatgcacctgattgagaagatcaccacagagggcaagatccaggccttctctgtggccagcaggaccctcttctatgagatcctgtgcagcctcatcaaccccaagaggaaggacacccggggcttcagccactttgctgaggtgacagaaaattttgccttcagcctgctgaccaacgtgacctgtggcagccctggagagaagagcaagaccatcctggacagctgcccctacctgagcatcctggccctgcactggtacccccagcagatcaatggccacaagtttgagggcaaggagggggactacatccgcatccctgagcggctgctggatgtgcaggatgctgagatcatggccggcaagagcacctgcaagctggtgcagttcacagagtacagcagccagcagtggttcatcagcggcaacaacctgcccaccctgaagaacaaggtgctgagcctgtctgtgaagggccagagcagccagctgctgaccaatgacaatgaggtgctgtaccgcatctatgctgctgagccccgcatcatcccccagaccagcctgtgcctgctgtggaaccaggccgccgcctcctggctgagtgacagccagttctgcaaggtggtggaggagacagctgactatgtggagtgtgcctgcagccacatgtctgtgtatgctgtgtatgccaggacagacaacctgagcagctacaatgaggccttcttcaccagcggcttcatctgcatcagcggcctgtgcctggccgtgctgagccacatcttctgtgcccgctacagcatgtttgctgccaagctgctgacccacatgatggccgccagcctgggcacccagatcctcttcctggccagcgcctatgccagcccccagctggccgaggagagctgcagcgccatggctgctgtgacccactacctgtacctgtgccagttctcctggatgctgatccagagcgtgaacttctggtacgtgctggtgatgaatgatgagcacacagagcggcgctacctgctcttcttcctgctgtcctggggcctgcctgcctttgtggtgatcctgctgattgtcatcctgaagggcatctaccaccagagcatgagccagatctacggcctcatccacggggacctgtgcttcatccccaacgtgtatgctgccctcttcaccgctgccctggtgcccctgacctgcctggtggtggtgtttgtggtgttcatccacgcctaccaggtgaagccccagtggaaggcctatgatgatgtgttccggggccgcaccaatgctgctgagatccccctcatcctgtacctgtttgccctgatctctgtgacctggctgtggggcggcctgcacatggcctaccgccacttctggatgctggtgctgtttgtgatcttcaacagcctgcagggcctgtatgtgttcatggtgtacttcatcctgcacaaccagatgtgctgccccatgaaggccagctacacagtggagatgaatggccaccctggccccagcacagccttcttcaccccaggcagcggcatgcctcctgctggaggagagatcagcaagagcacccagaacctgattggagccatggaggaggtgcccccagactgggagcgggccagcttccagcagggcagccaggccagcccagacctgaagcccagcccccagaatggagccaccttccccagcagcggcggctacggccagggcagcctgattgctgatgaggagagccaggagtttgatgacctgatctttgccctgaagacaggagctggcctgtctgtgtctgacaatgaaagtggccagggcagccaggagggcggcaccctgacagacagccagatcgtggagctgcggcgcatccccatcgctgacacccacctgtag

SEQ ID NO: 153310 - DNA, 6921 bp, Artificial Sequence
  Description of Artificial Sequence: Synthetic coding sequence
gtggatgtgttcatgttcctgggcatgcccagcgccagcctgctggtgaacctgctgagcgccctgctgatcctgtttgtgtttggagaaacagagatccgcttcaccggccagacagaatttgtggtgaatgagaccagcaccaccgtcatccgcctcatcatcgagcgcatcggggagcccgccaacgtgacagccatcgtgtccctgtatggagaagatgctggggacttctttgacacctatgctgctgccttcatcccagctggggagaccaacagaacagtgtacatcgctgtgtgtgatgatgacctgcctgagccagatgagaccttcatcttccacctgaccctgcagaagcccagcgccaacgtgaagctgggctggcccaggacagtgacagtgaccatcctgagcaatgacaatgccttcggcatcatctccttcaacatgctgcccagcattgctgtgtctgagcccaagggcagaaatgaatccatgcccctgaccctcatccgggagaagggcacctacggcatggtgatggtgacctttgaggtggagggcggccccaaccccccagatgaggacctgagccctgtgaagggcaacatcaccttccccccaggccgggccaccgtcatctacaacctgactgtgctggatgatgaggtgcctgaaaatgatgagatcttcctgatccagctgaagtctgtggagggcggcgctgagatcaacaccagcagaaattccattgagatcatcatcaagaagaatgacagccctgtgcgcttcctgcagagcatctacctggtgcctgaggaggaccacatcctgatcatccctgtggtgcggggcaaggacaacaacggcaacctgattggaagtgatgaatatgaggtgtccatctcctatgctgtgaccactggaaacagcacagcccacgcccagcagaacctggacttcatcgacctgcagcccaacaccaccgtggtgttcccccccttcatccacgagagccacctgaagttccagatcgtggatgacaccatccctgagattgctgagagcttccacatcatgctgctgaaggacaccctgcagggagatgctgtgctgatcagccccagcgtggtgcaggtgaccatcaagcccaatgacaagccctacggcgtgctgtccttcaacagcgtgctgtttgagaggacagtcatcattgatgaggaccgcatcagccgctatgaggagatcaccgtggtgagaaatggaggcacccacggcaatgtgtctgccaactgggtgctgaccaggaacagcacagaccccagccctgtgacagctgacatccggcccagcagtggagtgctgcactttgcccagggccagatgctggccaccatccccctgactgtggtggatgatgacctgcctgaggaggccgaggcctacctgctgcagatcctgccccacaccatccggggcggcgctgaggtgtctgagcctgctgagctgctcttctacatccaggacagtgatgatgtgtatggcctcatcaccttcttccccatggagaaccagaagattgagagcagccctggagagcgctacctgagcctgtccttcacccggctgggcggcaccaagggagatgtgcggctgctgtacagcgtgctgtacatcccagctggagctgtggaccccctgcaggccaaggagggcatcctgaacatcagcagaagaaatgacctgatcttccctgagcagaagacccaggtgaccaccaagctgcccatcagaaatgatgccttcctgcagaatggagcccacttcctggtgcagctggagaccgtggagctgctgaacatcatccccctcatcccccccatcagccccaggtttggagagatctgcaacatcagcctgctggtgaccccagccatcgccaatggagagatcggcttcctgagcaacctgcccatcatcctgcacgagcctgaggactttgctgctgaggtggtgtacatccccctgcacagagatggaacagatggccaggccaccgtgtactggagcctgaagcccagcggcttcaacagcaaggctgtgaccccagatgacatcggccccttcaatggatctgtgctcttcctgagcggccagagcgacaccaccatcaacatcaccatcaagggagatgacatccctgagatgaatgagaccgtgaccctgagcctggacagagtgaatgtggagaaccaggtgctgaagagcggctacaccagccgggacctgatcatcctggagaatgatgaccccggcggcgtgtttgagttcagccctgccagccggggcccctacgtgatcaaggagggggagagcgtggagctgcacatcatccgcagccggggcagcctggtgaagcagttcctgcactacagagtggagccccgggacagcaatgagttctacggcaacacaggagtgctggagttcaagccaggagagcgggagatcgtcatcaccctgctggcccggctggatggcatccctgagctggatgagcactactgggtggtgctgagcagccatggagagcgggagagcaagctgggcagcgccaccatcgtgaacatcaccatcctgaagaatgatgacccccacggcatcatcgagtttgtgtctgatggcctcatcgtgatgatcaatgaaagcaaaggagatgccatctacagcgctgtgtatgatgtggtgaggaacagaggcaactttggagatgtgtctgtgtcctgggtggtgtccccagacttcacccaggatgtgtttcctgtgcagggcaccgtggtgtttggagaccaggagttcagcaagaacatcaccatctacagcctgcctgatgagatccctgaggagatggaggagttcaccgtcatcctgctgaatggcaccggcggggccaaggtgggcaacagaaccacagccaccctgcgcatcagaagaaatgatgaccccatctactttgctgagccccgggtggtgcgggtgcaggagggggagacagccaacttcaccgtgctgagaaatggatctgtggatgtgacctgcatggtgcagtatgccaccaaggatggcaaggccacagcccgggagcgggacttcatccctgtggagaagggggagaccctcatctttgaggtgggcagccggcagcagagcatcagcatctttgtgaatgaagatggcatccctgagacagatgagcccttctacatcatcctgctgaacagcactggagacacagtggtgtaccagtatggagtggccaccgtcatcatcgaggccaatgatgaccccaacggcatcttcagcctggagcccatcgacaaggctgtggaggagggcaagaccaatgccttctggatcctgcggcaccggggctactttggatctgtgtctgtgtcctggcagctgttccagaatgattctgccctgcagcccggccaggagttctatgagaccagcggcaccgtgaacttcatggatggagaggaggccaagcccatcatcctgcacgccttcccagacaagatccctgagttcaatgagttctacttcctgaagctggtgaacatcagcggcggcagccctggccctgggggccagctggccgagaccaacctgcaggtgacagtgatggtgcccttcaatgatgacccctttggagtcttcatcctggaccctgaatgtctggagcgggaggtggctgaagatgtgctgtctgaagatgacatgagctacatcaccaacttcaccatcctgcggcagcagggcgtgtttggagatgtgcagctgggctgggagatcctgagcagcgagttccctgctggcctgccccccatgattgacttcctgctggtgggcatcttccccaccaccgtgcacctgcagcagcacatgagaagacaccacagcggcacagatgccctgtacttcaccggcctggagggcgcctttggaacagtgaaccccaagtaccaccccagcaggaacaacaccatcgccaacttcaccttcagcgcctgggtgatgcccaatgccaacaccaacggcttcatcatcgccaaggatgatggaaatggcagcatctactatggagtgaagatccagaccaatgaaagccacgtgaccctgagcctgcactacaagaccctgggcagcaatgccacctacatcgccaagaccaccgtgatgaagtacctggaggagagcgtgtggctgcacctgctgatcatcctggaggatggcatcatcgagttctacctggatggaaatgccatgccccggggcatcaagagcctgaagggggaggccatcacagatggccctggcatcctgcgcatcggggccggcatcaatggaaatgaccgcttcaccggcctgatgcaggatgtgcgctcctatgaaaggaagctgaccctggaggagatctatgagctgcacgccatgcctgccaagagtgacctgcaccccatcagcggctacctggagttccggcagggcgagaccaacaagagcttcatcatcagcgccagagatgacaatgatgaggagggggaggagctgttcatcctgaagctggtgtctgtgtatggaggagcccgcatcagcgaggagaacaccacagcccggctgaccatccagaagagtgacaatgccaacggcctgtttggcttcaccggggcctgcatccctgagattgctgaggagggcagcaccatcagctgtgtggtggagaggaccaggggggccctggactatgtgcacgtgttctacaccatcagccagattgaaacagatggcatcaactacctggtggatgactttgccaatgccagcggcaccatcaccttcctgccctggcagaggtctgaggtgctgaacatctacgtgctggatgatgacatccctgagctgaatgagtacttccgggtgaccctggtgtctgccatccctggagatggcaagctgggcagcacccccaccagcggggccagcattgatcctgagaaggagaccacagacatcaccatcaaggccagtgaccacccctacggcctgctgcagttcagcacaggcctgcccccccagcccaaggatgccatgaccctgcctgccagctctgtgccccacatcaccgtggaggaggaggatggagagatccggctgctggtgatccgggcccagggcctgctgggccgggtgacagctgagttcagaacagtgtccctgacagccttcagccctgaggactaccagaatgtggccggcaccctggagttccagcctggagagcgctacaagtacatcttcatcaacatcacagacaacagcatccctgagctggagaagagcttcaaggtggagctgctgaacctggagggcggcgtggccgagctgttccgggtggatggcagcggcagcggagatggagacatggagttcttcctgcccaccatccacaagagggccagcctgggcgtggccagccagatcctggtgaccatcgccgccagtgaccacgcccatggagtgtttgagttcagccctgagagcctgtttgtgtctggaacagagccagaagatggctacagcacagtgaccctgaatgtcatccgccaccacggcaccctgagccctgtgaccctgcactggaacatcgacagcgaccctgatggagacctggccttcaccagcggcaacatcacctttgagatcggccagaccagcgccaacatcaccgtggagatcctgcctgatgaagatcctgagctggacaaggccttctctgtgtctgtgctgtctgtgagcagcggcagcctgggcgcccacatcaatgccaccctgactgtgctggccagtgatgacccctacggcatcttcatcttcagcgagaagaacagacctgtgaaggtggaggaggccacccagaacatcaccctgagcatcatccggctgaagggcctgatgggcaaggtgctggtgtcctatgccaccctggatgacatggagaagccaccctacttcccccccaacctggcccgggccacccagggccgggactacatcccagccagcggctttgccctgtttggagccaaccagagcgaggccaccatcgccatcagcatcctggatgatgatgagcctgagaggtctgagagcgtcttcatcgagctgctgaacagcaccctggtggccaaggtgcagagccgcagcatccccaacagcccccggctgggccccaaggtggagaccatcgcccagctgatcatcatcgccaatgatgatgccttcggcaccctgcagctgagcgcccccatcgtgcgggtggctgaaaatcatgtgggccccatcatcaacgtgaccaggactggaggagcctttgctgatgtgtctgtgaagttcaaggctgtgcccatcacagccatcgccggggaggactacagcatcgccagcagtgatgtggtgctgctggagggggagaccagcaaggctgtgcccatctacgtgatcaatgacatctacccagagctggaggagagcttcctggtgcagctgatgaatgagaccaccggcggggcccggctgggcgccctgacagaagctgtgatcatcatcgaggccagtgatgacccctacggcctgtttggcttccagatcaccaagctgattgtggaggagcctgagttcaacagcgtgaaggtgaacctgcccatcatccggaacagcggcaccctgggcaatgtgacagtgcagtgggtggccaccatcaatggccagctggccaccggggacctgcgggtggtgtctggaaatgtgacctttgcccctggcatgagcagctaccccagcgccaccaactag

SEQ ID NO: 153311 - DNA, 18921 bp, Artificial Sequence
  Description of Artificial Sequence: Synthetic coding sequence
atgtctgtgttcctgggccctggcatgcccagcgccagcctgctggtgaacctgctgagcgccctgctgatcctgtttgtgtttggagaaacagagatccgcttcaccggccagacagaatttgtggtgaatgagaccagcaccaccgtcatccgcctcatcatcgagcgcatcggggagcccgccaacgtgacagccatcgtgtccctgtatggagaagatgctggggacttctttgacacctatgctgctgccttcatcccagctggggagaccaacagaacagtgtacatcgctgtgtgtgatgatgacctgcctgagccagatgagaccttcatcttccacctgaccctgcagaagcccagcgccaacgtgaagctgggctggcccaggacagtgacagtgaccatcctgagcaatgacaatgccttcggcatcatctccttcaacatgctgcccagcattgctgtgtctgagcccaagggcagaaatgaatccatgcccctgaccctcatccgggagaagggcacctacggcatggtgatggtgacctttgaggtggagggcggccccaaccccccagatgaggacctgagccctgtgaagggcaacatcaccttccccccaggccgggccaccgtcatctacaacctgactgtgctggatgatgaggtgcctgaaaatgatgagatcttcctgatccagctgaagtctgtggagggcggcgctgagatcaacaccagcagaaattccattgagatcatcatcaagaagaatgacagccctgtgcgcttcctgcagagcatctacctggtgcctgaggaggaccacatcctgatcatccctgtggtgcggggcaaggacaacaacggcaacctgattggaagtgatgaatatgaggtgtccatctcctatgctgtgaccactggaaacagcacagcccacgcccagcagaacctggacttcatcgacctgcagcccaacaccaccgtggtgttcccccccttcatccacgagagccacctgaagttccagatcgtggatgacaccatccctgagattgctgagagcttccacatcatgctgctgaaggacaccctgcagggagatgctgtgctgatcagccccagcgtggtgcaggtgaccatcaagcccaatgacaagccctacggcgtgctgtccttcaacagcgtgctgtttgagaggacagtcatcattgatgaggaccgcatcagccgctatgaggagatcaccgtggtgagaaatggaggcacccacggcaatgtgtctgccaactgggtgctgaccaggaacagcacagaccccagccctgtgacagctgacatccggcccagcagtggagtgctgcactttgcccagggccagatgctggccaccatccccctgactgtggtggatgatgacctgcctgaggaggccgaggcctacctgctgcagatcctgccccacaccatccggggcggcgctgaggtgtctgagcctgctgagctgctcttctacatccaggacagtgatgatgtgtatggcctcatcaccttcttccccatggagaaccagaagattgagagcagccctggagagcgctacctgagcctgtccttcacccggctgggcggcaccaagggagatgtgcggctgctgtacagcgtgctgtacatcccagctggagctgtggaccccctgcaggccaaggagggcatcctgaacatcagcagaagaaatgacctgatcttccctgagcagaagacccaggtgaccaccaagctgcccatcagaaatgatgccttcctgcagaatggagcccacttcctggtgcagctggagaccgtggagctgctgaacatcatccccctcatcccccccatcagccccaggtttggagagatctgcaacatcagcctgctggtgaccccagccatcgccaatggagagatcggcttcctgagcaacctgcccatcatcctgcacgagcctgaggactttgctgctgaggtggtgtacatccccctgcacagagatggaacagatggccaggccaccgtgtactggagcctgaagcccagcggcttcaacagcaaggctgtgaccccagatgacatcggccccttcaatggatctgtgctcttcctgagcggccagagcgacaccaccatcaacatcaccatcaagggagatgacatccctgagatgaatgagaccgtgaccctgagcctggacagagtgaatgtggagaaccaggtgctgaagagcggctacaccagccgggacctgatcatcctggagaatgatgaccccggcggcgtgtttgagttcagccctgccagccggggcccctacgtgatcaaggagggggagagcgtggagctgcacatcatccgcagccggggcagcctggtgaagcagttcctgcactacagagtggagccccgggacagcaatgagttctacggcaacacaggagtgctggagttcaagccaggagagcgggagatcgtcatcaccctgctggcccggctggatggcatccctgagctggatgagcactactgggtggtgctgagcagccatggagagcgggagagcaagctgggcagcgccaccatcgtgaacatcaccatcctgaagaatgatgacccccacggcatcatcgagtttgtgtctgatggcctcatcgtgatgatcaatgaaagcaaaggagatgccatctacagcgctgtgtatgatgtggtgaggaacagaggcaactttggagatgtgtctgtgtcctgggtggtgtccccagacttcacccaggatgtgtttcctgtgcagggcaccgtggtgtttggagaccaggagttcagcaagaacatcaccatctacagcctgcctgatgagatccctgaggagatggaggagttcaccgtcatcctgctgaatggcaccggcggggccaaggtgggcaacagaaccacagccaccctgcgcatcagaagaaatgatgaccccatctactttgctgagccccgggtggtgcgggtgcaggagggggagacagccaacttcaccgtgctgagaaatggatctgtggatgtgacctgcatggtgcagtatgccaccaaggatggcaaggccacagcccgggagcgggacttcatccctgtggagaagggggagaccctcatctttgaggtgggcagccggcagcagagcatcagcatctttgtgaatgaagatggcatccctgagacagatgagcccttctacatcatcctgctgaacagcactggagacacagtggtgtaccagtatggagtggccaccgtcatcatcgaggccaatgatgaccccaacggcatcttcagcctggagcccatcgacaaggctgtggaggagggcaagaccaatgccttctggatcctgcggcaccggggctactttggatctgtgtctgtgtcctggcagctgttccagaatgattctgccctgcagcccggccaggagttctatgagaccagcggcaccgtgaacttcatggatggagaggaggccaagcccatcatcctgcacgccttcccagacaagatccctgagttcaatgagttctacttcctgaagctggtgaacatcagcggcggcagccctggccctgggggccagctggccgagaccaacctgcaggtgacagtgatggtgcccttcaatgatgacccctttggagtcttcatcctggaccctgaatgtctggagcgggaggtggctgaagatgtgctgtctgaagatgacatgagctacatcaccaacttcaccatcctgcggcagcagggcgtgtttggagatgtgcagctgggctgggagatcctgagcagcgagttccctgctggcctgccccccatgattgacttcctgctggtgggcatcttccccaccaccgtgcacctgcagcagcacatgagaagacaccacagcggcacagatgccctgtacttcaccggcctggagggcgcctttggaacagtgaaccccaagtaccaccccagcaggaacaacaccatcgccaacttcaccttcagcgcctgggtgatgcccaatgccaacaccaacggcttcatcatcgccaaggatgatggaaatggcagcatctactatggagtgaagatccagaccaatgaaagccacgtgaccctgagcctgcactacaagaccctgggcagcaatgccacctacatcgccaagaccaccgtgatgaagtacctggaggagagcgtgtggctgcacctgctgatcatcctggaggatggcatcatcgagttctacctggatggaaatgccatgccccggggcatcaagagcctgaagggggaggccatcacagatggccctggcatcctgcgcatcggggccggcatcaatggaaatgaccgcttcaccggcctgatgcaggatgtgcgctcctatgaaaggaagctgaccctggaggagatctatgagctgcacgccatgcctgccaagagtgacctgcaccccatcagcggctacctggagttccggcagggcgagaccaacaagagcttcatcatcagcgccagagatgacaatgatgaggagggggaggagctgttcatcctgaagctggtgtctgtgtatggaggagcccgcatcagcgaggagaacaccacagcccggctgaccatccagaagagtgacaatgccaacggcctgtttggcttcaccggggcctgcatccctgagattgctgaggagggcagcaccatcagctgtgtggtggagaggaccaggggggccctggactatgtgcacgtgttctacaccatcagccagattgaaacagatggcatcaactacctggtggatgactttgccaatgccagcggcaccatcaccttcctgccctggcagaggtctgaggtgctgaacatctacgtgctggatgatgacatccctgagctgaatgagtacttccgggtgaccctggtgtctgccatccctggagatggcaagctgggcagcacccccaccagcggggccagcattgatcctgagaaggagaccacagacatcaccatcaaggccagtgaccacccctacggcctgctgcagttcagcacaggcctgcccccccagcccaaggatgccatgaccctgcctgccagctctgtgccccacatcaccgtggaggaggaggatggagagatccggctgctggtgatccgggcccagggcctgctgggccgggtgacagctgagttcagaacagtgtccctgacagccttcagccctgaggactaccagaatgtggccggcaccctggagttccagcctggagagcgctacaagtacatcttcatcaacatcacagacaacagcatccctgagctggagaagagcttcaaggtggagctgctgaacctggagggcggcgtggccgagctgttccgggtggatggcagcggcagcggagatggagacatggagttcttcctgcccaccatccacaagagggccagcctgggcgtggccagccagatcctggtgaccatcgccgccagtgaccacgcccatggagtgtttgagttcagccctgagagcctgtttgtgtctggaacagagccagaagatggctacagcacagtgaccctgaatgtcatccgccaccacggcaccctgagccctgtgaccctgcactggaacatcgacagcgaccctgatggagacctggccttcaccagcggcaacatcacctttgagatcggccagaccagcgccaacatcaccgtggagatcctgcctgatgaagatcctgagctggacaaggccttctctgtgtctgtgctgtctgtgagcagcggcagcctgggcgcccacatcaatgccaccctgactgtgctggccagtgatgacccctacggcatcttcatcttcagcgagaagaacagacctgtgaaggtggaggaggccacccagaacatcaccctgagcatcatccggctgaagggcctgatgggcaaggtgctggtgtcctatgccaccctggatgacatggagaagccaccctacttcccccccaacctggcccgggccacccagggccgggactacatcccagccagcggctttgccctgtttggagccaaccagagcgaggccaccatcgccatcagcatcctggatgatgatgagcctgagaggtctgagagcgtcttcatcgagctgctgaacagcaccctggtggccaaggtgcagagccgcagcatccccaacagcccccggctgggccccaaggtggagaccatcgcccagctgatcatcatcgccaatgatgatgccttcggcaccctgcagctgagcgcccccatcgtgcgggtggctgaaaatcatgtgggccccatcatcaacgtgaccaggactggaggagcctttgctgatgtgtctgtgaagttcaaggctgtgcccatcacagccatcgccggggaggactacagcatcgccagcagtgatgtggtgctgctggagggggagaccagcaaggctgtgcccatctacgtgatcaatgacatctacccagagctggaggagagcttcctggtgcagctgatgaatgagaccaccggcggggcccggctgggcgccctgacagaagctgtgatcatcatcgaggccagtgatgacccctacggcctgtttggcttccagatcaccaagctgattgtggaggagcctgagttcaacagcgtgaaggtgaacctgcccatcatccggaacagcggcaccctgggcaatgtgacagtgcagtgggtggccaccatcaatggccagctggccaccggggacctgcgggtggtgtctggaaatgtgacctttgcccctggagagaccatccagaccctgctgctggaggtgctggctgatgatgtgcctgagattgaggaggtgatccaggtgcagctgacagatgccagcggcggcggcaccatcggcctggacagaattgccaacatcatcatcccagccaatgatgacccctatggaacagtggcctttgcccagatggtgtacagagtgcaggagcccctggagaggagcagctgtgccaacatcaccgtgcggcgcagcggcggccacttcggccgcctgctgctcttctacagcaccagtgacattgatgtggtggccctggccatggaggagggccaggacctgctgagctactatgagagccccatccagggcgtgcctgaccccctgtggaggacctggatgaatgtgtctgctgtgggggagcccctgtacacctgtgccaccctgtgcctgaaggagcaggcctgcagcgccttctccttcttcagcgccagcgagggcccccagtgcttctggatgacctcctggatcagccctgctgtgaacaacagcgacttctggacctacaggaagaacatgaccagggtggccagcctcttcagcggccaggccgtggccggcagtgactatgagcctgtgacccggcagtgggccatcatgcaggagggagatgaatttgccaacctgactgtgtccatcctgcctgatgacttccctgagatggatgagagcttcctgatcagcctgctggaggtgcacctgatgaacatcagcgccagcctgaagaaccagcccaccatcggccagcccaacatcagcacagtggtgattgccctgaatggagatgcctttggagtgtttgtgatctacaacatcagccccaacaccagtgaagatggcctgtttgtggaggtgcaggagcagccccagaccctggtggagctgatgatccacaggactggaggcagcctgggccaggtggccgtggagtggagggtggtgggcggcacagccacagagggcctggacttcatcggggccggggagatcctgacctttgctgagggggagaccaagaagacagtcatcctgaccatcctggatgattctgagccagaagatgatgagagcatcatcgtgtccctggtgtacacagagggcggcagccgcatcctgcccagcagtgacacagtgcgggtgaacatcctggccaatgacaacgtggccggcatcgtgtccttccagacagccagccgctctgtgattggacatgaaggagagatcctgcagttccacgtgatccgcaccttccctggaagaggaaatgtgacagtgaactggaagatcatcggccagaacctggagctgaactttgccaacttcagcggccagctgttcttccctgagggcagcctgaacaccaccctgtttgtgcacctgctggatgacaacatccctgaggagaaggaggtgtaccaggtgatcctgtatgatgtgaggacccagggcgtgcccccagctggcatcgccctgctggatgcccagggctatgctgctgtgctgactgtggaggccagtgatgagccccatggagtgctgaactttgccctgagcagcagatttgtgctgctgcaggaggccaacatcaccatccagctgttcatcaaccgggagtttggcagcctgggcgccatcaacgtgacctacaccaccgtgcccggcatgctgagcctgaagaaccagacagtgggcaacctggccgagcctgaggtggactttgtgcccatcatcggcttcctgatcctggaggagggggagacagctgctgccatcaacatcaccatcctggaggatgatgtgcctgagctggaggagtacttcctggtgaacctgacctacgtgggcctgaccatggccgccagcaccagcttccccccccggctggacagcgagggcctgacagcccaggtgatcattgatgccaatgatggagcccggggcgtcatcgagtggcagcagagcagatttgaggtgaatgagacccacggcagcctgaccctggtggcccagaggagccgggagcccctgggccacgtgtccctgtttgtgtatgcccagaacctggaggcccaggtgggcctggactacatcttcacccccatgatcctgcactttgctgatggagagcgctacaagaatgtgaacatcatgatcctggatgatgacatcccagaaggagatgagaagttccagctgatcctgaccaaccccagccctggcctggagctgggcaagaacaccatcgccctgatcatcgtgctggccaatgatgatggccctggggtgctgtccttcaacaacagcgagcacttcttcctgcgggagcccacagccctgtatgtgcaggagagcgtggccgtgctgtacatcgtgcgggagcccgcccagggcctgtttggcaccgtgacagtgcagttcatcgtgacagaggtgaacagcagcaatgaaagcaaggacctgacccccagcaagggctacatcgtgctggaggagggcgtgcgcttcaaggccctgcagatcagcgccatcctggacacagagcctgagatggatgagtactttgtgtgcaccctcttcaaccccactggaggagcccggctgggcgtgcacgtgcagaccctcatcaccgtgctgcagaaccaggcccccctgggcctcttcagcatctctgctgtggagaacagagccaccagcattgacatcgaggaggccaacagaacagtgtacctgaatgtgtccaggaccaatggaattgacctggccgtgtctgtgcagtgggagaccgtgtctgaaacagccttcggcatgaggggcatggatgtggtgttttctgtgttccagagcttcctggatgagagcgccagcggctggtgcttcttcaccctggagaacctgatctacggcatcatgctgaggaagagctctgtgacagtgtaccgctggcagggcatcttcatccctgtggaggacctgaacatcgagaaccccaagacctgtgaggccttcaacatcggcttcagcccctactttgtgatcacccatgaggagagaaatgaggagaagcccagcctgaacagcgtcttcaccttcaccagcggcttcaagctgttcctggtgcagaccatcatcatcctggagagcagccaggtgcgctacttcaccagtgacagccaggactacctgatcatcgccagccagagagatgattctgagctgacccaggtgttccgctggaatggaggcagctttgtgctgcaccagaagctgcctgtgcggggcgtgctgactgtggccctcttcaacaagggcggcagcgtcttcctggccatcagccaggccaatgcccggctgaacagcctgctcttccgctggagcggcagcggcttcatcaacttccaggaggtgcctgtgtctggcaccacagaggtggaggccctgagcagcgccaatgacatctacctgatctttgctgaaaatgtgttcctgggggaccagaacagcattgacatcttcatctgggagatgggccagagcagcttccgctacttccagagcgtggactttgctgctgtgaaccgcatccacagcttcaccccagccagcggcatcgcccacatcctgctgattggccaggacatgtctgccctgtactgctggaacagcgagaggaaccagttctcctttgtgctggaggtgcccagcgcctatgatgtggcctctgtgacagtgaagagcctgaacagcagcaagaacctgattgccctggtgggcgcccacagccacatctatgagctggcctacatcagcagccacagcgacttcatccccagcagtggagagctgatctttgagcccggggagcgggaggccaccatcgctgtgaacatcctggatgacacagtgcctgagaaggaggagagcttcaaggtgcagctgaagaaccccaagggcggcgctgagatcggcatcaatgattctgtgaccatcaccatcctgagcaatgatgatgcctatggaattgtggcctttgcccagaacagcctgtacaagcaggtggaggagatggagcaggacagcctggtgaccctgaatgtggagcggctgaagggcacctacggccgcatcaccatcgcctgggaggctgatggcagcatcagtgacatcttccccaccagcggggtcatcctcttcacagagggccaggtgctgagcaccatcaccctgaccatcctggccgacaacatccctgagctgtctgaggtggtgattgtgaccctgacccgcatcaccacagagggcgtggaggacagctacaagggggccaccatcgaccaggacaggagcaagagcgtcatcaccaccctgcccaatgacagccccttcggcctggtgggctggagggctgcctctgtgttcatccgggtggccgagcccaaggagaacaccaccaccctgcagctgcagatcgcccgggacaagggcctgctgggggacatcgccatccacctgcgggcccagcccaacttcctgctgcacgtggacaaccaggccacagaaaatgaagattatgtgctgcaggagaccatcatcatcatgaaggagaacatcaaggaggcccacgccgaggtgtccatcctgcctgatgacctgcctgagctggaggagggcttcatcgtgaccatcacagaggtgaacctggtgaacagcgacttcagcacaggccagcccagcgtgcggcggcccggcatggagattgctgagatcatgattgaagaaaatgatgacccccggggcatcttcatgttccacgtgaccagaggagctggggaggtgatcacagcctatgaggtgcccccacccctgaatgtgctgcaggtgcctgtggtgcggctggccggcagctttggagctgtgaatgtgtactggaaggccagcccagattctgctggcctggaggacttcaagcccagccacggcatcctggagtttgctgacaagcaggtgacagccatgattgagatcaccatcattgatgatgctgagtttgagctgacagagaccttcaacatcagcctcatctctgtggccggcggcggccgcctgggagatgatgtggtggtgacagtggtgatcccccagaatgacagcccctttggagtgtttggatttgaggagaagacagtgatgattgatgagagcctgagcagtgatgatcctgacagctatgtgaccctgactgtggtgcgcagccctgggggcaaaggaacagtgcggctggagtggaccattgatgagaaggccaagcacaacctgagccccctgaatggcaccctgcactttgatgaaacagagagccagaagaccatcgtgctgcacaccctgcaggacacagtgctggaggaggaccggcgcttcaccatccagctgatcagcattgatgaggtggagatcagccctgtgaagggcagcgccagcatcatcatccggggggacaagagggccagcggggaggtgggcatcgcccccagcagccgccacatcctgattggagagcccagcgccaagtacaacggcacagccatcatcagcctggtgcggggccctggcatcctgggggaggtgaccgtcttctggaggatcttccccccatctgtgggggagtttgctgagaccagcggcaagctgaccatgagagatgagcagagcgctgtgattgtggtgatccaggccctgaatgatgacatccctgaggagaagagcttctatgagttccagctgacagctgtgtctgagggcggcgtgctgtctgagagcagcagcacagccaacatcaccgtggtggccagtgacagcccctacggccgctttgccttcagccatgagcagctgcgggtgtctgaggcccagagggtgaacatcaccatcatccgcagcagcggggactttggacatgtgcggctgtggtacaagaccatgagcggcacagctgaggccggcctggactttgtgcctgctgctggggagctgctgtttgaggccggggagatgaggaagagcctgcacgtggagatcctggatgatgactacccagagggccctgaggagttcagcctgaccatcaccaaggtggagctgcagggccggggctatgacttcaccatccaggagaatggcctgcagattgaccagcccccagagatcggcaacatcagcatcgtgcgcatcatcatcatgaagaatgacaatgctgagggcatcatcgagtttgaccccaagtacacagcctttgaggtggaggaggatgtgggcctcatcatgatccctgtggtgcggctgcacggcacctacggctacgtgacagctgacttcatcagccagagcagcagcgccagccctggaggagtggactacatcctgcacggcagcacagtgaccttccagcacggccagaacctgtccttcatcaacatcagcatcattgatgacaatgaaagtgaatttgaggagcccatcgagatcctgctgactggagccaccggcggcgctgtgctgggccgccacctggtgagccgcatcatcatcgccaagagtgacagcccctttggagtcatccgcttcctgaaccagagcaagatcagcatcgccaaccccaacagcaccatgatcctgagcctggtgctggagaggactggaggcctgctgggggagatccaggtgaactgggagaccgtgggccccaacagccaggaggccctgctgccccagaacagagacattgctgaccctgtgtctggcctcttctactttggagagggggagggcggcgtgaggaccatcatcctgaccatctacccccatgaggagattgaggtggaggagaccttcatcatcaagctgcacctggtgaagggggaggccaagctggacagccgggccaaggatgtgaccctgaccatccaggagtttggagaccccaatggagtggtgcagtttgcccctgagaccctgagcaagaagacctacagcgagcccctggccctggagggccccctgctgatcaccttctttgtgagaagagtgaagggcacctttggagagatcatggtgtactgggagctgagcagcgagtttgacatcacagaggacttcctgagcaccagcggcttcttcaccatcgcagatggagagagcgaggccagctttgatgtgcacctgctgcctgatgaggtgcctgagattgaggaggactatgtgatccagctggtgtctgtggagggcggcgctgagctggacctggagaagagcatcacctggttctctgtgtatgccaatgatgacccccatggagtgtttgccctgtacagcgaccggcagagcatcctgattggccagaacctgatccgcagcatccagatcaacatcacccggctggccggcacctttggagatgtggccgtgggcctgcgcatcagcagtgaccacaaggagcagcccatcgtgacagaaaatgctgagcggcagctggtggtgaaggatggagccacctacaaggtggatgtggtgcccatcaagaaccaggtgttcctgagcctgggcagcaacttcaccctgcagctggtgacagtgatgctggtgggcggccgcttctacggcatgcccaccatcctgcaggaggccaagtctgctgtgctgcctgtgtctgagaaggccgccaacagccaggtgggctttgagagcacagccttccagctgatgaacatcacagctggcaccagccacgtgatgatcagcagaagaggcacctatggagccctgtctgtggcctggaccaccggctacgcccctggcctggagatccctgagttcatcgtggtgggcaacatgacccccaccctgggcagcctgtccttcagccacggggagcagaggaaaggagtcttcctgtggaccttccccagccctggctggccagaggcctttgtgctgcacctgagcggcgtgcagagcagcgcccctggaggagcccagctgcggagcggcttcatcgtggccgagattgagcccatgggcgtcttccagttcagcaccagcagcaggaacatcatcgtgtctgaggacacccagatgatccggctgcacgtgcagaggctgtttggcttccacagcgacctgatcaaggtgtcctaccagaccacagctggcagcgccaagcccctggaggactttgagcctgtgcagaatggagagctgttcttccagaagttccagacagaggtggactttgagatcaccatcatcaatgaccagctgtctgaaattgaggagttcttctacatcaacctgacctctgtggagatccggggcctgcagaagtttgatgtgaactggagcccccggctgaacctggacttctctgtggccgtcatcaccatcctggacaatgatgacctggccggcatggacatctccttccctgagaccaccgtggccgtggccgtggacaccaccctcatccctgtggagacagagagcaccacctacctgagcaccagcaagaccaccaccatcctgcagcccaccaacgtggtggccatcgtgacagaggccactggagtgtctgccatccctgagaagctggtgaccctgcacggcaccccagctgtgtctgagaagccagatgtggccaccgtgacagccaacgtgtccatccacggcaccttcagcctgggccccagcatcgtgtacatcgaggaggagatgaagaatggcaccttcaacacagctgaggtgctgatccggaggactggaggcttcaccggaaatgtgtccatcaccgtgaagaccttcggggagcgctgtgcccagatggagcccaatgccctgcccttccggggcatctacggcatcagcaacctgacctgggccgtggaggaggaggactttgaggagcagaccctgaccctcatcttcctggatggagagcgggagaggaaggtgtctgtgcagatcctggatgatgatgagcctgagggccaggagttcttctacgtgttcctgaccaacccccagggcggggcccagatcgtggaggagaaggatgacaccggctttgctgcctttgccatggtgatcatcactggaagtgacctgcacaacggcatcatcggcttcagcgaggagagccagagcggcctggagctgcgggagggcgctgtgatgaggcggctgcacctgattgtgacccggcagcccaacagagcctttgaagatgtgaaggtgttctggagggtgaccctgaacaagacagtggtggtgctgcagaaggatggagtgaacctggtggaggagctgcagagcgtgtctggcaccaccacctgcaccatgggccagaccaagtgcttcatcagcattgagctgaagccagagaaggtgccccaggtggaggtgtacttctttgtggagctgtatgaggccacagctggagctgccatcaacaacagcgccaggtttgcccagatcaagatcctggagagtgatgagagccagagcctggtgtacttctctgtgggcagccggctggccgtggcccacaagaaggccaccctcatcagcctgcaggtggcccgggacagcggcaccggcctgatgatgtctgtgaacttcagcacccaggagctgcggtctgctgagaccatcggccgcaccatcatcagccctgccatcagcggcaaggactttgtgatcacagagggcaccctggtgtttgagcccggccagaggagcacagtgctggatgtgatcctgaccccagagaccggcagcctgaacagcttccccaagcgcttccagatcgtgctgtttgaccccaagggcggggccagaattgacaaggtgtatggaacagccaacatcaccctggtgtctgatgctgacagccaggccatctggggcctggccgaccagctgcaccagcctgtgaatgatgacatcctgaacagagtgctgcacaccatctccatgaaggtggccacagagaacacagatgagcagctgagcgccatgatgcacctgattgagaagatcaccacagagggcaagatccaggccttctctgtggccagcaggaccctcttctatgagatcctgtgcagcctcatcaaccccaagaggaaggacacccggggcttcagccactttgctgaggtgacagaaaattttgccttcagcctgctgaccaacgtgacctgtggcagccctggagagaagagcaagaccatcctggacagctgcccctacctgagcatcctggccctgcactggtacccccagcagatcaatggccacaagtttgagggcaaggagggggactacatccgcatccctgagcggctgctggatgtgcaggatgctgagatcatggccggcaagagcacctgcaagctggtgcagttcacagagtacagcagccagcagtggttcatcagcggcaacaacctgcccaccctgaagaacaaggtgctgagcctgtctgtgaagggccagagcagccagctgctgaccaatgacaatgaggtgctgtaccgcatctatgctgctgagccccgcatcatcccccagaccagcctgtgcctgctgtggaaccaggccgccgcctcctggctgagtgacagccagttctgcaaggtggtggaggagacagctgactatgtggagtgtgcctgcagccacatgtctgtgtatgctgtgtatgccaggacagacaacctgagcagctacaatgaggccttcttcaccagcggcttcatctgcatcagcggcctgtgcctggccgtgctgagccacatcttctgtgcccgctacagcatgtttgctgccaagctgctgacccacatgatggccgccagcctgggcacccagatcctcttcctggccagcgcctatgccagcccccagctggccgaggagagctgcagcgccatggctgctgtgacccactacctgtacctgtgccagttctcctggatgctgatccagagcgtgaacttctggtacgtgctggtgatgaatgatgagcacacagagcggcgctacctgctcttcttcctgctgtcctggggcctgcctgcctttgtggtgatcctgctgattgtcatcctgaagggcatctaccaccagagcatgagccagatctacggcctcatccacggggacctgtgcttcatccccaacgtgtatgctgccctcttcaccgctgccctggtgcccctgacctgcctggtggtggtgtttgtggtgttcatccacgcctaccaggtgaagccccagtggaaggcctatgatgatgtgttccggggccgcaccaatgctgctgagatccccctcatcctgtacctgtttgccctgatctctgtgacctggctgtggggcggcctgcacatggcctaccgccacttctggatgctggtgctgtttgtgatcttcaacagcctgcagggcctgtatgtgttcatggtgtacttcatcctgcacaaccagatgtgctgccccatgaaggccagctacacagtggagatgaatggccaccctggccccagcacagccttcttcaccccaggcagcggcatgcctcctgctggaggagagatcagcaagagcacccagaacctgattggagccatggaggaggtgcccccagactgggagcgggccagcttccagcagggcagccaggccagcccagacctgaagcccagcccccagaatggagccaccttccccagcagcggcggctacggccagggcagcctgattgctgatgaggagagccaggagtttgatgacctgatctttgccctgaagacaggagctggcctgtctgtgtctgacaatgaaagtggccagggcagccaggagggcggcaccctgacagacagccagatcgtggagctgcggcgcatccccatcgctgacacccacctgtag

SEQ ID NO: 153312 - DNA, 4188 bp, Artificial Sequence
  Description of Artificial Sequence: Synthetic coding sequence
atgaccggggctgagattgagagcggggcccaggtgaagccagagaagaagccaggagaggaggtggtgggcggcgctgagattgaaaatgatgtgcccctggtggtgcggcccaaggtgaggacccaggcccagatcatgcctggggcccggcccaagaacaagagcaaggtgatgcctggggccagcaccaaggtggagaccagcgctgtgggcggggcccggcccaagagcaaggccaaggccatccctgtgagccgcttcaaggaggaggcccagatgtgggcccagcccaggtttggagctgagcggctgagcaagacagagaggaacagccagaccaacatcatcgccagccccctggtgtccacagacagcgtgctggtggccaagaccaagtacctgtctgaagatcgggagctggtgaacacagacacagagagcttccccaggaggaaggcccactaccaggccggcttccagcccagcttccgcagcaaggaggagaccaacatgggctcctggtgctgcccccggcccaccagcaagcaggaggccagccccaacagcgacttcaagtgggtggacaagtctgtgagcagcctcttctggagcggagatgaggtgacagccaagttccaccctggcaacagagtgaaggacagcaacagatccatgcacatggccaaccaggaggccaacaccatgagccgcagccagaccaaccaggagctgtacatcgccagcagcagcggctctgaagatgaatctgtgaagaccccctggttctgggcccgggacaagaccaacacctggagcggcccccgggaggaccccaacagccgcagccgcttccgcagcaagaaggaggtgtatgtggagagcagcagcggcagcgagcacgaggaccacctggagagctggtttggagctgggaaggaggccaagttccgcagcaagatgagagctgggaaggaggccaacaacagagcccggcaccgggccaagcgggaggcctgcatcgacttcatgcctggcagcattgatgtgatcaagaaggagagctgcttctggccagaagaaaatgccaacaccttcagccggcccatgatcaagaaggaggcccgggcccgggccatgaccaaggaggaggccaagaccaaggcccgggcccgggccaagcaggaggcccggtctgaggaggaggccctgattggcacctggttctgggccacagatgagagctccatggctgatgaggccagcattgagagcagcctgcaggtggaggatgagagcatcatcggctcctggttctggacagaggaggaggcctccatgggcactggagccagcagcaagagccggcccaggacagatggagagcgcatcggggacagcctgtttggagcccgggagaagacctccatgaagacaggagctgaggccaccagcgagagcatcctggccgcagatgatgagcaggtgatcatcggctcctggttctgggccggggaggaggtgaaccaggaggccgaggaggagaccatcttcggctcctggttctgggtgattgatgctgcctctgtggagagcggcgtgggcgtgtcctgtgagagcaggaccaggtctgaggaggaggaggtgattggcccctggttctggagcggggagcaggtggacatcgaggccggcatcggggaggaggcccggcctggagctgaggaggagaccatcttcggctcctggttctgggccgagaaccagacctacatggactgcagagctgagaccagctgtgacaccatgcagggcgctgaggaggaggagcccatcatcggctcctggttctggaccagggtggaggcctgtgtggagggagatgtgaacagcaagagcagcctggaggacaaggaggaggccatgatcccctgcttcggggccaaggaggaggtgtccatgaagcacggcaccggggtgcgctgccgcttcatggccggggctgaggagaccaacaacaagagctgcttctgggccgagaaggagccctgcatgtacccagctgggggcggctcctggaagagcaggcctgaggaggaggaggacatcgtgaacagctggttctggagcaggaagtacaccaagccagaggccatcatcggctcctggctgtgggccacagaggagagcaacattgatggcactggagagaaggccaagctgctgacagaggaggagaccatcatcaacagctggttctggaaggaggatgaggccatcagcgaggccacagaccgggaggagagcaggcctgaggccgaggagggggacatcatcggctcctggttctgggccggggaggaggaccggctggagcctgctgctgagacccgggaggaggaccggctggccgctgagaaggagggcatcgtgggctcctggtttggagcccgggaggagaccatcagaagagaggccggcagctgcagcaagagcagccccaaggccgaggaggaggaggtgatcatcggctcctggttctgggaggaggaggccagccctgaggccgtggccggcgtgggctttgagagcaagccaggcacagaggaggaggagatcaccgtgggctcctggttctggccagaggaggaggccagcatccaggccggcagccaggccgtggaggagatggagagcgagacagaggaggagaccatcttcggctcctggttctgggatggcaaggaggtgtctgaggaggccggcccctgctgcgtgtccaagccagaagatgatgaggagatgattgtggagagctggttctggagccgggacaaggccatcaaggagactggaacagtggccacctgtgagagcaagccagaaaatgaggagggcgccatcgtgggctcctggtttgaagcagaagatgaggtggacaacagaacagacaatggcagcaactgtggcagcaggaccctggctgatgaagatgaggccatcgtgggctcctggttctgggccggagatgaggcccactttgagagcaaccccagccctgtgttccgggccatctgccgcagcacctgcagcgtggagcaggagccagaccccagccggcggccccagagctgggaggaggtgacagtgcagttcaagccaggcccctggggccgggtgggcttccccagcatcagccccttccgcttccccaaggaggccgccagcctcttctgtgagatgtttggaggcaagcccaggaacatggtgctgagccctgagggggaggaccaggagagcctgctgcagcctgaccagcccagccctgagttccccttccagtatgaccccagctacagatctgtgcaggagatccgggagcacctgcgggccaaggagagcacagagcctgagagcagcagctgcaactgcatccagtgtgagctgaagattggcagcgaggagtttgaggagctgctgctgctgatggagaagatccgggaccccttcatccacgagatcagcaagatcgccatgggcatgaggtctgccagccagttcacccgggacttcatccgggacagcggcgtggtgtccctgattgagaccctgctgaactaccccagcagccgggtgaggaccagcttcctggagaacatgatccgcatggccccaccctaccccaacctgaacatcatccagacctacatctgcaaggtgtgtgaggagaccctggcctacagcgtggacagccctgagcagctgagcggcatccgcatgatccgccacctgaccaccaccacagactaccacaccctggtggccaactacatgagcggcttcctgagcctgctggccactggaaatgccaagacccgcttccacgtgctgaagatgctgctgaacctgtctgaaaatctcttcatgaccaaggagctgctgtctgctgaggccgtgtctgagttcatcggcctcttcaaccgggaggagaccaatgacaacatccagatcgtgctggccatctttgaaaatattggcaacaacatcaagaaggagaccgtcttcagtgatgatgacttcaacatcgagcccctcatcagcgccttccacaaggtggagaagtttgccaaggagctgcagggcaagacagacaaccagaatgaccctgagggggaccaggagaactag

SEQ ID NO: 153313 - DNA, 4188 bp, Artificial Sequence; identical to SEQ ID NO: 153312
  Description of Artificial Sequence: Synthetic coding sequence

SEQ ID NO: 153314 - DNA, 4188 bp, Artificial Sequence; identical to SEQ ID NO: 153312
  Description of Artificial Sequence: Synthetic coding sequence

SEQ ID NO: 153315 - DNA, 4188 bp, Artificial Sequence; identical to SEQ ID NO: 153312
  Description of Artificial Sequence: Synthetic coding sequence

SEQ ID NO: 153316 - DNA, 1692 bp, Artificial Sequence
  Description of Artificial Sequence: Synthetic coding sequence
atggactttggcagcctggagaccgtggtggccaacagcgccttcatcgccgcccggggcagctttgatggcagcagcagccagcccagccgggacaagaagtacctggccaagctgaagctgccccccctgagcaaatgtgagagcctgcgggacagcctgagcctggagtttgagagcgtgtgcctggagcagcccatcggcaagaagctgttccagcagttcctgcagagcgctgagaagcacctgcctgccctggagctgtggaaggacattgaagattatgacacagctgacaatgacctgcagccccagaaggcccagaccatcctggcccagtacctggacccccaggccaagctgttctgcagcttcctggatgagggcatcgtggccaagttcaaggagggccctgtggagatccaggacggcctcttccagcccctgctgcaggccaccctggcccacctgggccaggcccccttccaggagtacctgggcagcctgtacttcctgcgcttcctgcagtggaagtggctggaggcccagcccatgggagaggactggttcctggacttccgggtgctgggcaagggcggctttggagaggtgtctgcctgccagatgaaggccaccgggaagctgtatgcctgcaagaagctgaacaagaagaggctgaagaagaggaagggctaccagggcgccatggtggagaagaagatcctgatgaaggtgcacagccgcttcatcgtgtccctggcctatgcctttgagaccaaggctgacctgtgcctggtgatgaccatcatgaatggaggagacatccgctaccacatctacaacgtgaatgaagaaaatcctggcttccctgagccccgggccctcttctacacagcccagatcatctgtggcctggagcacctgcaccagaggagaattgtgtacagagacctgaagccagaaaatgtgctgctggacaatgatggaaatgtgcgcatcagtgacctgggcctggccgtggagctgctggatggccagagcaagaccaagggctacgccggcaccccaggcttcatggcccctgagctgctgcagggcgaggagtatgacttctctgtggactactttgccctgggcgtgaccctgtatgagatgattgctgcccggggccccttccgggcccggggggagaaggtggagaacaaggagctgaagcaccgcatcatcagcgagcctgtgaagtacccagacaagttcagccaggccagcaaggacttctgtgaggccctgctggagaaggaccctgagaagaggctgggcttcagagatgagacctgtgacaagctgcgggcccaccccctcttcaaggacctgaactggaggcagctggaggccggcatgctgatgccacccttcatcccagacagcaagacagtgtatgccaaggacatccaggatgtgggcgccttcagcacagtgaagggcgtggcctttgacaagacagacacagagttcttccaggagtttgccactggaaactgccccatcccctggcaggaggagatgattgaaacaggcatctttggagagctgaatgtgtggaggagtgatggccagatgccagatgacatgaagggcatcagcggcggcagcagcagcagcagcaagagcggcatgtgcctggtgtcctag

SEQ ID NO: 153317 - DNA, 285 bp, Artificial Sequence
  Description of Artificial Sequence: Synthetic coding sequence
atgattgctgcccggggccccttccgggcccggggggagaaggtggagaacaaggagctgaagcaccgcatcatcagcgagcctgtgaagtacccagacaagttcagccaggccagcaaggacttctgtgaggccctgctggagaaggaccctgagaagaggctgggcttcagagatgagacctgtgacaagctgcgggcccaccccctcttcaaggacctgaactggaggcagctggaggccggcatgctgatgccacccttcatcccagacagcaagacctag

SEQ ID NO: 153318 - DNA, 228 bp, Artificial Sequence
  Description of Artificial Sequence: Synthetic coding sequence
atggagctggagaacatcgtggccaacacagtgctgctgaaggcccgggagggcggcggcggcaagaggaagggcaagagcaagaagtggaaggagatcctgaagttcccccacatcagccagtgtgaggacctgcggaggaccatcggggagctgagcggcagcctcatctcctggagcagcagcaccaaggagcacggccggcccacagagatcaagatgaggtag

SEQ ID NO: 153319 - DNA, 1458 bp, Artificial Sequence
  Description of Artificial Sequence: Synthetic coding sequence
atgaccaagtacctgacccccaagagccctgtgttcatcgcccaggtgggccaggacctggtgtcccagacagaggagaagctgctgcagaagccctgcaaggagctgttcagcgcctgtgcccagagcgtgcatgagtacctgcggggggagcccttccacgagtacctggacagcatgttctttgaccgcttcctgcagtggaagtggctggagcggcagcctgtgaccaagaacaccttccggcagtacagagtgctgggcaaaggaggctttggagaggtgtgtgcctgccaggtgcgggccaccgggaagatgtatgcctgcaagaggctggagaagaagaggatcaagaagaggaaaggagagagcatggccctgaatgagaagcagatcctggagaaggtgaacagccagtttgtggtgaacctggcctatgcctatgagaccaaggatgccctgtgcctggtgctgaccatcatgaatggaggagacctgaagttccacatctacaacatgggcaaccctggctttgaggaggagcgggccctcttctatgctgctgagatcctgtgtggcctggaggacctgcaccgggagaacacagtgtacagagacctgaagccagagaacatcctgctggatgattatggccacatccgcatcagtgacctgggcctggccgtgaagatccctgagggggacctgatccggggccgggtgggcaccgtgggctacatggcccctgaggtgctgaacaaccagagatatggcctgagcccagactactggggcctgggctgcctgatctatgagatgattgagggccagagccccttccggggcaggaaggagaaggtgaagcgggaggaggtggaccggcgggtgctggagacagaggaggtgtacagccacaagttcagcgaggaggccaagagcatctgcaagatgctgctgaccaaggatgccaagcagaggctgggctgccaggaggagggcgctgctgaggtgaagaggcaccccttcttcaggaacatgaacttcaagaggctggaggccggcatgctggaccccccatttgtgcctgaccccagggctgtgtactgcaaggatgtgctggacatcgagcagttcagcacagtgaagggcgtgaacctggaccacacagatgatgacttctacagcaagttcagcactggatctgtgtccatcccctggcagaatgagatgattgaaacagagtgcttcaaggagctgaatgtgtttggccccaacggcaccctgcccccagacctgaacagaaaccaccccccagagccccccaagaagggcctgctgcagaggctcttcaagaggcagcaccagaacaacagcaagagcagccccagcagcaagaccagcttcaaccaccacatcaacagcaaccacgtgagcagcaacagcacaggcagcagctag

SEQ ID NO: 153320 - DNA, 1773 bp, Artificial Sequence
  Description of Artificial Sequence: Synthetic coding sequence
atggagctggagaacatcgtggccaacacagtgctgctgaaggcccgggagggcggcggcggcaagaggaagggcaagagcaagaagtggaaggagatcctgaagttcccccacatcagccagtgtgaggacctgcggaggaccatcgaccgggactactgcagcctgtgtgacaagcagcccatcggccgcctgctcttccggcagttctgtgagaccaggcctggcctggagtgctacatccagttcctggacagcgtggccgagtatgaggtgaccccagatgagaagctgggggagaagggcaaggagatcatgaccaagtacctgacccccaagagccctgtgttcatcgcccaggtgggccaggacctggtgtcccagacagaggagaagctgctgcagaagccctgcaaggagctgttcagcgcctgtgcccagagcgtgcatgagtacctgcggggggagcccttccacgagtacctggacagcatgttctttgaccgcttcctgcagtggaagtggctggagcggcagcctgtgaccaagaacaccttccggcagtacagagtgctgggcaagggcggctttggagaggtgtgtgcctgccaggtgcgggccaccgggaagatgtatgcctgcaagaggctggagaagaagaggatcaagaagaggaagggggagagcatggccctgaatgagaagcagatcctggagaaggtgaacagccagtttgtggtgaacctggcctatgcctatgagaccaaggatgccctgtgcctggtgctgaccatcatgaatggaggagacctgaagttccacatctacaacatgggcaaccctggctttgaggaggagcgggccctcttctacgccgctgagatcctgtgtggcctggaggacctgcacagagaaaatacagtgtacagagacctgaagccagagaacatcctgctggatgattatggccacatccgcatcagtgacctgggcctggccgtgaagatccctgagggggacctgatccggggccgggtgggcaccgtgggctacatggcccctgaggtgctgaacaaccagagatatggcctgagcccagactactggggcctgggctgcctgatctatgagatgattgagggccagagccccttccggggcaggaaggagaaggtgaagcgggaggaggtggacagaagagtgctggagacagaggaggtgtacagccacaagttcagcgaggaggccaagagcatctgcaagatgctgctgaccaaggatgccaagcagaggctgggctgccaggaggagggcgctgctgaggtgaagaggcaccccttcttcaggaacatgaacttcaagaggctggaggccggcatgctggaccccccatttgtgcctgaccccagggctgtgtactgcaaggatgtgctggacatcgagcagttcagcacagtgaagggcgtgaacctggaccacacagatgatgacttctacagcaagttcagcacaggctctgtgtccatcccctggcagaatgagatgattgaaacagagtgcttcaaggagctgaatgtgtttggccccaacggcaccctgcccccagacctgaacagaaaccaccccccagagccccccaagaagggcctgctgcagaggctcttcaagaggcagcaccagaacaacagcaagagcagccccagcagcaagaccagcttcaaccaccacatcaacagcaaccacgtgagcagcaacagcacaggcagcagctag

SEQ ID NO: 153321 - DNA, 1200 bp, Artificial Sequence
  Description of Artificial Sequence: Synthetic coding sequence
atgaccaagtacctgacccccaagagccctgtgttcatcgcccaggtgggccaggacctggtgtcccagacagaggagaagctgctgcagaagccctgcaaggagctgttcagcgcctgtgcccagagcgtgcatgagtacctgcggggggagcccttccacgagtacctggacagcatgttctttgaccgcttcctgcagtggaagtggctggagcggcagcctgtgaccaagaacaccttccggcagtacagagtgctgggcaaaggaggctttggagaggtgtgtgcctgccaggtgcgggccaccgggaagatgtatgcctgcaagaggctggagaagaagaggatcaagaagaggaaaggagagagcatggccctgaatgagaagcagatcctggagaaggtgaacagccagtttgtggtgaacctggcctatgcctatgagaccaaggatgccctgtgcctggtgctgaccatcatgaatggaggagacctgaagttccacatctacaacatgggcaaccctggctttgaggagggcgctgctgaggtgaagaggcaccccttcttcaggaacatgaacttcaagaggctggaggccggcatgctggaccccccatttgtgcctgaccccagggctgtgtactgcaaggatgtgctggacatcgagcagttcagcacagtgaagggcgtgaacctggaccacacagatgatgacttctacagcaagttcagcactggatctgtgtccatcccctggcagaatgagatgattgaaacagagtgcttcaaggagctgaatgtgtttggccccaacggcaccctgcccccagacctgaacagaaaccaccccccagagccccccaagaagggcctgctgcagaggctcttcaagaggcagcaccagaacaacagcaagagcagccccagcagcaagagcacagtggagcccgcccagaccctgctgctgcggagcggcagcagcggggccccagccctggtgggcctgcccggggagacccctggggccggggagggcggccggcccagcagaagaagaaggaccagccgcttcctgaaggagatcagcacccaggtgtgcttcccccggcggcccaggcctggctggattggatttgtgtttggagagcactgcaacagaaaccccatcggctatgacaacctgcacgtgttctag

SEQ ID NO: 153322 - DNA, 1731 bp, Artificial Sequence
  Description of Artificial Sequence: Synthetic coding sequence
atggagctggagaacatcgtggccaacacagtgctgctgaaggcccgggagggcggcggcggcaacaggaagggcaagagcaagaagtggaggcagatgctgcagttcccccacatcagccagtgtgaggagctgcggctgagcctggagcgggactaccacagcctgtgtgagcggcagcccatcggccgcctgctcttccgggagttctgtgccaccaggcctgagctgagccgctgtgtggccttcctggatggagtggccgagtatgaggtgaccccagatgacaagaggaaggcctgtggccggcagctgacccagaacttcctgagccacactggaccagacctgatccctgaggtgccccggcagctggtgaccaactgcacccagaggctggagcagggcccctgcaaggacctcttccaggagctgacccggctgacccatgagtacctgtctgtggccccctttgctgactacctggacagcatctacttcaaccgcttcctgcagtggaagtggctggagcggcagcctgtgaccaagaacaccttccggcagtacagagtgctgggcaagggcggctttggagaggtgtgtgcctgccaggtgcgggccaccgggaagatgtatgcctgcaagaagctggagaagaagaggatcaagaagaggaagggggaggccatggccctgaatgagaagcagatcctggagaaggtgaacagcagatttgtggtgtccctggcctatgcctatgagaccaaggatgccctgtgcctggtgctgaccctgatgaatggaggagacctgaagttccacatctaccacatgggccaggccggcttccctgaggcccgggctgtgttctacgccgctgagatctgctgcggcctggaggacctgcaccgggagagaattgtgtacagagacctgaagccagagaacatcctgctggatgaccacggccacatccgcatcagtgacctgggcctggccgtgcacgtgcctgagggccagaccatcaagggccgggtgggcaccgtgggctacatggcccctgaggtggtgaagaatgaaagatacaccttctccccagactggtgggccctgggctgcctgctgtatgagatgattgctggccagagccccttccagcagaggaagaagaagatcaagcgggaggaggtggagcggctggtgaaggaggtgcctgaggagtacagcgagcgcttcagcccccaggcccggagcctgtgcagccagctgctgtgcaaggaccctgctgagcggctgggctgccggggcggcagcgcccgggaggtgaaggagcaccccctcttcaagaagctgaacttcaagaggctgggcgccggcatgctggagccccccttcaagccagacccccaggccatctactgcaaggatgtgctggacatcgagcagttcagcacagtgaagggcgtggagctggagcccacagaccaggacttctaccagaagtttgccaccggctctgtgcccatcccctggcagaatgagatggtggagacagagtgcttccaggagctgaatgtgtttggcctggatggctctgtgcccccagacctggactggaagggccagcccccagccccacccaagaagggcctgctgcagaggctcttcagccggcaggactgctgcggcaactgcagcgacagcgaggaggagctgcccacccggctgtag

SEQ ID NO: 153323 - DNA, 1683 bp, Artificial Sequence
  Description of Artificial Sequence: Synthetic coding sequence
atggagctggagaacatcgtggccaacacagtgctgctgaaggcccgggagggcggcggcggcaacaggaagggcaagagcaagaagtggaggcagatgctgcagttcccccacatcagccagtgtgaggagctgcggctgagcctggagcgggactaccacagcctgtgtgagcggcagcccatcggccgcctgctcttccgggagttctgtgccaccaggcctgagctgagccgctgtgtggccttcctggatggagtggccgagtatgaggtgaccccagatgacaagaggaaggcctgtggccggcagctgacccagaacttcctgagccacactggaccagacctgatccctgaggtgccccggcagctggtgaccaactgcacccagaggctggagcagggcccctgcaaggacctcttccaggagctgacccggctgacccatgagtacctgtctgtggccccctttgctgactacctggacagcatctacttcaaccgcttcctgcagtggaagtggctggagcggcagcctgtgaccaagaacaccttccggcagtacagagtgctgggcaagggcggctttggagaggtgtgtgcctgccaggtgcgggccaccgggaagatgtatgcctgcaagaagctggagaagaagaggatcaagaagaggaagggggaggccatggccctgaatgagaagcagatcctggagaaggtgaacagcagatttgtggtgtccctggcctatgcctatgagaccaaggatgccctgtgcctggtgctgaccctgatgaatggaggagacctgaagttccacatctaccacatgggccaggccggcttccctgaggcccgggctgtgttctacgccgctgagatctgctgcggcctggaggacctgcaccgggagagaattgtgtacagagacctgaagccagagaacatcctgctggatgaccacggccacatccgcatcagtgacctgggcctggccgtgcacgtgcctgagggccagaccatcaagggccgggtgggcaccgtgggctacatggcccctgaggtggtgaagaatgaaagatacaccttctccccagactggtgggccctgggctgcctgctgtatgagatgattgctggccagagccccttccagcagaggaagaagaagatcaagcgggaggaggtggagcggctggtgaaggaggtgcctgaggagtacagcgagcgcttcagcccccaggcccggagcctgtgcagccagctgctgtgcaaggaccctgctgagcggctgggctgccggggcggcagcgcccgggaggtgaaggagcaccccctcttcaagaagctgaacttcaagaggctgggcgccggcatgctggagccccccttcaagccagacccccaggccatctactgcaaggatgtgctggacatcgagcagttcagcacagtgaagggcgtggagctggagcccacagaccaggacttctaccagaagtttgccaccggctctgtgcccatcccctggcagaatgagatggtggagacagagtgcttccaggagctgaatgtgtttggcctggatggctctgtgcccccagacctggactggaagggccagcccccagccccacccaagaagggcctgctgcagaggctcttcagccggcagaggtag

SEQ ID NO: 153324 - DNA, 1770 bp, Artificial Sequence
  Description of Artificial Sequence: Synthetic coding sequence
atggagctggagaacatcgtggccaacacagtgctgctgaaggcccgggagggcggcggcggcaacaggaagggcaagagcaagaagtggaggcagatgctgcagttcccccacatcagccagtgtgaggagctgcggctgagcctggagcgggactaccacagcctgtgtgagcggcagcccatcggccgcctgctcttccgggagttctgtgccaccaggcctgagctgagccgctgtgtggccttcctggatggagtggccgagtatgaggtgaccccagatgacaagaggaaggcctgtggccggcagctgacccagaacttcctgagccacactggaccagacctgatccctgaggtgccccggcagctggtgaccaactgcacccagaggctggagcagggcccctgcaaggacctcttccaggagctgacccggctgacccatgagtacctgtctgtggccccctttgctgactacctggacagcatctacttcaaccgcttcctgcagtggaagtggctggagcggcagcctgtgaccaagaacaccttccggcagtacagagtgctgggcaagggcggctttggagaggtgtgtgcctgccaggtgcgggccaccgggaagatgtatgcctgcaagaagctggagaagaagaggatcaagaagaggaagggggaggccatggccctgaatgagaagcagatcctggagaaggtgaacagcagatttgtggtgtccctggcctatgcctatgagaccaaggatgccctgtgcctggtgctgaccctgatgaatggaggagacctgaagttccacatctaccacatgggccaggccggcttccctgaggcccgggctgtgttctacgccgctgagatctgctgcggcctggaggacctgcaccgggagagaattgtgtacagagacctgaagccagagaacatcctgctggatgaccacggccacatccgcatcagtgacctgggcctggccgtgcacgtgcctgagggccagaccatcaagggccgggtgggcaccgtgggctacatggcccctgaggtggtgaagaatgaaagatacaccttctccccagactggtgggccctgggctgcctgctgtatgagatgattgctggccagagccccttccagcagaggaagaagaagatcaagcgggaggaggtggagcggctggtgaaggaggtgcctgaggagtacagcgagcgcttcagcccccaggcccggagcctgtgcagccagctgctgtgcaaggaccctgctgagcggctgggctgccggggcggcagcgcccgggaggtgaaggagcaccccctcttcaagaagctgaacttcaagaggctgggcgccggcatgctggagccccccttcaagccagacccccaggccatctactgcaaggatgtgctggacatcgagcagttcagcacagtgaagggcgtggagctggagcccacagaccaggacttctaccagaagtttgccaccggctctgtgcccatcccctggcagaatgagatggtggagacagagtgcttccaggagctgaatgtgtttggcctggatggctctgtgcccccagacctggactggaagggccagcccccagccccacccaagaagggcctgctgcagaggctcttcagccggcagagaattgctgtggagacagctgccacagccaggaagagcagccccccagccagcagcccccagcctgaggcccccaccagctcctggaggtag

SEQ ID NO: 153325 - DNA, 1662 bp, Artificial Sequence
  Description of Artificial Sequence: Synthetic coding sequence
atggtggacatgggcgccctggacaacctgattgccaacacagcctacctgcaggccaggaagcccagcgactgtgacagcaaggagctgcagaggagaagaagaagcctggccctgcccggcctgcagggctgtgccgagctgcggcagaagctgagcctgaacttccacagcctgtgtgagcagcagcccatcggcagaagactcttccgggacttcctggccaccgtgcccaccttcaggaaggccgccaccttcctggaggatgtgcagaactgggagctggccgaggagggccccaccaaggacagcgccctgcagggcctggtggccacctgtgccagcgccccagcccctggcaacccccagcccttcctgagccaggccgtggccaccaagtgccaggccgccaccacagaggaggagcgggtggccgctgtgaccctggccaaggccgaggccatggccttcctgcaggagcagcccttcaaggactttgtgaccagcgccttctatgacaagttcctgcagtggaagctgtttgagatgcagcctgtgtctgacaagtacttcacagagttccgggtgctgggcaaaggaggctttggagaggtgtgtgctgtgcaggtgaagaacacaggcaagatgtatgcctgcaagaagctggacaagaagaggctgaagaagaagggcggggagaagatggccctgctggagaaggagatcctggagaaggtgagcagccccttcatcgtgtccctggcctatgcctttgagagcaagacccacctgtgcctggtgatgagcctgatgaatggaggagacctgaagttccacatctacaacgtgggcacccggggcctggacatgagcagggtcatcttctacagcgcccagatcgcctgtggcatgctgcacctgcacgagctgggcatcgtgtacagagacatgaagccagaaaatgtgctgctggatgacctgggcaactgccgcctgagtgacctgggcctggccgtggagatgaagggcggcaagcccatcacccagagagctggcaccaacggctacatggcccctgagatcctgatggagaaggtgtcctacagctaccctgtggactggtttgccatgggctgcagcatctatgagatggtggccggccgcacccccttcaaggactacaaggagaaggtgtccaaagaagacctgaagcagaggaccctgcaggatgaggtgaagttccagcacgacaacttcacagaggaggccaaggacatctgccgcctcttcctggccaagaagccagagcagaggctgggcagccgggagaagagtgatgaccccaggaagcaccacttcttcaagaccatcaacttcccccggctggaggccggcctgattgagcccccatttgtgcctgaccccagcgtggtgtatgccaaggacattgctgagattgatgacttcagcgaggtgcggggcgtggagtttgatgacaaggacaagcagttcttcaagaactttgccaccggggctgtgcccatcgcctggcaggaggagatcatcgagaccggcctgtttgaggagctgaatgaccccaaccggcccaccggctgtgaggagggcaacagcagcaagtctggagtgtgcctgctgctgtag

SEQ ID NO: 153326 - DNA, 2088 bp, Artificial Sequence
  Description of Artificial Sequence: Synthetic coding sequence
atggaggagaagccaggccagccccagccccagcaccaccacagccaccaccacccccaccaccacccccagcagcagcagcagcagccccaccaccaccaccactactacttctacaaccacagccacaaccaccaccaccaccaccaccaccagcagccccaccagtacctgcagcacggggctgagggcagccccaaggcccagcccaagcccctgaagcatgagcagaagcacaccctgcagcagcaccaggagacccccaagaagaagacaggctacggggagctgaatggaaatgctggggagcgggagatcagcctgaagaacctgagcagtgatgaggccaccaaccccatcagccgggtgctgaatggaaaccagcaggtggtggacaccagcctgaagcagacagtgaaggccaacaccttcggcaaggccggcatcaagaccaagaacttcatccagaagaacagcatggacaagaagaatggcaagagctatgagaacaagagcggggagaaccagagcgtggacaagagtgacaccatccccatccccaacggggtggtgaccaacaacagcggctacatcaccaacggctacatgggcaaaggagctgacaatgatggcagcggcagcgagagcggctacaccacccccaagaagaggaaggcccggaggaacagcgccaagggctgtgagaacctgaacatcgtgcaggacaagatcatgcagcaggagacctctgtgcccaccctgaagcagggcctggagaccttcaagccagactacagcgagcagaagggcaacagagtggatggcagcaagcccatctggaagtatgagaccggccctgggggcaccagccggggcaagccagctgtgggggacatgctgaggaagagcagtgacagcaagccaggagtgagcagcaagaagtttgatgaccggcccaagggcaagcacgccagcgctgtggccagcaaagaagattcctggaccctcttcaagcccccacctgtgtttcctgtggacaacagcagcgccaagatcgtgcccaagatctcctatgccagcaaggtgaaggagaacctgaacaagaccatccagaacagctctgtgagccccaccagcagcagcagcagcagcagcagcactggagagacccagacccagagcagcagccggctgagccaggtgcccatgtctgccctgaagtctgtgaccagcgccaacttcagcaatggacctgtgctggccggcacagatggaaatgtgtacccacctgggggccagcccctgctgaccacagctgccaacaccctgacccccatcagcagcggcacagacagcgtgctgcaggacatgagcctgaccagcgctgctgtggagcagatcaagaccagcctcttcatctaccccagcaacatgcagaccatgctgctgagcacagcccaggtggacctgcccagccagacagaccagcagaacctgggggacatcttccagaaccagtggggcctgtccttcatcaatgagcccagcgctggccctgagaccgtgacaggcaagagcagcgagcacaaggtgatggaggtgaccttccagggcgagtacccagccaccctggtgtcccagggcgctgagatcatccccagcggcacagagcaccctgtgttccccaaggcctatgagctggagaagaggaccagcccccaggtgctgggcagcatcctgaagagcggcaccaccagcgagagcggggccctgagcctggagcccagccacatcggggacctgcagaaggctgacaccagcagccagggcgccctggtgttcctgagcaaggactatgaaattgagagccagaaccccctggccagccccaccaacaccctgctgggcagcgccaaggagcagcgctaccagaggggcctggagagaaatgacagctggggcagctttgacctgcgggccgccatcgtgtaccacaccaaggagatggagagcatctggaacctgcagaagcaggaccccaagaggatcatcacctacaatgaggccatggacagcccagaccagtag

SEQ ID NO: 153327 - DNA, 534 bp, Artificial Sequence
  Description of Artificial Sequence: Synthetic coding sequence
atgagcaggaagggccccagggctgaggtgtgtgccgactgcagcgccccagaccccggctgggccagcatcagcagaggagtgctggtgtgtgatgagtgctgcagcgtgcacaggagcctgggccgccacatcagcatcgtgaagcacctgcggcacagcgcctggccacccaccctgctgcagatggtgcacaccctggccagcaatggagccaacagcatctgggagcacagcctgctggaccctgcccaggtgcagagcggccgcaggaaggccaacccccaggacaaggtgcaccccatcaagtctgagttcatccgggccaagtaccagatgctggcctttgtgcacaagctgccctgcagagatgatgatggagtgacagccaaggatgacctgaccggccaccgctcctgggccaccccagacatcaacccccaccccaacagagccaccggcaccagcgccctgtctgctgccaccctgcccggcagccaggtgccctggtgcccccccctgagcagcccctag

SEQ ID NO: 153328 - DNA, 2313 bp, Artificial Sequence
  Description of Artificial Sequence: Synthetic coding sequence
atgagcaggaagggccccagggctgaggtgtgtgccgactgcagcgccccagaccccggctgggccagcatcagcagaggagtgctggtgtgtgatgagtgctgcagcgtgcacaggagcctgggccgccacatcagcatcgtgaagcacctgcggcacagcgcctggccacccaccctgctgcagatggtgcacaccctggccagcaatggagccaacagcatctgggagcacagcctgctggaccctgcccaggtgcagagcggccgcaggaaggccaacccccaggacaaggtgcaccccatcaagtctgagttcatccgggccaagtaccagatgctggcctttgtgcacaagctgccctgcagagatgatgatggagtgacagccaaggacctgagcaagcagctgcacagctctgtgaggactggaaacctggagacctgcctgcggctgctgagcctgggcgcccaggccaacttcttccaccctgagaagggcaccacccccctgcacgtggccgccaaggccggccagaccctgcaggccgagctgctggtggtgtatggagctgaccccggcagcccagatgtgaatggaagaacacccatcgactatgcccggcaggccggccaccacgagctggccgagcggctggtggagtgccagtatgagctgacagaccggctggccttctacctgtgtggcaggaagccagaccacaagaatggccactacatcatcccccagatggctgacaggagccggcagaagtgcatgagccagagcctggacctgtctgagctggccaaggccgccaagaagaagctgcaggccctgagcaaccggctgtttgaggagctggccatggatgtgtatgatgaggtggaccggcgggagaatgatgctgtgtggctggccacccagaaccacagcaccctggtgacagagaggtctgctgtgcccttcctgcctgtgaaccctgagtacagcgccaccaggaaccagggccggcagaagctggcccgcttcaatgcccgggagtttgccaccctcatcatcgacatcctgtctgaggccaagaggcggcagcagggcaagagcctgagcagccccacagacaacctggagctgagcctgcggagccagagcgacctggatgaccagcacgactatgacagcgtggccagtgatgaggacacagaccaggagcccctgcggagcactggagccaccaggagcaacagagcccgctccatggacagcagtgacctgagtgatggagctgtgaccctgcaggagtacctggagctgaagaaggccctggccaccagcgaggccaaggtgcagcagctgatgaaggtgaacagcagcctgagtgatgagctgcggcggctgcagcgggagatccacaagctgcaggccgagaacctgcagctgcggcagcccccaggccctgtgcccaccccacccctgcccagcgagagagctgagcacacccccatggcccctgggggcagcacccaccggcgggaccggcaggccttctccatgtatgagcccggcagcgccctgaagccctttggaggccccccaggagatgagctgaccacccggctgcagcccttccacagcacagagctggaggatgatgccatctacagcgtgcacgtgcctgctggcctgtaccgcatcagaaaaggagtgtctgccagcgctgtgcccttcacccccagcagccccctgctgagctgcagccaggagggcagccgccacaccagcaagctgagcagacatggcagcggggctgacagcgactatgagaacacccagagcggggaccccctgctgggcctggagggcaagcgcttcctggagctgggcaaggaggaggacttccaccctgagctggagagcctggatggagacctggaccccggcctgcccagcacagaagatgtgatcctgaagacagagcaggtgaccaagaacatccaggagctgctgcgggccgcccaggagttcaagcatgacagctttgtgccctgcagcgagaagatccacctggccgtgacagagatggccagcctcttccccaagaggcctgccctggagcctgtgcgcagcagcctgcggctgctgaatgccagcgcctaccgcctgcagagcgagtgcaggaagacagtgcccccagagcccggggcccctgtggacttccagctgctgacccagcaggtgatccagtgtgcctatgacatcgccaaggccgccaagcagctggtgaccatcaccacccgggagaagaagcagtag

SEQ ID NO: 153329 - DNA, 1212 bp, Artificial Sequence
  Description of Artificial Sequence: Synthetic coding sequence
atgtttgtggccagcgagaggaagatgagggcccaccaggtgctgaccttcctgctgctgtttgtgatcacctctgtggcctctgaaaatgccagcaccagccggggctgcggcctggacctgctgccccagtatgtgtccctgtgtgacctggatgccatctggggcatcgtggtggaggccgtggccggggccggggccctgatcaccctgctgctgatgctgatcctgctggtgcggctgcccttcatcaaggagaaggagaagaagagccctgtgggcctgcacttcctgttcctgctgggcaccctgggcctgtttggcctgacctttgccttcatcatccaggaggatgagaccatctgcagcgtgcggcgcttcctgtggggcgtgctgtttgccctgtgcttcagctgcctgctgagccaggcctggagggtgcggcggctggtgagacatggaactggacctgctggctggcagctggtgggcctggccctgtgcctgatgctggtgcaggtgatcatcgctgtggagtggctggtgctgactgtgctgcgggacaccaggcctgcctgtgcctatgagcccatggactttgtgatggccctgatctatgacatggtgctgctggtggtgaccctgggcctggccctcttcaccctgtgtgggaagttcaagcgctggaagctgaatggagccttcctgctgatcacagccttcctgtctgtgctgatctgggtggcctggatgaccatgtacctgtttggaaatgtgaagctgcagcagggagatgcctggaatgaccccaccctggccatcaccctggccgccagcggctgggtgtttgtgatcttccacgccatccctgagatccactgcaccctgctgcctgccctgcaggagaacacccccaactactttgacaccagccagcccaggatgagggagacagcctttgaggaggatgtgcagctgccccgggcctacatggagaacaaggccttctccatggatgagcacaatgctgccctgaggacagctggcttccccaacggcagcctgggcaagaggcccagcggcagcctgggcaagaggcccagcgcccccttccgcagcaatgtgtaccagcccacagagatggctgtggtgctgaatggaggcaccatccccacagccccacccagccacacaggccgccacctgtggtag

SEQ ID NO: 153330 - DNA, 1215 bp, Artificial Sequence
  Description of Artificial Sequence: Synthetic coding sequence
atgtttgtggccagcgagaggaagatgagggcccaccaggtgctgaccttcctgctgctgtttgtgatcacctctgtggcctctgaaaatgccagcaccagccggggctgcggcctggacctgctgccccagtatgtgtccctgtgtgacctggatgccatctggggcatcgtggtggaggccgtggccggggccggggccctgatcaccctgctgctgatgctgatcctgctggtgcggctgcccttcatcaaggagaaggagaagaagagccctgtgggcctgcacttcctgttcctgctgggcaccctgggcctgtttggcctgacctttgccttcatcatccaggaggatgagaccatctgcagcgtgcggcgcttcctgtggggcgtgctgtttgccctgtgcttcagctgcctgctgagccaggcctggagggtgcggcggctggtgagacatggaactggacctgctggctggcagctggtgggcctggccctgtgcctgatgctggtgcaggtgatcatcgctgtggagtggctggtgctgactgtgctgcgggacaccaggcctgcctgtgcctatgagcccatggactttgtgatggccctgatctatgacatggtgctgctggtggtgaccctgggcctggccctcttcaccctgtgtgggaagttcaagcgctggaagctgaatggagccttcctgctgatcacagccttcctgtctgtgctgatctgggtggcctggatgaccatgtacctgtttggaaatgtgaagctgcagcagggagatgcctggaatgaccccaccctggccatcaccctggccgccagcggctgggtgtttgtgatcttccacgccatccctgagatccactgcaccctgctgcctgccctgcaggagaacacccccaactactttgacaccagccagcccaggatgagggagacagcctttgaggaggatgtgcagctgccccgggcctacatggagaacaaggccttctccatggatgagcacaatgctgccctgaggacagctggcttccccaacggcagcctgggcaagaggcccagcggcagcctgggcaagaggcccagcgcccccttccgcagcaatgtgtaccagcccacagagatggctgtggtgctgaatggaggaacagagatggtgacccaccccaggagcctggagagctttggagccttctag

SEQ ID NO: 153331 - DNA, 1290 bp, Artificial Sequence
  Description of Artificial Sequence: Synthetic coding sequence
atgaaccccccctggagcgtggcctggggccaggagggcttccgggccggcaccccaggcagccgctacctgcccaggatgtttgtggccagcgagaggaagatgagggcccaccaggtgctgaccttcctgctgctgtttgtgatcacctctgtggcctctgaaaatgccagcaccagccggggctgcggcctggacctgctgccccagtatgtgtccctgtgtgacctggatgccatctggggcatcgtggtggaggccgtggccggggccggggccctgatcaccctgctgctgatgctgatcctgctggtgcggctgcccttcatcaaggagaaggagaagaagagccctgtgggcctgcacttcctgttcctgctgggcaccctgggcctgtttggcctgacctttgccttcatcatccaggaggatgagaccatctgcagcgtgcggcgcttcctgtggggcgtgctgtttgccctgtgcttcagctgcctgctgagccaggcctggagggtgcggcggctggtgagacatggaactggacctgctggctggcagctggtgggcctggccctgtgcctgatgctggtgcaggtgatcatcgctgtggagtggctggtgctgactgtgctgcgggacaccaggcctgcctgtgcctatgagcccatggactttgtgatggccctgatctatgacatggtgctgctggtggtgaccctgggcctggccctcttcaccctgtgtgggaagttcaagcgctggaagctgaatggagccttcctgctgatcacagccttcctgtctgtgctgatctgggtggcctggatgaccatgtacctgtttggaaatgtgaagctgcagcagggagatgcctggaatgaccccaccctggccatcaccctggccgccagcggctgggtgtttgtgatcttccacgccatccctgagatccactgcaccctgctgcctgccctgcaggagaacacccccaactactttgacaccagccagcccaggatgagggagacagcctttgaggaggatgtgcagctgccccgggcctacatggagaacaaggccttctccatggatgagcacaatgctgccctgaggacagctggcttccccaacggcagcctgggcaagaggcccagcggcagcctgggcaagaggcccagcgcccccttccgcagcaatgtgtaccagcccacagagatggctgtggtgctgaatggaggcaccatccccacagccccacccagccacacaggccgccacctgtggtag

SEQ ID NO: 153332 - DNA, 759 bp, Artificial Sequence
  Description of Artificial Sequence: Synthetic coding sequence
atgtttgtggccagcgagaggaagatgagggcccaccaggtgctgaccttcctgctgctgtttgtgatcacctctgtggcctctgaaaatgccagcaccagccggggctgcggcctggacctgctgccccagtatgtgtccctgtgtgacctggatgccatctggggcatcgtggtggaggccgtggccggggccggggccctgatcaccctgctgctgatgctgatcctgctggtgcggctgcccttcttcctgctgatcacagccttcctgtctgtgctgatctgggtggcctggatgaccatgtacctgtttggaaatgtgaagctgcagcagggagatgcctggaatgaccccaccctggccatcaccctggccgccagcggctgggtgtttgtgatcttccacgccatccctgagatccactgcaccctgctgcctgccctgcaggagaacacccccaactactttgacaccagccagcccaggatgagggagacagcctttgaagaagatgtgcagctgccccgggcctacatggagaacaaggccttctccatggatgagcacaatgctgccctgaggacagctggcttccccaacggcagcctgggcaagaggccttctggcagcctgggcaagaggccttctgcccccttccgcagcaatgtgtaccagcccacagagatggctgtggtgctgaatggaggcaccatccccacagccccacccagccacacaggccgccacctgtggtag

SEQ ID NO: 153333 - DNA, 489 bp, Artificial Sequence
  Description of Artificial Sequence: Synthetic coding sequence
atggccatccacaaggccctggtgatgtgcctgggcctgcccctcttcctgtttcctgagcagagctaccagggcgacatgtaccccacccggggcgtgggctatgagaccatcctgaaggagcagaagggccagagcatgtttgtggagaacaaggccttctccatggatgagcctgtggccgccaagaggcctgtgagcccctacagcggctacaacggccagctgctgacctctgtgtaccagcccacagagatggccctgatgcacaaggtgcccagcgagggcgcctatgacatcatcctgccccgggccacagccaacagccaggtgatgggcagcgccaacagcaccctgcgggcagaggacatgtacagcgcccagagccaccaggccgccaccccacccaaggatggcaagaacagccaggtgtctgagctgacccagaggggccaggccaacaccaaccaggtgttcctgcggctgtag

SEQ ID NO: 153334 - DNA, 1461 bp, Artificial Sequence
  Description of Artificial Sequence: Synthetic coding sequence
atgaggggccggggcagccagcagcagcagcccacccggcggcagggccagaagctgcccagccccagccctgctgggaagtatgagagcgcccagcccggcggcacccagcctgagcccggcctgggcgccaggatggccatccacaaggccctggtgatgtgcctgggcctgcccctcttcctgtttcctggggcctgggcccagggccacgtgcccccaggctgcagccagggcctgaaccccctgtactacaacctgtgtgacagaagtggggcctggggcatcgtgctggaggccgtggccggggccggcatcgtgaccacctttgtgctgaccatcatcctggtggccagcctgccctttgtgcaggacaccaagaagaggagcctgctgggcacccaggtgttcttcctgctgggcaccctgggcctcttctgcctggtgtttgcctgtgtggtgaagccagacttcagcacctgtgccagccgccgcttcctgtttggagtgctgtttgccatctgcttcagctgcctggccgcccacgtgtttgccctgaacttcctggccaggaagaaccacggcccccggggctgggtgatcttcaccgtggccctgctgctgaccctggtggaggtgatcatcaacacagagtggctgatcatcaccctggtgcggggcagcggggagggcggcccccagggcaacagcagcgctggctgggccgtggccagcccctgtgccatcgccaacatggactttgtgatggccctgatctacgtgatgctgctgctgctgggcgccttcctgggcgcctggccagccctgtgtggccgctacaagcgctggaggaagcacggcgtgtttgtgctgctgaccacagccacctctgtggccatctgggtggtgtggatcgtgatgtacacctacggcaacaagcagcacaacagccccacctgggatgaccccaccctggccatcgccctggccgccaatgcctgggcctttgtgctcttctacgtgattcctgaggtgtcccaggtgaccaagagcagccctgagcagagctaccagggcgacatgtaccccacccggggcgtgggctatgagaccatcctgaaggagcagaagggccagagcatgtttgtggagaacaaggccttctccatggatgagcctgtggccgccaagaggcctgtgagcccctacagcggctacaacggccagctgctgacctctgtgtaccagcccacagagatggccctgatgcacaaggtgcccagcgagggcgcctatgacatcatcctgccccgggccacagccaacagccaggtgatgggcagcgccaacagcaccctgcgggcagaggacatgtacagcgcccagagccaccaggccgccaccccacccaaggatggcaagaacagccaggtgttcaggaacccctacgtgtgggactag

SEQ ID NO: 153335 - DNA, 1326 bp, Artificial Sequence
  Description of Artificial Sequence: Synthetic coding sequence
atggccatccacaaggccctggtgatgtgcctgggcctgcccctcttcctgtttcctggggcctgggcccagggccacgtgcccccaggctgcagccagggcctgaaccccctgtactacaacctgtgtgacagaagtggggcctggggcatcgtgctggaggccgtggccggggccggcatcgtgaccacctttgtgctgaccatcatcctggtggccagcctgccctttgtgcaggacaccaagaagaggagcctgctgggcacccaggtgttcttcctgctgggcaccctgggcctcttctgcctggtgtttgcctgtgtggtgaagccagacttcagcacctgtgccagccgccgcttcctgtttggagtgctgtttgccatctgcttcagctgcctggccgcccacgtgtttgccctgaacttcctggccaggaagaaccacggcccccggggctgggtgatcttcaccgtggccctgctgctgaccctggtggaggtgatcatcaacacagagtggctgatcatcaccctggtgcggggcagcggggagggcggcccccagggcaacagcagcgctggctgggccgtggccagcccctgtgccatcgccaacatggactttgtgatggccctgatctacgtgatgctgctgctgctgggcgccttcctgggcgcctggccagccctgtgtggccgctacaagcgctggaggaagcatggagtgtttgtgctgctgaccacagccacctctgtggccatctgggtggtgtggatcgtgatgtacacctacggcaacaagcagcacaacagccccacctgggatgaccccaccctggccatcgccctggccgccaatgcctgggcctttgtgctcttctacgtgattcctgaggtgtcccaggtgaccaagagcagccctgagcagagctaccagggcgacatgtaccccacccggggcgtgggctatgagaccatcctgaaggagcagaagggccagagcatgtttgtggagaacaaggccttctccatggatgagcctgtggccgccaagaggcctgtgagcccctacagcggctacaacggccagctgctgacctctgtgtaccagcccacagagatggccctgatgcacaaggtgcccagcgagggcgcctatgacatcatcctgccccgggccacagccaacagccaggtgatgggcagcgccaacagcaccctgcgggcagaggacatgtacagcgcccagagccaccaggccgccaccccacccaaggatggcaagaacagccaggtgttcaggaacccctacgtgtgggactag

SEQ ID NO: 153336 - DNA, 1329 bp, Artificial Sequence
  Description of Artificial Sequence: Synthetic coding sequence
atggccatccacaaggccctggtgatgtgcctgggcctgcccctcttcctgtttcctggggcctgggcccagggccacgtgcccccaggctgcagccagggcctgaaccccctgtactacaacctgtgtgacagaagtggggcctggggcatcgtgctggaggccgtggccggggccggcatcgtgaccacctttgtgctgaccatcatcctggtggccagcctgccctttgtgcaggacaccaagaagaggagcctgctgggcacccaggtgttcttcctgctgggcaccctgggcctcttctgcctggtgtttgcctgtgtggtgaagccagacttcagcacctgtgccagccgccgcttcctgtttggagtgctgtttgccatctgcttcagctgcctggccgcccacgtgtttgccctgaacttcctggccaggaagaaccacggcccccggggctgggtgatcttcaccgtggccctgctgctgaccctggtggaggtgatcatcaacacagagtggctgatcatcaccctggtgcggggcagcggggagggcggcccccagggcaacagcagcgctggctgggccgtggccagcccctgtgccatcgccaacatggactttgtgatggccctgatctacgtgatgctgctgctgctgggcgccttcctgggcgcctggccagccctgtgtggccgctacaagcgctggaggaagcatggagtgtttgtgctgctgaccacagccacctctgtggccatctgggtggtgtggatcgtgatgtacacctacggcaacaagcagcacaacagccccacctgggatgaccccaccctggccatcgccctggccgccaatgcctgggcctttgtgctcttctacgtgattcctgaggtgtcccaggtgaccaagagcagccctgagcagagctaccagggcgacatgtaccccacccggggcgtgggctatgagaccatcctgaaggagcagaagggccagagcatgtttgtggagaacaaggccttctccatggatgagcctgtggccgccaagaggcctgtgagcccctacagcggctacaacggccagctgctgacctctgtgtaccagcccacagagatggccctgatgcacaaggtgcccagcgagggcgcctatgacatcatcctgccccgggccacagccaacagccaggtgatgggcagcgccaacagcaccctgcgggcagaggacatgtacagcgcccagagccaccaggccgccaccccacccaaggatggcaagaacagccaggcccagagcccccagagcaagacccgctggtag

SEQ ID NO: 153337 - DNA, 1362 bp, Artificial Sequence
  Description of Artificial Sequence: Synthetic coding sequence
atgggcacccagcctgagcccggcctgggcgccaggatggccatccacaaggccctggtgatgtgcctgggcctgcccctcttcctgtttcctggggcctgggcccagggccacgtgcccccaggctgcagccagggcctgaaccccctgtactacaacctgtgtgacagaagtggggcctggggcatcgtgctggaggccgtggccggggccggcatcgtgaccacctttgtgctgaccatcatcctggtggccagcctgccctttgtgcaggacaccaagaagaggagcctgctgggcacccaggtgttcttcctgctgggcaccctgggcctcttctgcctggtgtttgcctgtgtggtgaagccagacttcagcacctgtgccagccgccgcttcctgtttggagtgctgtttgccatctgcttcagctgcctggccgcccacgtgtttgccctgaacttcctggccaggaagaaccacggcccccggggctgggtgatcttcaccgtggccctgctgctgaccctggtggaggtgatcatcaacacagagtggctgatcatcaccctggtgcggggcagcggggagggcggcccccagggcaacagcagcgctggctgggccgtggccagcccctgtgccatcgccaacatggactttgtgatggccctgatctacgtgatgctgctgctgctgggcgccttcctgggcgcctggccagccctgtgtggccgctacaagcgctggaggaagcatggagtgtttgtgctgctgaccacagccacctctgtggccatctgggtggtgtggatcgtgatgtacacctacggcaacaagcagcacaacagccccacctgggatgaccccaccctggccatcgccctggccgccaatgcctgggcctttgtgctcttctacgtgattcctgaggtgtcccaggtgaccaagagcagccctgagcagagctaccagggcgacatgtaccccacccggggcgtgggctatgagaccatcctgaaggagcagaagggccagagcatgtttgtggagaacaaggccttctccatggatgagcctgtggccgccaagaggcctgtgagcccctacagcggctacaacggccagctgctgacctctgtgtaccagcccacagagatggccctgatgcacaaggtgcccagcgagggcgcctatgacatcatcctgccccgggccacagccaacagccaggtgatgggcagcgccaacagcaccctgcgggcagaggacatgtacagcgcccagagccaccaggccgccaccccacccaaggatggcaagaacagccaggtgttcaggaacccctacgtgtgggactag

SEQ ID NO: 153338 - DNA, 597 bp, Artificial Sequence
  Description of Artificial Sequence: Synthetic coding sequence
atgagcaatgtgcgggtgtccaatggcagccccagcctggagaggatggatgcccggcaggccgagcaccccaagcccagcgcctgcaggaacctgtttggacctgtggaccacgaggagctgacccgggacctggagaagcactgccgggacatggaggaggccagccagaggaagtggaactttgacttccagaaccacaagcccctggagggcaagtatgagtggcaggaggtggagaagggcagcctgcctgagttctactacagaccaccccggccccccaagggggcctgcaaggtgcctgcccaggagagccaggatgtgtctggcagcaggcctgctgcccccctgattggagccccagccaacagcgaggacacccacctggtggaccccaagacagaccccagcgacagccagacaggcctggccgagcagtgtgccggcatcaggaagaggcctgccacagatgacagcagcacccagaacaagagggccaacagaacagaggagaatgtgtctgatggcagccccaatgccggctctgtggagcagacccccaagaagccaggcctgcggcggcggcagacctag

SEQ ID NO: 153339 - DNA, 903 bp, Artificial Sequence
  Description of Artificial Sequence: Synthetic coding sequence
atgtacaaggactgcatcgagagcactggagactacttcctgctgtgtgatgctgagggcccctggggcatcatcctggagagcctggccatcctgggcatcgtggtgaccatcctgctgctgctggccttcctgttcctgatgaggaagatccaggactgcagccagtggaatgtgctgcccacccagctgctcttcctgctgtctgtgctgggcctgtttggcctggcctttgccttcatcatcgagctgaaccagcagacagcccctgtgcgctacttcctgtttggagtgctgtttgccctgtgcttcagctgcctgctggcccacgccagcaacctggtgaagctggtgcggggctgtgtgtccttctcctggaccaccatcctgtgcatcgccatcggctgcagcctgctgcagatcatcatcgccacagaatatgtgaccctcatcatgacccggggcatgatgtttgtgaacatgaccccctgccagctgaatgtggactttgtggtgctgctggtgtatgtgctcttcctgatggccctgaccttctttgtgtccaaggccaccttctgtggcccctgtgagaactggaagcagcacggccgcctcatcttcatcaccgtgctcttcagcatcatcatctgggtggtgtggatctccatgctgctgcggggcaacccccagttccagaggcagccccagtgggatgatcctgtggtgtgcatcgccctggtgaccaatgcctgggtgttcctgctgctgtacatcgtgcctgagctgtgcatcctgtaccgcagctgccggcaggagtgccccctgcagggcaatgcctgccctgtgacagcctaccagcacagcttccaggtggagaaccaggagctgagccgggactgctag

SEQ ID NO: 153340 - DNA, 363 bp, Artificial Sequence
  Description of Artificial Sequence: Synthetic coding sequence
atgtacaaggactgcatcgagagcactggagactacttcctgctgtgtgatgctgagggcccctggggcatcatcctggagagcctggccatcctgggcatcgtggtgaccatcctgctgctgctggccttcctgttcctgatgaggaagatccaggactgcagccagtggaatgtgctgcccacccagctgctcttcctgctgtctgtgctgggcctgtttggcctggcctttgccttcatcatcgagctgaaccagcagacagcccctgtgcgctacttcctgtttggagtgctgtttgccctgtgcttcagctgcctgctggcccacgccagcaacctggtgaagctggtgcggggctag

SEQ ID NO: 153341 - DNA, 312 bp, Artificial Sequence
  Description of Artificial Sequence: Synthetic coding sequence
atggagaccgtgcaggagctgatccccctggccaaggagatgatggcccagaagaggaagggcaagatggtgaagctgtatgtgctgggctctgtgctggccctgtttggagtggtgctgggcctgatggagaccgtgtgcagccccttcaccgctgcccggcggctgcgggaccaggaggccgctgtggccgagctgcaggccgccctggagcggcaggccctgcagaagcaggccctgcaggagaagggcaagcagcaggacacagtgctgggcggccgggccctgagcaaccggcagcacgccagctag

SEQ ID NO: 153342 - DNA, 1500 bp, Artificial Sequence
  Description of Artificial Sequence: Synthetic coding sequence
atggagctgtctgagcccatcgtggagaatggagaaacagagatgagccctgaggagagctgggagcacaaggaggagatcagcgaggccgagcccggcggcggcagcctgggagatggccggcccccagaggagagcgcccacgagatgatggaggaggaggaggagatccccaagcccaagtctgtggtggcccctcctggggcccccaagaaggagcacgtgaatgtggtgttcatcggccacgtggatgctgggaagagcaccatcggcggccagatcatgtacctgaccggcatggtggacaagaggaccctggagaagtatgagcgggaggccaaggagaagaaccgggagacctggtacctgtcctgggccctggacaccaaccaggaggagcgggacaagggcaagacagtggaggtgggccgggcctactttgaaacagagaagaagcacttcaccatcctggatgcccctggccacaagagctttgtgcccaacatgattggaggagccagccaggccgacctggccgtgctggtgatcagcgccaggaaaggagaatttgagaccggctttgagaagggcggccagacccgggagcacgccatgctggccaagacagctggggtgaagcacctgattgtgctgatcaacaagatggatgaccccaccgtgaactggagcaatgaaagatatgaggagtgcaaggagaagctggtgcccttcctgaagaaggtgggcttcaaccccaagaaggacatccacttcatgccctgcagcggcctgactggagccaacctgaaggagcagagcgacttctgcccctggtacatcggcctgcccttcatcccctacctggacaacctgcccaacttcaacagatctgtggatggccccatccggctgcccatcgtggacaagtacaaggacatgggcaccgtggtgctgggcaagctggagagcggcagcatctgcaagggccagcagctggtgatgatgcccaacaagcacaacgtggaggtgctgggcatcctgagtgatgatgtggagacagacacagtggcccctggagagaacctgaagatccggctgaagggcatcgaggaggaggagatcctgcccggcttcatcctgtgtgaccccaacaacctgtgccacagcggccgcacctttgatgcccagatcgtcatcatcgagcacaagagcatcatctgccccggctacaatgctgtgctgcacatccacacctgcatcgaggaggtggagatcacagccctgatctgcctggtggacaagaagagcggggagaagagcaagacccggcccaggtttgtgaagcaggaccaggtgtgcatcgcccggctgaggacagctggcaccatctgcctggagaccttcaaggacttcccccagatgggccgcttcaccctgagagatgagggcaagaccatcgccatcggcaaggtgctgaagctggtgcctgagaaggactag

SEQ ID NO: 153343 - DNA, 1914 bp, Artificial Sequence
  Description of Artificial Sequence: Synthetic coding sequence
atggaccccggcagcggcggcggcggcggcggcggcggcggcggcggcagcagcagcggcagcagcagcagtgacagcgccccagactgctgggaccaggccgacatggaggcccctggccctggcccctgtggcggcggcggcagcctggccgctgctgctgaggcccagcgggagaacctgtctgctgccttcagccggcagctgaatgtgaatgccaagccctttgtgcccaacgtgcacgccgctgagtttgtgcccagcttcctgcggggccctgctgcccctcctcctcctgtgggcggggccgccaacaaccacggggccggcagcggggccggcggccgggccgcccctgtggagagcagccaggaggagcagagcctgtgtgagggcagcaacagcgctgtgtccatggagctgtctgagcccatcgtggagaatggagaaacagagatgagccctgaggagagctgggagcacaaggaggagatcagcgaggccgagcccggcggcggcagcctgggagatggccggcccccagaggagagcgcccacgagatgatggaggaggaggaggagatccccaagcccaagtctgtggtggcccctcctggggcccccaagaaggagcacgtgaatgtggtgttcatcggccacgtggatgctgggaagagcaccatcggcggccagatcatgtacctgaccggcatggtggacaagaggaccctggagaagtatgagcgggaggccaaggagaagaaccgggagacctggtacctgtcctgggccctggacaccaaccaggaggagcgggacaagggcaagacagtggaggtgggccgggcctactttgaaacagagaagaagcacttcaccatcctggatgcccctggccacaagagctttgtgcccaacatgattggaggagccagccaggccgacctggccgtgctggtgatcagcgccaggaaaggagaatttgagaccggctttgagaagggcggccagacccgggagcacgccatgctggccaagacagctggggtgaagcacctgattgtgctgatcaacaagatggatgaccccaccgtgaactggagcaatgaaagatatgaggagtgcaaggagaagctggtgcccttcctgaagaaggtgggcttcaaccccaagaaggacatccacttcatgccctgcagcggcctgactggagccaacctgaaggagcagagcgacttctgcccctggtacatcggcctgcccttcatcccctacctggacaacctgcccaacttcaacagatctgtggatggccccatccggctgcccatcgtggacaagtacaaggacatgggcaccgtggtgctgggcaagctggagagcggcagcatctgcaagggccagcagctggtgatgatgcccaacaagcacaacgtggaggtgctgggcatcctgagtgatgatgtggagacagacacagtggcccctggagagaacctgaagatccggctgaagggcatcgaggaggaggagatcctgcccggcttcatcctgtgtgaccccaacaacctgtgccacagcggccgcacctttgatgcccagatcgtcatcatcgagcacaagagcatcatctgccccggctacaatgctgtgctgcacatccacacctgcatcgaggaggtggagatcacagccctgatctgcctggtggacaagaagagcggggagaagagcaagacccggcccaggtttgtgaagcaggaccaggtgtgcatcgcccggctgaggacagctggcaccatctgcctggagaccttcaaggacttcccccagatgggccgcttcaccctgagagatgagggcaagaccatcgccatcggcaaggtgctgaagctggtgcctgagaaggactag

SEQ ID NO: 153344 - DNA, 1911 bp, Artificial Sequence
  Description of Artificial Sequence: Synthetic coding sequence
atggaccccggcagcggcggcggcggcggcggcggcggcggcggcggcagcagcagcggcagcagcagcagtgacagcgccccagactgctgggaccaggccgacatggaggcccctggccctggcccctgtggcggcggcggcagcctggccgctgctgctgaggcccagcgggagaacctgtctgctgccttcagccggcagctgaatgtgaatgccaagccctttgtgcccaacgtgcacgccgctgagtttgtgcccagcttcctgcggggccctgctgcccctcctcctcctgtgggcggggccgccaacaaccacggggccggcagcggggccggcggccgggccgcccctgtggagagcagccaggaggagcagagcctgtgtgagggcagcaacagcgctgtgtccatggagctgtctgagcccattgaaaatggagaaacagagatgagccctgaggagagctgggagcacaaggaggagatcagcgaggccgagcccggcggcggcagcctgggagatggccggcccccagaggagagcgcccacgagatgatggaggaggaggaggagatccccaagcccaagtctgtggtggcccctcctggggcccccaagaaggagcacgtgaatgtggtgttcatcggccacgtggatgctgggaagagcaccatcggcggccagatcatgtacctgaccggcatggtggacaagaggaccctggagaagtatgaaagagaggccaaggagaagaaccgggagacctggtacctgtcctgggccctggacaccaaccaggaggagcgggacaagggcaagacagtggaggtgggccgggcctactttgaaacagagaagaagcacttcaccatcctggatgcccctggccacaagagctttgtgcccaacatgattggaggagccagccaggccgacctggccgtgctggtgatcagcgccaggaagggggagtttgaaacaggctttgagaagggcggccagacccgggagcacgccatgctggccaagacagctggggtgaagcacctgattgtgctgatcaacaagatggatgaccccaccgtgaactggagcaatgaaagatatgaggagtgcaaggagaagctggtgcccttcctgaagaaggtgggcttcaaccccaagaaggacatccacttcatgccctgcagcggcctgaccggggccaacctgaaggagcagagcgacttctgcccctggtacatcggcctgcccttcatcccctacctggacaacctgcccaacttcaacagatctgtggatggccccatccggctgcccatcgtggacaagtacaaggacatgggcaccgtggtgctgggcaagctggagagcggcagcatctgcaagggccagcagctggtgatgatgcccaacaagcacaacgtggaggtgctgggcatcctgagtgatgatgtggagacagacacagtggcccctggagagaacctgaagatccggctgaagggcatcgaggaggaggagatcctgcccggcttcatcctgtgtgaccccaacaacctgtgccacagcggccgcacctttgatgcccagatcgtcatcatcgagcacaagagcatcatctgccccggctacaatgctgtgctgcacatccacacctgcatcgaggaggtggagatcacagccctgatctgcctggtggacaagaagtctggagagaagagcaagacccggcccaggtttgtgaagcaggaccaggtgtgcatcgcccggctgaggacagctggcaccatctgcctggagaccttcaaggacttcccccagatgggccgcttcaccctgagagatgagggcaagaccatcgccatcggcaaggtgctgaagctggtgcctgagaaggactag

SEQ ID NO: 153345 - DNA, 1887 bp, Artificial Sequence
  Description of Artificial Sequence: Synthetic coding sequence
atggattctggcagcagcagcagtgacagcgccccagactgctgggaccaggtggacatggagagccctggcagcgcccccagcggagatggagtgagcagcgctgtggccgaggcccagcgggagcccctgagcagcgccttcagcaggaagctgaatgtgaatgccaagccctttgtgcccaacgtgcatgctgctgagtttgtgcccagcttcctgcggggccccacccagccccccaccctgcctgctggcagcggcagcaatgatgagacctgcaccggggccggctacccccagggcaagaggatgggccgcggggcccctgtggagcccagccgggaggagcccctggtgtccctggagggcagcaacagcgctgtgaccatggagctgtctgagcctgtggtggagaatggagaggtggagatggccctggaggagagctgggagcacagcaaggaggtgtctgaggccgagcccggcggcggcagcagcggggacagcggccccccagaggagagcggccaggagatgatggaggagaaggaggagatcaggaagagcaagtctgtgattgtgcccagcggggcccccaagaaggagcacgtgaatgtggtgttcatcggccacgtggatgctgggaagagcaccatcggcggccagatcatgttcctgaccggcatggtggacaagaggaccctggagaagtatgaaagagaggccaaggagaagaaccgggagacctggtacctgtcctgggccctggacaccaaccaggaggagcgggacaagggcaagacagtggaggtgggccgggcctactttgaaacagagaggaagcacttcaccatcctggatgcccctggccacaagagctttgtgcccaacatgattggaggagccagccaggccgacctggccgtgctggtgatcagcgccaggaagggggagtttgaaacaggctttgagaagggcggccagacccgggagcacgccatgctggccaagacagctggggtgaagcacctgattgtgctgatcaacaagatggatgaccccaccgtgaactggagcattgaaagatatgaggagtgcaaggagaagctggtgcccttcctgaagaaggtgggcttcagccccaagaaggacatccacttcatgccctgcagcggcctgaccggggccaacatcaaggagcagagcgacttctgcccctggtacacaggcctgcccttcatcccctacctggacaacctgcccaacttcaacagaagcattgatggccccatccggctgcccatcgtggacaagtacaaggacatgggcaccgtggtgctgggcaagctggagagcggcagcatcttcaagggccagcagctggtgatgatgcccaacaagcacaacgtggaggtgctgggcatcctgagtgatgacacagaaacagactttgtggcccctggagagaacctgaagatccggctgaagggcatcgaggaggaggagatcctgcccggcttcatcctgtgtgaccccagcaacctgtgccacagcggccgcacctttgatgtgcagatcgtcatcatcgagcacaagagcatcatctgccccggctacaatgctgtgctgcacatccacacctgcatcgaggaggtggagatcacagccctgatcagcctggtggacaagaagtctggagagaagagcaagacccggcccaggtttgtgaagcaggaccaggtgtgcatcgcccggctgaggacagctggcaccatctgcctggagaccttcaaggacttcccccagatgggccgcttcaccctgagagatgagggcaagaccatcgccatcggcaaggtgctgaagctggtgcctgagaaggactag

SEQ ID NO: 153346 - DNA, 1638 bp, Artificial Sequence
  Description of Artificial Sequence: Synthetic coding sequence
atggattctggcagcaatgatgagacctgcacaggagctggctacccccagggcaagaggatgggccgcggggcccctgtggagcccagccgggaggagcccctggtgtccctggagggcagcaacagcgctgtgaccatggagctgtctgagcctgtggtggagaatggagaggtggagatggccctggaggagagctgggagcacagcaaggaggtgtctgaggccgagcccggcggcggcagcagcggggacagcggccccccagaggagagcggccaggagatgatggaggagaaggaggagatcaggaagagcaagagcgtcatcgtgcccagcggggcccccaagaaggagcacgtgaatgtggtgttcatcggccacgtggatgctgggaagagcaccatcggcggccagatcatgttcctgaccggcatggtggacaagaggaccctggagaagtatgagcgggaggccaaggagaagaaccgggagacctggtacctgtcctgggccctggacaccaaccaggaggagcgggacaagggcaagacagtggaggtgggccgggcctactttgaaacagagaggaagcacttcaccatcctggatgcccctggccacaagagctttgtgcccaacatgattggaggagccagccaggccgacctggccgtgctggtgatcagcgccaggaaaggagaatttgagaccggctttgagaagggcggccagacccgggagcacgccatgctggccaagacagctggggtgaagcacctgattgtgctgatcaacaagatggatgaccccaccgtgaactggagcattgaaagatatgaggagtgcaaggagaagctggtgcccttcctgaagaaggtgggcttcagccccaagaaggacatccacttcatgccctgcagcggcctgactggagccaacatcaaggagcagagcgacttctgcccctggtacacaggcctgcccttcatcccctacctggacaacctgcccaacttcaacagaagcattgatggccccatccggctgcccatcgtggacaagtacaaggacatgggcaccgtggtgctgggcaagctggagagcggcagcatcttcaagggccagcagctggtgatgatgcccaacaagcacaacgtggaggtgctgggcatcctgagtgatgacacagaaacagactttgtggcccctggagagaacctgaagatccggctgaagggcatcgaggaggaggagatcctgcccggcttcatcctgtgtgaccccagcaacctgtgccacagcggccgcacctttgatgtgcagatcgtcatcatcgagcacaagagcatcatctgccccggctacaatgctgtgctgcacatccacacctgcatcgaggaggtggagatcacagccctgatcagcctggtggacaagaagagcggggagaagagcaagacccggcccaggtttgtgaagcaggaccaggtgtgcatcgcccggctgaggacagctggcaccatctgcctggagaccttcaaggacttcccccagatgggccgcttcaccctgagagatgagggcaagaccatcgccatcggcaaggtgctgaagctggtgcctgagaaggactag

SEQ ID NO: 153347 - DNA, 1365 bp, Artificial Sequence
  Description of Artificial Sequence: Synthetic coding sequence
atgaccaagcgggaggccgaggagctgattgaaattgaaattgatggaacagagaaggcagaatgtacagaggagagcatcgtggagcagacctacgccccagcagaatgtgtgtcccaggccatcgacatcaatgagcccatcggcaacctgaagaagctgctggagccccggctgcagtgcagcctggatgcccacgagatctgcctgcaggacatccagctggaccctgagaggagcctgtttgaccagggcgtgaagacagatggcaccgtgcagctgtctgtgcaggtgatctcctaccagggcatcgagcccaagctgaacatcctggagatcgtgaagccagctgacacagtggaggtggtgattgatcctgatgcccaccacgccgagagcgaggcccacctggtggaggaggcccaggtgatcaccctggatggcaccaagcacatcaccaccatcagtgatgagaccagcgagcaggtgacccgctgggccgccgccctggagggctacaggaaggagcaggagcggctgggcatcccctatgaccccatccagtggagcacagaccaggtgctgcactgggtggtgtgggtgatgaaggagttctccatgacagacatcgacctgaccaccctgaacatcagcggccgggagctgtgcagcctgaaccaggaggacttcttccagagggtgcccagaggagagatcctgtggagccacctggagctgctgaggaaatatgtgctggccagccaggagcagcagatgaatgagatcgtgaccatcgaccagcctgtgcagatcatcccagcctctgtgcagagcgccacccccaccaccatcaaggtgatcaacagcagcgccaaggccgccaaggtgcagagggccccccgcatctctggagaagatagaagcagccctggcaacagaacaggcaacaacggccagatccagctgtggcagttcctgctggagctgctgacagacaaggatgcccgggactgcatctcctgggtgggagatgaaggagagttcaagctgaaccagcctgagctggtggcccagaagtggggccagaggaagaacaagcccaccatgaactatgagaagctgagccgggccctgcgctactactatgatggagacatgatctgcaaggtgcagggcaagagatttgtgtacaagtttgtgtgtgacctgaagaccctgattggctacagcgctgctgagctgaaccggctggtgacagaatgtgagcagaagaagctggccaagatgcagctgcacggcatcgcccagcctgtgacagctgtggccctggccacagccagcctgcagacagagaaggacaactag

SEQ ID NO: 153348 - DNA, 1365 bp, Artificial Sequence; identical to SEQ ID NO: 153347
  Description of Artificial Sequence: Synthetic coding sequence

SEQ ID NO: 153349 - DNA, 2163 bp, Artificial Sequence
  Description of Artificial Sequence: Synthetic coding sequence
atggcccagggcctggaggtggccctgacagacctgcagagcagcaggaacaacgtgcgccaccacacagaggagatcaccgtggaccacctgctggtgcggcggggccaggccttcaacctgaccctgtacttcaggaacagaagcttccagcccggcctggacaacatcatctttgtggtggagaccggccccctgcctgacctggccctgggcaccagggctgtgttcagcctggcccggcaccacagccccagcccctggatcgcctggctggagaccaatggagccaccagcacagaggtgtccctgtgtgccccacccacagctgctgtgggccgctacctgctgaagatccacatcgacagcttccagggctctgtgacagcctaccagctgggggagttcatcctgctcttcaacccctggtgcccagaagatgctgtgtacctggacagcgagccccagaggcaggagtatgtgatgaatgactatggcttcatctaccagggcagcaagaactggatccggccctgcccctggaactacggccagtttgaggacaagatcatcgacatctgcctgaagctgctggacaagagcctgcacttccagacagatcctgccacagactgtgccctgcggggcagccctgtgtatgtgtcccgggtggtgtgtgccatgatcaacagcaatgatgacaatggagtgctgaatggaaactggagcgagaactacacagatggagccaacccagctgagtggacaggctctgtggccatcctgaagcagtggaatgccaccggctgccagcctgtgcgctatggccagtgctgggtgtttgctgctgtgatgtgcaccgtgatgcgctgcctgggcatccccaccagggtcatcaccaactttgacagcggccatgacacagatggcaacctgatcattgatgagtactatgacaacacaggccgcatcctgggcaacaagaagaaggacaccatctggaacttccacgtgtggaatgaatgctggatggccaggaaggacctgcccccagcctatggaggctggcaggtgctggatgccaccccccaggagatgagcaatggagtgtactgctgcggccctgcctctgtgcgggccatcaaggagggggaggtggacctgaactatgacaccccatttgtgttctccatggtgaatgctgactgcatgtcctggctggtgcagggcggcaaggagcagaagctgcaccaggacaccagctctgtgggcaacttcatcagcaccaagagcatccagagtgatgaaagagatgacatcacagagaactacaagtatgaggagggcagcctgcaggagcggcaggtgttcctgaaggccctgcagaagctgaaggcccggagcttccacggcagccagagaggagctgagctgcagcccagccggcccaccagcctgagccaggacagccccaggagcctgcacacccccagcctgcggcccagtgatgtggtgcaggtgtccctgaagttcaagctgctggacccccccaacatgggccaggacatctgctttgtgctgctggccctgaacatgagcagccagttcaaggacctgaaggtgaacctgagcgcccagagcctgctgcatgatggcagccccctgagccccttctggcaggacacagccttcatcaccctgagccccaaggaggccaagacctacccctgcaagatctcctacagccagtacagccagtacctgagcacagacaagctgatccgcatcagcgccctgggggaggagaagagcagccctgagaagatcctggtgaacaagatcatcaccctgagctaccccagcatcaccatcaacgtgctgggcgctgctgtggtgaaccagcccctgagcatccaggtgatcttcagcaaccccctgtctgagcaggtggaggactgtgtgctgactgtggagggcagcggcctcttcaagaagcagcagaaggtgttcctgggcgtgctgaagccccagcaccaggccagcatcatcctggagaccgtgcccttcaagagcggccagaggcagatccaggccaacatgaggagcaacaagttcaaggacatcaagggctacagaaatgtgtatgtggactttgccctgtag

SEQ ID NO: 153350 - DNA, 1047 bp, Artificial Sequence
  Description of Artificial Sequence: Synthetic coding sequence
atgagcctggtggacctgggcaagaagctgctggaggccgcccgggccggccaggatgatgaggtgcgcatcctgatggccaacggggcccccttcaccacagactggctgggcaccagccccctgcacctggccgcccagtatggccactacagcaccacagaggtgctgctgcgggccggcgtgtccagagatgcccggaccaaggtggacaggacccccctgcacatggccgccagcgagggccacgccagcatcgtggaggtgctgctgaagcatggagcagatgtgaatgccaaggacatgctgaagatgacagccctgcactgggccacagagcacaaccaccaggaggtggtggagctgctgatcaagtacggggctgatgtgcacacccagagcaagttctgcaagacagcctttgacatcagcattgacaatggaaatgaagacctggccgagatcctgcagatcgccatgcagaaccagatcaacaccaaccctgagagcccagacacagtgaccatccacgccgccaccccccagttcatcatcggccctggaggagtggtgaacctgacagatgaaacaggagtgtctgctgtgcagtttggaaacagcagcacctctgtgctggccaccctggccgccctggccgaggccagcgcccccctgagcaacagcagcgagacccctgtggtggccacagaggaggtggtgacagctgagagcgtggatggagccatccagcaggtggtgtcctctgggggccagcaggtgatcaccatcgtgacagatggcatccagctgggcaacctgcacagcatccccaccagcggcatcggccagcccatcatcgtgaccatgccagatggccagcaggtgctgactgtgcctgccacagacattgctgaggagaccgtcatcagcgaggagcccccagccaagaggcagtgcatcgagatcatcgagaacagagtggagagcgctgagattgaggtgcgcagcctgctgcccggggtgctgtgccgcagccaccccaagtag

SEQ ID NO: 153351 - DNA, 1152 bp, Artificial Sequence
  Description of Artificial Sequence: Synthetic coding sequence
atgagcctggtggacctgggcaagaagctgctggaggccgcccgggccggccaggatgatgaggtgcgcatcctgatggccaacggggcccccttcaccacagactggctgggcaccagccccctgcacctggccgcccagtatggccactacagcaccacagaggtgctgctgcgggccggcgtgtccagagatgcccggaccaaggtggacaggacccccctgcacatggccgccagcgagggccacgccagcatcgtggaggtgctgctgaagcatggagcagatgtgaatgccaaggacatgctgaagatgacagccctgcactgggccacagagcacaaccaccaggaggtggtggagctgctgatcaagtacggggctgatgtgcacacccagagcaagttctgcaagacagcctttgacatcagcattgacaatggaaatgaagacctggccgagatcctgcagatcgccatgcagaaccagatcaacaccaaccctgagagcccagacacagtgaccatccacgccgccaccccccagttcatcatcggccctggaggagtggtgaacctgacagatgaaacaggagtgtctgctgtgcagtttggaaacagcagcacctctgtgctggccaccctggccgccctggccgaggccagcgcccccctgagcaacagcagcgagacccctgtggtggccacagaggaggtggtgacagctgagagcgtggatggagccatccagcaggtggtgtcctctgggggccagcaggtgatcaccatcgtgacagatggcatccagctgggcaacctgcacagcatccccaccagcggcatcggccagcccatcatcgtgaccatgccagatggccagcaggtgctgactgtgcctgccacagacattgctgaggagaccgtcatcagcgaggagcccccagccaagaggcagtgcatcgagatcatcgagaacagagtggagagcgctgagattgaggagcgggaggccctgcagaagcagctggatgaggccaaccgggaggcccagaagtaccggcagcagctgctgaagaaggagcaggaggccgaggcctaccggcagaagctggaggccatgacccggctgcagaccaacaaggaggccgtgtag

SEQ ID NO: 153352 - DNA, 1047 bp, Artificial Sequence; identical to SEQ ID NO: 153350
  Description of Artificial Sequence: Synthetic coding sequence

SEQ ID NO: 153353 - DNA, 1083 bp, Artificial Sequence
  Description of Artificial Sequence: Synthetic coding sequence
atgagcctggtggacctgggcaagaagctgctggaggccgcccgggccggccaggatgatgaggtgcgcatcctgatggccaacggggcccccttcaccacagactggctgggcaccagccccctgcacctggccgcccagtatggccactacagcaccacagaggtgctgctgcgggccggcgtgtccagagatgcccggaccaaggtggacaggacccccctgcacatggccgccagcgagggccacgccagcatcgtggaggtgctgctgaagcatggagcagatgtgaatgccaaggacatgctgaagatgacagccctgcactgggccacagagcacaaccaccaggaggtggtggagctgctgatcaagtacggggctgatgtgcacacccagagcaagttctgcaagacagcctttgacatcagcattgacaatggaaatgaagacctggccgagatcctgcagatcgccatgcagaaccagatcaacaccaaccctgagagcccagacacagtgaccatccacgccgccaccccccagttcatcatcggccctggaggagtggtgaacctgaccggcctggtgtcctctgagaacagcagcaaggccacagatgaaacaggagtgtctgctgtgcagtttggaaacagcagcacctctgtgctggccaccctggccgccctggccgaggccagcgcccccctgagcaacagcagcgagacccctgtggtggccacagaggaggtggtgacagctgagagcgtggatggagccatccagcaggtggtgtcctctgggggccagcaggtgatcaccatcgtgacagatggcatccagctgggcaacctgcacagcatccccaccagcggcatcggccagcccatcatcgtgaccatgccagatggccagcaggtgctgactgtgcctgccacagacattgctgaggagaccgtcatcagcgaggagcccccagccaagaggcagtgcatcgagatcatcgagaacagagtggagagcgctgagattgaggtgcgcagcctgctgcccggggtgctgtgccgcagccaccccaagtag

SEQ ID NO: 153354 - DNA, 270 bp, Artificial Sequence
  Description of Artificial Sequence: Synthetic coding sequence
atgagcctggtggacctgggcaagaagctgctggaggccgcccgggccggccaggatgatgaggtgcgcatcctgatggccaacggggcccccttcaccacagactggctgggcaccagccccctgcacctggccgcccagtatggccactacagcaccacagaggtgctgctgcgggccggcgtgtccagagatgcccggaccaaggtggacaggacccccctgcacatggccgccagcgagggccacgccagcatcgtggaggtgtag

SEQ ID NO: 153355 - DNA, 270 bp, Artificial Sequence; identical to SEQ ID NO: 153354
  Description of Artificial Sequence: Synthetic coding sequence

SEQ ID NO: 153356 - DNA, 354 bp, Artificial Sequence
  Description of Artificial Sequence: Synthetic coding sequence
atgaagtttgtgtacaaggaggagcacccctttgagaagagaagaagtgaaggagagaagatcaggaagaagtacccagacagagtgcctgtgattgtggagaaggcccccaaggccagaattggagacctggacaagaagaagtacctggtgcccagcgacctgactgtgggccagttctacttcctgatcaggaagaggatccacctgcgggcagaagatgccctcttcttctttgtgaacaacgtcatcccccccaccagcgccaccatgggccagctgtaccaggagcaccacgaggaggacttcttcctgtacatcgcctacagtgatgaatctgtgtatggcctgtag

SEQ ID NO: 153357 - DNA, 354 bp, Artificial Sequence
  Description of Artificial Sequence: Synthetic coding sequence
atgaagttccagtacaaggaggaccacccctttgagtacaggaagaaggagggggagaagatcaggaagaagtacccagacagagtgcctgtgattgtggagaaggcccccaaggcccgggtgcctgacctggacaagaggaagtacctggtgcccagcgacctgactgtgggccagttctacttcctgatcaggaagaggatccacctgcggccagaagatgccctcttcttctttgtgaacaacaccatcccccccaccagcgccaccatgggccagctgtatgaggacaaccacgaggaggactacttcctgtatgtggcctacagtgatgaatctgtgtatggcaagtag

SEQ ID NO: 153358 - DNA, 441 bp, Artificial Sequence
  Description of Artificial Sequence: Synthetic coding sequence
atgaagttccagtacaaggaggaccacccctttgagtacaggaagaaggagggggagaagatcaggaagaagtacccagacagagtgcctgtgattgtggagaaggcccccaaggcccgggtgcctgacctggacaagaggaagtacctggtgcccagcgacctgactgtgggccagttctacttcctgatcaggaagaggatccacctgcggccagaagatgccctcttcttctttgtgaacaacaccatcccccccaccagcgccaccatgggccagctgtatgaggtgatggtgctggtggcccagtactggatgcccagcagcgctgtgtggcaccccctggccctggtgctggatgccctgatcacccacctgcggagcggggctgagggcgtcatctacccagaccccctgacctacggctctgtgcggctgtag

SEQ ID NO: 153359 - DNA, 441 bp, Artificial Sequence; identical to SEQ ID NO: 153358
  Description of Artificial Sequence: Synthetic coding sequence

SEQ ID NO: 153360 - DNA, 213 bp, Artificial Sequence
  Description of Artificial Sequence: Synthetic coding sequence
atgaagttccagtacaaggaggaccacccctttgagtacaggaagaaggagggggagaagatcaggaagaagtacccagacagagtgcctgtgattgtggagaaggcccccaaggcccgggtgcctgacctggacaagaggaagtacctggtgcccagcgacctgactgtgggccagttctacttcctgatcaggaagaggatccacctgtag

SEQ ID NO: 153361 - DNA, 354 bp, Artificial Sequence; identical to SEQ ID NO: 153357
  Description of Artificial Sequence: Synthetic coding sequence

SEQ ID NO: 153362 - DNA, 354 bp, Artificial Sequence
  Description of Artificial Sequence: Synthetic coding sequence
atgaagtggatgttcaaggaggaccacagcctggagcaccgctgtgtggagagcgccaagatccgggccaagtacccagacagagtgcctgtgattgtggagaaggtgtctggcagccagatcgtggacatcgacaagaggaagtacctggtgcccagcgacatcaccgtggcccagttcatgtggatcatcaggaagaggatccagctgcccagcgagaaggccatcttcctgtttgtggacaagacagtgccccagagcagcctgaccatgggccagctgtatgagaaggagaaggatgaagatggcttcctgtatgtggcctacagcggggagaacaccttcggcttctag

SEQ ID NO: 153363 - DNA, 1344 bp, Artificial Sequence
  Description of Artificial Sequence: Synthetic coding sequence
atgcctgtgctgtatgaccggctgctgaagctgaaggagatgttcaacagcaagtttggcagcatccccaagttctacgtgcgggcccctggccgggtgaacatcatcggggagcacatcgactactgcggctacagcgtgctgcccatggctgtggagcaggatgtgctgattgctgtggagcctgtgaagacctacgccctgcagctggccaacaccaaccccctgtacccagacttcagcaccagcgccaacaacatccagattgacaagaccaagcccctgtggcacaactacttcctgtgtggcctgaagggcatccaggagcacttcggcctgagcaacctgaccggcatgaactgcctggtggatggcaacatcccccccagcagcggcctgagcagcagcagcgccctggtgtgctgtgccggcctggtgaccctgactgtgctgggcaggaacctgagcaaggtggagctggccgagatctgtgccaagtctgagcgctacatcggcacagaaggaggcggcatggaccagagcatctccttcctggccgaggagggcacagccaagctgattgagttcagccccctgcgggccacagatgtgaagctgcccagcggggctgtgtttgtgattgccaacagctgtgtggagatgaacaaggccgccaccagccacttcaacatccgggtgatggagtgccgcctggccgccaagctgctggccaagtacaagagcctgcagtgggacaaggtgctgcggctggaggaggtgcaggccaagctgggcatcagcctggaggagatgctgctggtgacagaagatgccctgcaccctgagccctacaaccctgaggagatctgccgctgcctgggcatcagcctggaggagctgcggacccagatcctgagccccaacacccaggatgtgctgatcttcaagctgtaccagagggccaagcacgtgtacagcgaggccgcccgggtgctgcagttcaagaagatctgtgaggaggcccctgagaacatggtgcagctgctgggggagctgatgaaccagagccacatgagctgccgggacatgtatgaatgtagctgcccagagctggaccagctggtggacatctgcaggaagtttggagcccagggcagccggctgactggagctggctggggcggctgcaccgtgtccatggtgcctgctgacaagctgcccagcttcctggccaacgtgcacaaggcctactaccagaggagtgatggcagcctggcccctgagaagcagagcctgtttgccaccaagccaggcggcggggccctggtgctgctggaggcctag

SEQ ID NO: 153364 - DNA, 1305 bp, Artificial Sequence
  Description of Artificial Sequence: Synthetic coding sequence
atgttcaacagcaagtttggcagcatccccaagttctacgtgcgggcccctggccgggtgaacatcattggagagcacatcgactactgcggctacagcgtgctgcccatggctgtggagcaggatgtgctgattgctgtggagcctgtgaagacctacgccctgcagctggccaacaccaaccccctgtacccagacttcagcaccagcgccaacaacatccagattgacaagaccaagcccctgtggcacaactacttcctgtgtggcctgaagggcatccaggagcacttcggcctgagcaacctgaccggcatgaactgcctggtggatggcaacatcccccccagcagcggcctgagcagcagcagcgccctggtgtgctgtgccggcctggtgaccctgactgtgctgggcaggaacctgagcaaggtggagctggccgagatctgtgccaagtctgagcgctacatcggcacagagggcggcggcatggaccagagcatctccttcctggccgaggagggcacagccaagctgattgagttcagccccctgcgggccacagatgtgaagctgcccagcggggctgtgtttgtgattgccaacagctgtgtggagatgaacaaggccgccaccagccacttcaacatccgggtgatggagtgccgcctggccgccaagctgctggccaagtacaagagcctgcagtgggacaaggtgctgcggctggaggaggtgcaggccaagctgggcatcagcctggaggagatgctgctggtgacagaagatgccctgcaccctgagccctacaaccctgaggagatctgccgctgcctgggcatcagcctggaggagctgcggacccagatcctgagccccaacacccaggatgtgctgatcttcaagctgtaccagagggccaagcacgtgtacagcgaggccgcccgggtgctgcagttcaagaagatctgtgaggaggcccctgagaacatggtgcagctgctgggggagctgatgaaccagagccacatgagctgccgggacatgtatgagtgcagctgcccagagctggaccagctggtggacatctgcaggaagtttggagcccagggcagccggctgaccggggccggctggggcggctgcaccgtgtccatggtgcctgctgacaagctgcccagcttcctggccaacgtgcacaaggcctactaccagaggagtgatggcagcctggcccctgagaagcagagcctgtttgccaccaagccaggcggcggggccctggtgctgctggaggcctag

SEQ ID NO: 153365 - DNA, 624 bp, Artificial Sequence
  Description of Artificial Sequence: Synthetic coding sequence
atgaactgcctggtggatggcaacatcccccccagcagcggcctgagcagcagcagcgccctggtgtgctgtgccggcctggtgaccctgactgtgctgggcaggaacctgagcaaggtggagctggccgagatctgtgccaagtctgagcgctacatcggcacagaaggaggcggcatggaccagagcatctccttcctggccgaggagggcacagccaagctgattgagttcagccccctgcgggccacagatgtgaagctgcccagcggggctgtgtttgtgattgccaacagctgtgtggagatgaacaaggccgccaccagccacttcaacatccgggtgatggagtgccgcctggccgccaagctgctggccaagtacaagagcctgcagtgggacaaggtgctgcggctggaggaggtgcaggccaagctgggcatcagcctggaggagatgctgctggtgacagaagatgccctgcaccctgagccctacaaccctgaggagatctgccgctgcctgggcatcagcctggaggagctgcggacccagatcctgagccccaacacccaggatgatggagtggtgctgtacagacctggctggagcgccacagcctag

SEQ ID NO: 153366 - DNA, 1305 bp, Artificial Sequence; identical to SEQ ID NO: 153364
  Description of Artificial Sequence: Synthetic coding sequence

SEQ ID NO: 153367 - DNA, 1305 bp, Artificial Sequence; identical to SEQ ID NO: 153364
  Description of Artificial Sequence: Synthetic coding sequence

SEQ ID NO: 153368 - DNA, 1377 bp, Artificial Sequence
  Description of Artificial Sequence: Synthetic coding sequence
atggccacagagagccctgccaccaggagagtgcaggtggccgagcacccccggctgctgaagctgaaggagatgttcaacagcaagtttggcagcatccccaagttctacgtgcgggcccctggccgggtgaacatcattggagagcacatcgactactgcggctacagcgtgctgcccatggctgtggagcaggatgtgctgattgctgtggagcctgtgaagacctacgccctgcagctggccaacaccaaccccctgtacccagacttcagcaccagcgccaacaacatccagattgacaagaccaagcccctgtggcacaactacttcctgtgtggcctgaagggcatccaggagcacttcggcctgagcaacctgaccggcatgaactgcctggtggatggcaacatcccccccagcagcggcctgagcagcagcagcgccctggtgtgctgtgccggcctggtgaccctgactgtgctgggcaggaacctgagcaaggtggagctggccgagatctgtgccaagtctgagcgctacatcggcacagagggcggcggcatggaccagagcatctccttcctggccgaggagggcacagccaagctgattgagttcagccccctgcgggccacagatgtgaagctgcccagcggggctgtgtttgtgattgccaacagctgtgtggagatgaacaaggccgccaccagccacttcaacatccgggtgatggagtgccgcctggccgccaagctgctggccaagtacaagagcctgcagtgggacaaggtgctgcggctggaggaggtgcaggccaagctgggcatcagcctggaggagatgctgctggtgacagaagatgccctgcaccctgagccctacaaccctgaggagatctgccgctgcctgggcatcagcctggaggagctgcggacccagatcctgagccccaacacccaggatgtgctgatcttcaagctgtaccagagggccaagcacgtgtacagcgaggccgcccgggtgctgcagttcaagaagatctgtgaggaggcccctgagaacatggtgcagctgctgggggagctgatgaaccagagccacatgagctgccgggacatgtatgagtgcagctgcccagagctggaccagctggtggacatctgcaggaagtttggagcccagggcagccggctgaccggggccggctggggcggctgcaccgtgtccatggtgcctgctgacaagctgcccagcttcctggccaacgtgcacaaggcctactaccagaggagtgatggcagcctggcccctgagaagcagagcctgtttgccaccaagccaggcggcggggccctggtgctgctggaggcctag

SEQ ID NO: 153369 - DNA, 1272 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggttccactatgatgaggtgcggggcctggtgcccaccaatgccatcttcatcaccgtgctgcgggaccctgcccggctgtttgagagcagcttccactactttggacctgtggtgcccctgacctggaagctgtctgctggggacaagctgacagagttcctgcaggaccctgaccgctactatgaccccaacggcttcaatgcccactacctgaggaacctgctcttctttgacctgggctatgacaacagcctggaccccagcagcccccaggtgcaggagcacatcctggaggtggagcggcgcttccacctggtgctgctgcaggagtactttgatgagagcctggtgctgctgaaggacctgctgtgctgggagctggaggatgtgctgtacttcaagctgaatgcccggcgggacagccctgtgccccggctgagcggggagctgtatggccgggccacagcctggaacatgctggacagccacctgtaccgccacttcaatgccagcttctggaggaaggtggaggccttcggccgggagaggatggcccgggaggtggccgccctgcggcatgccaatgaaagaatgaggaccatctgcattgatggcggccatgctgtggatgctgctgccatccaggatgaggccatgcagccctggcagcccctgggcaccaagagcatcctgggctacaacctgaagaagagcatcggccagagacatgcccagctgtgcaggaggatgctgaccccagagatccagtacctgatggacctgggcgccaacctgtgggtgaccaagctgtggaagttcatccgggacttcctgcgctggtag

SEQ ID NO: 153370 - DNA, 1272 bp, Artificial Sequence; identical to SEQ ID NO: 153369
  Description of Artificial Sequence: Synthetic coding sequence

SEQ ID NO: 153371 - DNA, 1272 bp, Artificial Sequence; identical to SEQ ID NO: 153369
  Description of Artificial Sequence: Synthetic coding sequence

SEQ ID NO: 153372 - DNA, 1272 bp, Artificial Sequence; identical to SEQ ID NO: 153369
  Description of Artificial Sequence: Synthetic coding sequence

SEQ ID NO: 153373 - DNA, 1272 bp, Artificial Sequence; identical to SEQ ID NO: 153369
  Description of Artificial Sequence: Synthetic coding sequence

SEQ ID NO: 153374 - DNA, 1272 bp, Artificial Sequence; identical to SEQ ID NO: 153369
  Description of Artificial Sequence: Synthetic coding sequence

SEQ ID NO: 153375 - DNA, 258 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagtag

SEQ ID NO: 153376 - DNA, 513 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggttccactatgatgaggtgcggggcctggtgcccaccaatgccatcttcatcaccgtgctgcgggaccctgcccggctcttctag

SEQ ID NO: 153377 - DNA, 450 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggttccactatgatgaggtgtag

SEQ ID NO: 153378 - DNA, 300 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggctag

SEQ ID NO: 153379 - DNA, 312 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcacaggtag

SEQ ID NO: 153380 - DNA, 600 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggttccactatgatgaggtgcggggcctggtgcccaccaatgccatcttcatcaccgtgctgcgggaccctgcccggctgtttgagagcagcttccactactttggacctgtggtgcccctgacctggaagctgtctgctggggacaagctgacagagttcctgcaggactag

SEQ ID NO: 153381 - DNA, 840 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggttccactatgatgaggtgcggggcctggtgcccaccaatgccatcttcatcaccgtgctgcgggaccctgcccggctgtttgagagcagcttccactactttggacctgtggtgcccctgacctggaagctgtctgctggggacaagctgacagagttcctgcaggaccctgaccgctactatgaccccaacggcttcaatgcccactacctgaggaacctgctcttctttgacctgggctatgacaacagcctggaccccagcagcccccaggtgcaggagcacatcctggaggtggagcggcgcttccacctggtgctgctgcaggagtactttgatgagagcctggtgctgctgaaggacctgctgtgctgggagctggaggatgtgctgtacttcaagctgaactag

SEQ ID NO: 153382 - DNA, 1272 bp, Artificial Sequence; identical to SEQ ID NO: 153369
  Description of Artificial Sequence: Synthetic coding sequence

SEQ ID NO: 153383 - DNA, 432 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggtag

SEQ ID NO: 153384 - DNA, 231 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggtag

SEQ ID NO: 153385 - DNA, 288 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctgtag

SEQ ID NO: 153386 - DNA, 216 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtag

SEQ ID NO: 153387 - DNA, 729 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagaagcaccggctgaagtttgccttccccaacggcagaaatgactttgactaccccaccttctttgcccggagcctggtgcaggactacagacctggggcctgcttcaacatcatctgcaaccacatgaggttccactatgatgaggtgcggggcctggtgcccaccaatgccatcttcatcaccgtgctgcgggaccctgcccggctgtttgagagcagcttccactactttggacctgtggtgcccctgacctggaagctgtctgctggggacaagctgacagagttcctgcaggaccctgaccgctactatgaccccaacggcttcaatgcccactacctgaggaacctgctcttctttgacctgggctatgacaacagcctggaccccagcagcccccaggtgcaggagcacatcctggaggtgtag

SEQ ID NO: 153388 - DNA, 303 bp, Artificial Sequence
  Description of Artificial Sequence: Synthetic coding sequence
atgctgcccccccagaagaagccctgggagagcatggccaagggcctggtgctgggcgccctcttcaccagcttcctgctgctggtgtacagctatgctgtgccccccctgcatgctggcctggccagcaccaccccagaggccgccgccagctgcagccccccagccctggagcctgaggccgtcatccgggccaacggcagcgctggggagtgccagcccaggaggaacatcgtgttcctgaagacccacaagacagccagcagcaccctgctgaacatcctcttccgcttcggccagtag

SEQ ID NO: 153389 - DNA, 1197 bp, Artificial Sequence
  Description of Artificial Sequence: Synthetic coding sequence
atgatgtccatgctgggcggcctgcagcgctacttccgggtcatcctgctgctgctgctggccctgaccctgctgctgctggccggcttcctgcacagcgacctggagctggacacccccctgtttggaggccaggccgagggcccccctgtgaccaacatcatgttcctgaagacccacaagacagccagcagcacagtgctgaacatcctgtacagatttgctgagacccacaacctgtctgtggccctgcctgctggcagccgggtgcacctgggctacccctggctgttcctggcccgctacgtggagggcgtgggcagccagcagcgcttcaacatcatgtgcaaccacctgcgcttcaacctgccccaggtgcagaaggtgatgcccaatgacaccttctacttcagcatcctgagaaatcctgtgttccagctggagagcagcttcatctactacaagacctacgccccagccttccggggggcccccagcctggatgccttcctggccagccccaggaccttctacaatgacagccgccacctgagaaatgtgtatgccaagaacaacatgtggtttgattttggatttgaccccaatgcccagtgtgaggagggctacgtgcgggccagaattgctgaggtggagcggcgcttccggctggtgctgattgctgagcacctggatgagagcctggtgctgctgcggcggcggctgcgctgggccctggatgatgtggtggccttccggctgaacagccgcagcgcccggtctgtggcccggctgagccctgagacccgggagcgggcccgctcctggtgtgccctggactggaggctgtatgagcacttcaacagaaccctgtgggcccagctgcgggcagagctgggcccccggcggctgcggggggaggtggagcggctgcgggcccggcggcgggagctggccagcctgtgcctgcaggacggcggggccctgaagaaccacacccagatccgggacccccggctgcggccctaccagagcggcaaggctgacatcctgggctacaacctgcggcccggcctggacaaccagaccctgggcgtgtgccagaggctggtgatgcctgagctgcagtacatggcccggctgtatgccctgcagtttcctgagaagcccctgaagaacatccccttcctgggcgcctag

SEQ ID NO: 153390 - DNA, 1296 bp, Artificial Sequence
  Description of Artificial Sequence: Synthetic coding sequence
atgccacccatcctgcagaggctgcagcaggccaccaagatgatgagcaggaggaagatcctgctgctggtgctgggctgcagcacagtgtccctgctgatccaccagggcgcccagctgtcctggtaccccaagctgttccccctgagctgcccccccctgaggaacagccccccccggcccaagcacatgacagtggccttcctgaagacccacaagacagctggcaccaccgtgcagaacatcctcttccgctttgctgagcggcacaacctgactgtggccctgccccaccccagctgtgagcaccagttctgctaccccaggaacttcagcgcccactttgtgcacccagccacccggcccccccacgtgctggccagccacctgcgctttgacagagctgagctggagcggctgatgccacccagcacagtgtatgtgaccatcctgcgggagcctgctgccatgtttgagagcctcttctcctactacaaccagtactgcccagccttcagaagagtgcccaatgccagcctggaggccttcctgcgggcccctgaggcctactacagagctggggagcactttgccatgtttgcccacaacaccctggcctatgacctgggcggggacaatgaaagaagccccagagatgatgctgcctacctggccggcctcatccggcaggtggaggaggtgttcagcctggtgatgattgctgagtactttgatgagagcctggtgctgctgcggcggctgctggcctgggacctggatgatgtgctgtatgccaagctgaatgcccgggccgccagcagccggctggccgccatcccagctgccctggcccgggccgcccggacctggaatgccctggatgctggcctgtatgaccacttcaatgccaccttctggaggcatgtggcccgggccggccgggcctgtgtggagcgggaggcccgggagctgcgggaggcccggcagaggctgctgcggcgctgctttggagatgagcccctgctgcggcctgctgcccagatccgcaccaagcagctgcagccctggcagcccagcaggaaggtggacatcatgggctatgacctgcccggcggcggggccggccctgccacagaggcctgcctgaagctggccatgcctgaggtgcagtacagcaactacctgctgaggaagcagaagagaagaggaggagcccgggcccggcctgagcctgtgctggacaaccccccaccccggcccatccgggtgctgccccggggcccccagggcccctag

SEQ ID NO: 153391 - DNA, 1296 bp, Artificial Sequence; identical to SEQ ID NO: 153390
  Description of Artificial Sequence: Synthetic coding sequence

SEQ ID NO: 153392 - DNA, 1461 bp, Artificial Sequence
  Description of Artificial Sequence: Synthetic coding sequence
atgggccccctgagccctgcccggaccctgcggctgtggggccccaggagcctgggcgtggccctgggcgtcttcatgaccatcggctttgccctgcagctgctgggcggccccttccagaggcggctgcccggcctgcagctgcggcagcccagcgcccccagcctgcggcctgccctgcccagctgccccccccggcagaggctggtgttcctgaagacccacaagagcggcagcagctctgtgctgagcctgctgcacagatatggagaccagcacggcctgcgctttgccctgcctgcccgctaccagtttggctaccccaagctgttccaggccagccgggtgaagggctaccggccccagggcggcggcacccagctgcccttccacatcctgtgccaccacatgaggttcaacctgaaggaggtgctgcaggtgatgcccagcgacagcttcttcttcagcatcgtgcgggaccctgctgccctggcccggagcgccttctcctactacaagagcaccagcagcgccttcaggaagagccccagcctggccgccttcctggccaacccccggggcttctacagacctggggcccggggggaccactacgccaggaacctgctgtggtttgattttggcctgcccttccccccagagaagagggccaagaggggcaacatccaccccccccgggaccccaaccccccccagctgcaggtgctgcccagcggggccggcccccgggcccagaccctgaaccccaatgccctgatccaccctgtgtccacagtgacagaccacaggagccagatcagcagccctgccagctttgacctgggcagcagcagcttcatccagtggggcctggcctggctggacagcgtgtttgacctggtgatggtggccgagtactttgatgagagcctggtgctgctggctgatgccctgtgctggggcctggatgatgtggtgggcttcatgcacaatgcccaggccggccacaagcagggcctgagcacagtgagcaacagcggcctgacagcagaagatcggcagctgacagcccgggcccgggcctggaacaacctggactgggccctgtatgtgcacttcaacagaagcctgtgggccagaattgagaagtatggccagggccgcctgcagacagctgtggccgagctgcgggcccggcgggaggccctggccaagcactgcctggtgggcggggaggccagtgaccccaagtacatcacagaccggcgcttccggcccttccagtttggaagtgccaaggtgctgggctacatcctgcggagcggcctgagcccccaggaccaggaggagtgtgagcggctggccaccccagagctgcagtacaaggacaagctggatgccaagcagtttcctcccaccgtgtccctgcccctgaagaccagccggcccctgagcccctag

SEQ ID NO: 153393 - DNA, 1461 bp, Artificial Sequence; identical to SEQ ID NO: 153392
  Description of Artificial Sequence: Synthetic coding sequence

SEQ ID NO: 153394 - DNA, 1275 bp, Artificial Sequence
  Description of Artificial Sequence: Synthetic coding sequence
atgacccccaggagccccaccagcgccttccgcagctgcacagctgtgagcagctgcctgtgccccagctcctggccctggctgcacctgtctgtgaccagccccttccctgtgccccacggccccagcctgagctgccaggatgctgctgccctgggcaccagcgagcccggcggcggcagcggcagcctgcatgaccactggctgtgcaccccagccctgggccgggccctgcctgaggaggtgctgcaggtgatgcccagcgacagcttcttcttcagcatcgtgcgggaccctgctgccctggcccggagcgccttctcctactacaagagcaccagcagcgccttcaggaagagccccagcctggccgccttcctggccaacccccggggcttctacagacctggggcccggggggaccactacgccaggaacctgctgtggtttgattttggcctgcccttccccccagagaagagggccaagaggggcaacatccaccccccccgggaccccaaccccccccagctgcaggtgctgcccagcggggccggcccccgggcccagaccctgaaccccaatgccctgatccaccctgtgtccacagtgacagaccacaggagccagatcagcagccctgccagctttgacctgggcagcagcagcttcatccagtggggcctggcctggctggacagcgtgtttgacctggtgatggtggccgagtactttgatgagagcctggtgctgctggctgatgccctgtgctggggcctggatgatgtggtgggcttcatgcacaatgcccaggccggccacaagcagggcctgagcacagtgagcaacagcggcctgacagcagaagatcggcagctgacagcccgggcccgggcctggaacaacctggactgggccctgtatgtgcacttcaacagaagcctgtgggccagaattgagaagtatggccagggccgcctgcagacagctgtggccgagctgcgggcccggcgggaggccctggccaagcactgcctggtgggcggggaggccagtgaccccaagtacatcacagaccggcgcttccggcccttccagtttggaagtgccaaggtgctgggctacatcctgcggagcggcctgagcccccaggaccaggaggagtgtgagcggctggccaccccagagctgcagtacaaggacaagctggatgccaagcagtttcctcccaccgtgtccctgcccctgaagaccagccggcccctgagcccctag

SEQ ID NO: 153395 - DNA, 1641 bp, Artificial Sequence
  Description of Artificial Sequence: Synthetic coding sequence
atgcctggcttcctggtgcgcatcctgcccctgctgctggtgctgctgctgctgggccccacccggggcctgagaaatgccacccagaggatgtttgaaattgactacagccgggacagcttcctgaaggatggccagcccttccgctacatcagcggcagcatccactacagccgggtgccccgcttctactggaaggaccggctgctgaagatgaagatggccggcctgaatgccatccagaccctgcccggcagctgtggccaggtggtgggcagccccagcgcccaggatgaggccagccccctgtctgagtggagggccagctacaacagcgctggcagcaacatcacagatgccttcctgagccagaggaaatgtgagcccaagggccccctcatcaacagcgagttctacacaggctggctggaccactggggccagccccacagcaccatcaagacagaagctgtggccagcagcctgtatgacatcctggcccggggggcctctgtgaacctgtacatgttcatcggcggcaccaactttgcctactggaatggagccaacagcccctatgctgcccagcccaccagctatgactatgatgcccccctgtctgaggccggggacctgacagagaagtactttgccctgaggaacatcatccagaagtttgagaaggtgcctgagggccccatcccccccagcacccccaagtttgcctacggcaaggtgaccctggagaagctgaagacagtgggcgccgccctggacatcctgtgccccagcggccccatcaagagcctgtaccccctgaccttcatccaggtgaagcagcactacggctttgtgctgtaccgcaccaccctgccccaggactgcagcaacccagcccccctgagcagccccctgaatggagtgcatgaccgggcctacgtggccgtggatggcatcccccagggcgtgctggagaggaacaacgtcatcaccctgaacatcaccgggaaggccggggccaccctggacctgctggtggagaacatgggccgggtgaactacggggcctacatcaatgacttcaagggcctggtgagcaacctgaccctgagcagcaacatcctgacagactggaccatcttccccctggacacagaagatgctgtgtgcagccacctgggcggctggggccaccgggacagcggccaccatgatgaggcctgggcccacaacagcagcaactacaccctgcctgccttctacatgggcaacttcagcatccccagcggcatcccagacctgccccaggacaccttcatccagtttcctggctggaccaagggccaggtgtggatcaatggcttcaacctgggccgctactggccagcccggggcccccagctgaccctgtttgtgccccagcacatcctgatgaccagcgcccccaacaccatcaccgtgctggagctggagtgggccccctgcagcagtgatgatcctgagctgtgtgctgtgacctttgtggacaggcctgtgattggcagctctgtgacctatgaccaccccagcaagcctgtggagaagaggctgatgcctcctccaccccagaagaacaaggacagctggctggaccacgtgtag

SEQ ID NO: 153396 - DNA, 1944 bp, Artificial Sequence
  Description of Artificial Sequence: Synthetic coding sequence
atgtttgaaattgactacagccgggacagcttcctgaaggatggccagcccttccgctacatcagcggcagcatccactacagccgggtgccccgcttctactggaaggaccggctgctgaagatgaagatggccggcctgaatgccatccagacctacgtgccctggaacttccacgagccctggccaggccagtaccagttcagcgaggaccatgatgtggagtacttcctgcggctggcccacgagctgggcctgctggtgatcctgcggcccggcccctacatctgtgccgagtgggagatgggcggcctgcctgcctggctgctggagaaggagagcatcctgctgcggagcagtgaccctgactacctggccgctgtggacaagtggctgggcgtgctgctgcccaagatgaagcccctgctgtaccagaatggaggccctgtgatcaccgtgcaggtggagaatgaatatggcagctactttgcctgtgactttgactacctgcgcttcctgcagaagcgcttccgccaccacctgggagatgatgtggtgctcttcaccacagatggagcccacaagaccttcctgaagtgtggggccctgcagggcctgtacaccaccgtggactttggcaccggcagcaacatcacagatgccttcctgagccagaggaaatgtgagcccaagggccccctcatcaacagcgagttctacacaggctggctggaccactggggccagccccacagcaccatcaagacagaggccgtggccagcagcctgtatgacatcctggcccggggggcctctgtgaacctgtacatgtttattggaggcaccaactttgcctactggaatggagccaacagcccctatgctgcccagcccaccagctatgactatgatgcccccctgtctgaggccggggacctgacagagaagtactttgccctgaggaacatcatccagaagtttgagaaggtgcctgagggccccatcccccccagcacccccaagtttgcctacggcaaggtgaccctggagaagctgaagacagtgggcgccgccctggacatcctgtgccccagcggccccatcaagagcctgtaccccctgaccttcatccaggtgaagcagcactacggctttgtgctgtaccgcaccaccctgccccaggactgcagcaacccagcccccctgagcagccccctgaatggagtgcatgaccgggcctacgtggccgtggatggcatcccccagggcgtgctggagagaaataatgtcatcaccctgaacatcaccgggaaggccggggccaccctggacctgctggtggagaacatgggccgggtgaactatggagcctacatcaatgacttcaagggcctggtgagcaacctgaccctgagcagcaacatcctgacagactggaccatcttccccctggacacagaagatgctgtgtgcagccacctgggcggctggggccaccgggacagcggccaccatgatgaggcctgggcccacaacagcagcaactacaccctgcctgccttctacatgggcaacttcagcatccccagcggcatcccagacctgccccaggacaccttcatccagtttcctggctggaccaagggccaggtgtggatcaatggcttcaacctgggccgctactggccagcccggggcccccagctgaccctgtttgtgccccagcacatcctgatgaccagcgcccccaacaccatcaccgtgctggagctggagtgggccccctgcagcagtgatgatcctgagctgtgtgctgtgacctttgtggacaggcctgtgattggcagctctgtgacctatgaccaccccagcaagcctgtggagaagaggctgatgcctcctccaccccagaagaacaaggacagctggctggaccacgtgtag

SEQ ID NO: 153397 - DNA, 2034 bp, Artificial Sequence
  Description of Artificial Sequence: Synthetic coding sequence
atgcctggcttcctggtgcgcatcctgcccctgctgctggtgctgctgctgctgggccccacccggggcctgagaaatgccacccagaggatgtttgaaattgactacagccgggacagcttcctgaaggatggccagcccttccgctacatcagcggcagcatccactacagccgggtgccccgcttctactggaaggaccggctgctgaagatgaagatggccggcctgaatgccatccagacctacgtgccctggaacttccacgagccctggccaggccagtaccagttcagcgaggaccatgatgtggagtacttcctgcggctggcccacgagctgggcctgctggtgatcctgcggcccggcccctacatctgtgccgagtgggagatgggcggcctgcctgcctggctgctggagaaggagagcatcctgctgcggagcagtgaccctgactacctggccgctgtggacaagtggctgggcgtgctgctgcccaagatgaagcccctgctgtaccagaatggaggccctgtgatcaccgtgcaggtggagaatgaatatggcagctactttgcctgtgactttgactacctgcgcttcctgcagaagcgcttccgccaccacctgggagatgatgtggtgctcttcaccacagatggagcccacaagaccttcctgaagtgtggggccctgcagggcctgtacaccaccgtggactttggcaccggcagcaacatcacagatgccttcctgagccagaggaaatgtgagcccaagggccccctcatcaacagcgagttctacacaggctggctggaccactggggccagccccacagcaccatcaagacagaggccgtggccagcagcctgtatgacatcctggcccggggggcctctgtgaacctgtacatgtttattggaggcaccaactttgcctactggaatggagccaacagcccctatgctgcccagcccaccagctatgactatgatgcccccctgtctgaggccggggacctgacagagaagtactttgccctgaggaacatcatccagaagtttgagaaggtgcctgagggccccatcccccccagcacccccaagtttgcctacggcaaggtgaccctggagaagctgaagacagtgggcgccgccctggacatcctgtgccccagcggccccatcaagagcctgtaccccctgaccttcatccaggtgaagcagcactacggctttgtgctgtaccgcaccaccctgccccaggactgcagcaacccagcccccctgagcagccccctgaatggagtgcatgaccgggcctacgtggccgtggatggcatcccccagggcgtgctggagagaaataatgtcatcaccctgaacatcaccgggaaggccggggccaccctggacctgctggtggagaacatgggccgggtgaactatggagcctacatcaatgacttcaagggcctggtgagcaacctgaccctgagcagcaacatcctgacagactggaccatcttccccctggacacagaagatgctgtgtgcagccacctgggcggctggggccaccgggacagcggccaccatgatgaggcctgggcccacaacagcagcaactacaccctgcctgccttctacatgggcaacttcagcatccccagcggcatcccagacctgccccaggacaccttcatccagtttcctggctggaccaagggccaggtgtggatcaatggcttcaacctgggccgctactggccagcccggggcccccagctgaccctgtttgtgccccagcacatcctgatgaccagcgcccccaacaccatcaccgtgctggagctggagtgggccccctgcagcagtgatgatcctgagctgtgtgctgtgacctttgtggacaggcctgtgattggcagctctgtgacctatgaccaccccagcaagcctgtggagaagaggctgatgcctcctccaccccagaagaacaaggacagctggctggaccacgtgtag

SEQ ID NO: 153398 - DNA, 2178 bp, Artificial Sequence
  Description of Artificial Sequence: Synthetic coding sequence
atgcctggcttcctggtgcgcatcctgcccctgctgctggtgctgctgctgctgggccccacccggggcctgcggagccgcttcctgccctgggccttccacctgccccggcaggcccccaagagccagctgcccctgcacaagaggggcaccaagacagccccaaatgagcacgccagcagcaacagaagtggaagaagaagaagacggcagcagtggaatgccacccagaggatgtttgaaattgactacagccgggacagcttcctgaaggatggccagcccttccgctacatcagcggcagcatccactacagccgggtgccccgcttctactggaaggaccggctgctgaagatgaagatggccggcctgaatgccatccagacctacgtgccctggaacttccacgagccctggccaggccagtaccagttcagcgaggaccatgatgtggagtacttcctgcggctggcccacgagctgggcctgctggtgatcctgcggcccggcccctacatctgtgccgagtgggagatgggcggcctgcctgcctggctgctggagaaggagagcatcctgctgcggagcagtgaccctgactacctggccgctgtggacaagtggctgggcgtgctgctgcccaagatgaagcccctgctgtaccagaatggaggccctgtgatcaccgtgcaggtggagaatgaatatggcagctactttgcctgtgactttgactacctgcgcttcctgcagaagcgcttccgccaccacctgggagatgatgtggtgctcttcaccacagatggagcccacaagaccttcctgaagtgtggggccctgcagggcctgtacaccaccgtggactttggcaccggcagcaacatcacagatgccttcctgagccagaggaaatgtgagcccaagggccccctcatcaacagcgagttctacacaggctggctggaccactggggccagccccacagcaccatcaagacagaggccgtggccagcagcctgtatgacatcctggcccggggggcctctgtgaacctgtacatgtttattggaggcaccaactttgcctactggaatggagccaacagcccctatgctgcccagcccaccagctatgactatgatgcccccctgtctgaggccggggacctgacagagaagtactttgccctgaggaacatcatccagaagtttgagaaggtgcctgagggccccatcccccccagcacccccaagtttgcctacggcaaggtgaccctggagaagctgaagacagtgggcgccgccctggacatcctgtgccccagcggccccatcaagagcctgtaccccctgaccttcatccaggtgaagcagcactacggctttgtgctgtaccgcaccaccctgccccaggactgcagcaacccagcccccctgagcagccccctgaatggagtgcatgaccgggcctacgtggccgtggatggcatcccccagggcgtgctggagagaaataatgtcatcaccctgaacatcaccgggaaggccggggccaccctggacctgctggtggagaacatgggccgggtgaactatggagcctacatcaatgacttcaagggcctggtgagcaacctgaccctgagcagcaacatcctgacagactggaccatcttccccctggacacagaagatgctgtgtgcagccacctgggcggctggggccaccgggacagcggccaccatgatgaggcctgggcccacaacagcagcaactacaccctgcctgccttctacatgggcaacttcagcatccccagcggcatcccagacctgccccaggacaccttcatccagtttcctggctggaccaagggccaggtgtggatcaatggcttcaacctgggccgctactggccagcccggggcccccagctgaccctgtttgtgccccagcacatcctgatgaccagcgcccccaacaccatcaccgtgctggagctggagtgggccccctgcagcagtgatgatcctgagctgtgtgctgtgacctttgtggacaggcctgtgattggcagctctgtgacctatgaccaccccagcaagcctgtggagaagaggctgatgcctcctccaccccagaagaacaaggacagctggctggaccacgtgtag

SEQ ID NO: 153399 - DNA, 2058 bp, Artificial Sequence
  Description of Artificial Sequence: Synthetic coding sequence
atggccgagtggctgctgagcgcctcctggcagaggcgggccaaggccatgacagctgctgctggcagcgctggccgggctgctgtgcccctgctgctgtgtgccctgctggcccctggaggagcctacgtgctggatgacagtgatggcctgggccgggagtttgatggcatcggggctgtgtctgggggcggggccaccagccggctgctggtgaactacccagagccctaccgcagccagatcctggactacctgttcaagcccaactttggagccagcctgcacatcctgaaggtggagattggaggagatggccagaccacagatggaacagagcccagccacatgcactacgccctggatgagaactacttccggggctatgagtggtggctgatgaaggaggccaagaagaggaaccccaacatcaccctgattggcctgccctggagcttccctggctggctgggcaaaggatttgactggccctacgtgaacctgcagctgacagcctactacgtggtgacctggatcgtgggcgccaagcgctaccatgacctggacatcgactacatcggcatctggaatgaaagaagctacaatgccaactacatcaagatcctgaggaagatgctgaactaccagggcctgcagagggtgaagatcatcgccagtgacaacctgtgggagagcatcagcgcctccatgctgctggatgctgagctgttcaaggtggtggatgtgattggagcccactacccaggcacccacagcgccaaggatgccaagctgaccgggaagaagctgtggagcagcgaggacttcagcaccctgaacagcgacatgggcgccggctgctggggccgcatcctgaaccagaactacatcaatggctacatgaccagcaccatcgcctggaacctggtggccagctactatgagcagctgccctacggccgctgtggcctgatgacagcccaggagccctggagcggccactacgtggtggagagccctgtgtgggtgtctgcccacaccacccagttcacccagcccggctggtactacctgaagacagtgggccacctggagaagggcggcagctatgtggccctgacagatggcctgggcaacctgaccatcatcatcgagaccatgagccacaagcacagcaagtgcatccggcccttcctgccctacttcaacgtgtcccagcagtttgccacctttgtgctgaagggcagcttcagcgagatccctgagctgcaggtgtggtacaccaagctgggcaagaccagcgagcgcttcctgttcaagcagctggacagcctgtggctgctggacagtgatggcagcttcaccctgagcctgcatgaagatgagctgttcaccctgaccaccctgaccactggaaggaagggcagctaccccctgccccccaagagccagcccttccccagcacctacaaggatgacttcaacgtggactaccccttcttcagcgaggcccccaactttgctgaccagacaggagtgtttgagtacttcaccaacattgaagatcctggagagcaccacttcaccctgcggcaggtgctgaaccagaggcccatcacctgggccgcagatgccagcaacaccatcagcatcatcggggactacaactggaccaacctgaccatcaagtgtgatgtgtacatcgagaccccagacacaggaggagtcttcatcgccggccgggtgaacaagggcggcatcctgatccgcagcgcccggggcatcttcttctggatctttgccaacggcagctacagagtgactggagacctggccggctggatcatctatgccctgggccgggtggaggtgacagccaagaagtggtacaccctgaccctgaccatcaagggccacttcaccagcggcatgctgaatgacaagagcctgtggacagacatccctgtgaacttccccaagaatggctgggccgccatcggcacccacagctttgaatttgcccagtttgacaacttcctggtggaggccaccaggtag

SEQ ID NO: 153400 - DNA, 1989 bp, Artificial Sequence
  Description of Artificial Sequence: Synthetic coding sequence
atggccgagtggctgctgagcgcctcctggcagaggcgggccaaggccatgacagctgctgctggcagcgctggccgggctgctgtgcccctgctgctgtgtgccctgctggcccctggaggagcctacgtgctggatgacagtgatggcctgggccgggagtttgatggcatcggggctgtgtctgggggcggccccaactttggagccagcctgcacatcctgaaggtggagattggaggagatggccagaccacagatggaacagagcccagccacatgcactacgccctggatgagaactacttccggggctatgagtggtggctgatgaaggaggccaagaagaggaaccccaacatcaccctcatcggcctgccctggagcttccctggctggctgggcaagggctttgactggccctacgtgaacctgcagctgacagcctactacgtggtgacctggatcgtgggcgccaagcgctaccatgacctggacatcgactacatcggcatctggaatgaaagaagctacaatgccaactacatcaagatcctgaggaagatgctgaactaccagggcctgcagagggtgaagatcatcgccagtgacaacctgtgggagagcatcagcgcctccatgctgctggatgctgagctgttcaaggtggtggatgtgattggagcccactacccaggcacccacagcgccaaggatgccaagctgaccgggaagaagctgtggagcagcgaggacttcagcaccctgaacagcgacatgggcgccggctgctggggccgcatcctgaaccagaactacatcaatggctacatgaccagcaccatcgcctggaacctggtggccagctactatgagcagctgccctacggccgctgtggcctgatgacagcccaggagccctggagcggccactacgtggtggagagccctgtgtgggtgtctgcccacaccacccagttcacccagcccggctggtactacctgaagacagtgggccacctggagaagggcggcagctatgtggccctgacagatggcctgggcaacctgaccatcatcatcgagaccatgagccacaagcacagcaagtgcatccggcccttcctgccctacttcaacgtgtcccagcagtttgccacctttgtgctgaagggcagcttcagcgagatccctgagctgcaggtgtggtacaccaagctgggcaagaccagcgagcgcttcctgttcaagcagctggacagcctgtggctgctggacagtgatggcagcttcaccctgagcctgcatgaagatgagctgttcaccctgaccaccctgaccaccggcaggaagggcagctaccccctgccccccaagagccagcccttccccagcacctacaaggatgacttcaacgtggactaccccttcttcagcgaggcccccaactttgctgaccagacaggagtgtttgagtacttcaccaacatcgaggaccccggggagcaccacttcaccctgcggcaggtgctgaaccagaggcccatcacctgggccgcagatgccagcaacaccatcagcatcattggagactacaactggaccaacctgaccatcaagtgtgatgtgtacatcgagaccccagacaccggcggcgtcttcatcgccggccgggtgaacaagggcggcatcctgatccgcagcgcccggggcatcttcttctggatctttgccaacggcagctacagagtgactggagacctggccggctggatcatctatgccctgggccgggtggaggtgacagccaagaagtggtacaccctgaccctgaccatcaagggccacttcaccagcggcatgctgaatgacaagagcctgtggacagacatccctgtgaacttccccaagaatggctgggccgccatcggcacccacagctttgaatttgcccagtttgacaacttcctggtggaggccaccaggtag

SEQ ID NO: 153401 - DNA, 1980 bp, Artificial Sequence
  Description of Artificial Sequence: Synthetic coding sequence
atgctgggcaagagccacggccgggccacccacggccccctgcccctggccgacctgggcatccacctgccctgtgtgaaggtgctgcaccaggtgaccccagaggagaagccagctgccaccagccggctgctggtgaactacccagagccctaccgcagccagatcctggactacctgttcaagcccaactttggagccagcctgcacatcctgaaggtggagattggaggagatggccagaccacagatggaacagagcccagccacatgcactacgccctggatgagaactacttccggggctatgagtggtggctgatgaaggaggccaagaagaggaaccccaacatcaccctgattggcctgccctggagcttccctggctggctgggcaaaggatttgactggccctacgtgaacctgcagctgacagcctactacgtggtgacctggatcgtgggcgccaagcgctaccatgacctggacatcgactacatcggcatctggaatgaaagaagctacaatgccaactacatcaagatcctgaggaagatgctgaactaccagggcctgcagagggtgaagatcatcgccagtgacaacctgtgggagagcatcagcgcctccatgctgctggatgctgagctgttcaaggtggtggatgtgattggagcccactacccaggcacccacagcgccaaggatgccaagctgaccgggaagaagctgtggagcagcgaggacttcagcaccctgaacagcgacatgggcgccggctgctggggccgcatcctgaaccagaactacatcaatggctacatgaccagcaccatcgcctggaacctggtggccagctactatgagcagctgccctacggccgctgtggcctgatgacagcccaggagccctggagcggccactacgtggtggagagccctgtgtgggtgtctgcccacaccacccagttcacccagcccggctggtactacctgaagacagtgggccacctggagaagggcggcagctatgtggccctgacagatggcctgggcaacctgaccatcatcatcgagaccatgagccacaagcacagcaagtgcatccggcccttcctgccctacttcaacgtgtcccagcagtttgccacctttgtgctgaagggcagcttcagcgagatccctgagctgcaggtgtggtacaccaagctgggcaagaccagcgagcgcttcctgttcaagcagctggacagcctgtggctgctggacagtgatggcagcttcaccctgagcctgcatgaagatgagctgttcaccctgaccaccctgaccactggaaggaagggcagctaccccctgccccccaagagccagcccttccccagcacctacaaggatgacttcaacgtggactaccccttcttcagcgaggcccccaactttgctgaccagacaggagtgtttgagtacttcaccaacattgaagatcctggagagcaccacttcaccctgcggcaggtgctgaaccagaggcccatcacctgggccgcagatgccagcaacaccatcagcatcatcggggactacaactggaccaacctgaccatcaagtgtgatgtgtacatcgagaccccagacacaggaggagtcttcatcgccggccgggtgaacaagggcggcatcctgatccgcagcgcccggggcatcttcttctggatctttgccaacggcagctacagagtgactggagacctggccggctggatcatctatgccctgggccgggtggaggtgacagccaagaagtggtacaccctgaccctgaccatcaagggccacttcaccagcggcatgctgaatgacaagagcctgtggacagacatccctgtgaacttccccaagaatggctgggccgccatcggcacccacagctttgaatttgcccagtttgacaacttcctggtggaggccaccaggtag

SEQ ID NO: 153402 - DNA, 1425 bp, Artificial Sequence
  Description of Artificial Sequence: Synthetic coding sequence
atgctgaactaccagggcctgcagagggtgaagatcatcgccagtgacaacctgtgggagagcatcagcgcctccatgctgctggatgctgagctgttcaaggtggtggatgtgattggagcccactacccaggcacccacagcgccaaggatgccaagctgaccgggaagaagctgtggagcagcgaggacttcagcaccctgaacagcgacatgggcgccggctgctggggccgcatcctgaaccagaactacatcaatggctacatgaccagcaccatcgcctggaacctggtggccagctactatgagcagctgccctacggccgctgtggcctgatgacagcccaggagccctggagcggccactacgtggtggagagccctgtgtgggtgtctgcccacaccacccagttcacccagcccggctggtactacctgaagacagtgggccacctggagaagggcggcagctatgtggccctgacagatggcctgggcaacctgaccatcatcatcgagaccatgagccacaagcacagcaagtgcatccggcccttcctgccctacttcaacgtgtcccagcagtttgccacctttgtgctgaagggcagcttcagcgagatccctgagctgcaggtgtggtacaccaagctgggcaagaccagcgagcgcttcctgttcaagcagctggacagcctgtggctgctggacagtgatggcagcttcaccctgagcctgcatgaagatgagctgttcaccctgaccaccctgaccaccggcaggaagggcagctaccccctgccccccaagagccagcccttccccagcacctacaaggatgacttcaacgtggactaccccttcttcagcgaggcccccaactttgctgaccagacaggagtgtttgagtacttcaccaacatcgaggaccccggggagcaccacttcaccctgcggcaggtgctgaaccagaggcccatcacctgggccgcagatgccagcaacaccatcagcatcattggagactacaactggaccaacctgaccatcaagtgtgatgtgtacatcgagaccccagacaccggcggcgtcttcatcgccggccgggtgaacaagggcggcatcctgatccgcagcgcccggggcatcttcttctggatctttgccaacggcagctacagagtgactggagacctggccggctggatcatctatgccctgggccgggtggaggtgacagccaagaagtggtacaccctgaccctgaccatcaagggccacttcaccagcggcatgctgaatgacaagagcctgtggacagacatccctgtgaacttccccaagaatggctgggccgccatcggcacccacagctttgaatttgcccagtttgacaacttcctggtggaggccaccaggtag

SEQ ID NO: 153403 - DNA, 1770 bp, Artificial Sequence
  Description of Artificial Sequence: Synthetic coding sequence
atgggcttcatggtggccgacctgtgggccaccagccggctgctggtgaactacccagagccctaccgcagccagatcctggactacctgttcaagcccaactttggagccagcctgcacatcctgaaggtggagattggaggagatggccagaccacagatggaacagagcccagccacatgcactacgccctggatgagaactacttccggggctatgagtggtggctgatgaaggaggccaagaagaggaaccccaacatcaccctgattggcctgccctggagcttccctggctggctgggcaaaggatttgactggccctacgtgaacctgcagctgacagcctactacgtggtgacctggatcgtgggcgccaagcgctaccatgacctggacatcgactacatcggcatctggaatgaaagaagctacaatgccaactacatcaagatcctgaggaagatgctgaactaccagggcctgcagagggtgaagatcatcgccagtgacaacctgtgggagagcatcagcgcctccatgctgctggatgctgagctgttcaaggtggtggatgtgattggagcccactacccaggcacccacagcgccaaggatgccaagctgaccgggaagaagctgtggagcagcgaggacttcagcaccctgaacagcgacatgggcgccggctgctggggccgcatcctgaaccagaactacatcaatggctacatgaccagcaccatcgcctggaacctggtggccagctactatgagcagctgccctacggccgctgtggcctgatgacagcccaggagccctggagcggccactacgtggtggagagccctgtgtgggtgtctgcccacaccacccagttcacccagcccggctggtactacctgaagacagtgggccacctggagaagggcggcagctatgtggccctgacagatggcctgggcaacctgaccatcatcatcgagaccatgagccacaagcacagcaagtgcatccggcccttcctgccctacttcaacgtgtcccagcagtttgccacctttgtgctgaagggcagcttcagcgagatccctgagctgcaggtgtggtacaccaagctgggcaagaccagcgagcgcttcctgttcaagcagctggacagcctgtggctgctggacagtgatggcagcttcaccctgagcctgcatgaagatgagctgttcaccctgaccaccctgaccactggaaggaagggcagctaccccctgccccccaagagccagcccttccccagcacctacaaggatgacttcaacgtggactaccccttcttcagcgaggcccccaactttgctgaccagacaggagtgtttgagtacttcaccaacattgaagatcctggagagcaccacttcaccctgcggcaggtgctgaaccagaggcccatcacctgggccgcagatgccagcaacaccatcagcatcatcggggactacaactggaccaacctgaccatcaagtgtgatgtgtacatcgagaccccagacacaggaggagtcttcatcgccggccgggtgaacaagggcggcatcctgatccgcagcgcccggggcatcttcttctggatctttgccaacggcagctacagagtgactggagacctggccggctggatcatctatgccctgggccgggtggaggtgacagccaagaagtggtacaccctgaccctgaccatcaaggtggccggccgcaggaagaagacctag

SEQ ID NO: 153404 - DNA, 372 bp, Artificial Sequence
  Description of Artificial Sequence: Synthetic coding sequence
atggcccggggcagcgccctgctgctggccagcctgctgctggccgccgccctgagcgccagcgctggcctgtggagccctgccaaggagaagaggggctggaccctgaacagcgctggctacctgctgggcccccatgctgtgggcaaccaccgctccttcagtgacaagaatggcctgaccagcaagcgggagctgcggccagaagatgacatgaagccaggcagctttgacaggagcatccctgagaacaacatcatgaggaccatcatcgagttcctgtccttcctgcacctgaaggaggccggggccctggaccggctgctggacctgcctgctgctgccagcagcgaggacatcgagaggagctag

SEQ ID NO: 153405 - DNA, 1050 bp, Artificial Sequence
  Description of Artificial Sequence: Synthetic coding sequence
atggagctggccgtgggcaacctgtctgagggcaatgcctcctggccagagcccccagcccctgagcccggccccctgtttggaattggagtggagaactttgtgaccctggtggtgtttggcctcatctttgccctgggcgtgctgggcaacagcctggtgatcaccgtgctggcccggagcaagccaggcaagcccaggagcaccaccaacctcttcatcctgaacctgagcattgctgacctggcctacctgctcttctgcatccccttccaggccaccgtgtatgccctgcccacctgggtgctgggcgccttcatctgcaagttcatccactacttcttcaccgtgtccatgctggtgtccatcttcaccctggccgccatgtctgtggaccgctacgtggccatcgtgcacagcagaagaagcagcagcctgcgggtgtccagaaatgccctgctgggcgtgggctgcatctgggccctgagcatcgccatggccagccctgtggcctaccaccagggcctcttccacccccgggccagcaaccagaccttctgctgggagcagtggccagaccccaggcacaagaaggcctacgtggtgtgcacctttgtgtttggctacctgctgcccctgctgctgatctgcttctgctacgccaaggtgctgaaccacctgcacaagaagctgaagaacatgagcaagaagtctgaggccagcaagaagaagacagcccagacagtgctggtggtggtggtggtgtttggcatctcctggctgccccaccacatcatccacctgtgggccgagtttggagtcttccccctgaccccagccagcttcctgttccgcatcacagcccactgcctggcctacagcaacagctctgtgaaccccatcatctatgccttcctgtctgagaacttcaggaaggcctacaagcaggtgttcaagtgccacatcaggaaggacagccacctgagtgacaccaaggagagcaagagcagaattgacaccccacccagcaccaactgcacccacgtgtag

SEQ ID NO: 153406 - DNA, 1164 bp, Artificial Sequence
  Description of Artificial Sequence: Synthetic coding sequence
atgaatgtgtctggctgccctggagctggaaatgccagccaggccggcggcggcggcggctggcaccctgaggccgtgattgtgcccctgctgtttgccctgatcttcctggtgggcaccgtgggcaacaccctggtgctggccgtgctgctgcggggcggccaggccgtgtccaccaccaacctcttcatcctgaacctgggcgtggccgacctgtgcttcatcctgtgctgcgtgcccttccaggccaccatctacaccctggatggctgggtgtttggcagcctgctgtgcaaggctgtgcacttcctgatcttcctgaccatgcacgccagcagcttcaccctggccgctgtgtccctggaccgctacctggccatccgctaccccctgcacagccgggagctgcggaccccaagaaatgccctggccgccatcggcctcatctggggcctgagcctgctcttcagcggcccctacctgagctactaccggcagagccagctggccaacctgactgtgtgccacccagcctggagcgccccccggcggcgggccatggacatctgcacctttgtgttctcctacctgctgcctgtgctggtgctgggcctgacctacgcccggaccctgcgctacctgtggagggctgtggaccctgtggccgccggcagcggggcccggcgggccaagaggaaggtgaccaggatgatcctgattgtggccgccctcttctgcctgtgctggatgccccaccacgccctgatcctgtgtgtgtggtttggccagttccccctgacccgggccacctacgccctgcgcatcctgagccacctggtgtcctatgccaacagctgtgtgaaccccatcgtgtatgccctggtgtccaagcacttcaggaagggcttccgcaccatctgtgccggcctgctgggccgggcccctggccgggccagcggccgggtgtgtgccgccgcccggggcacccacagcggctctgtgctggagcgggagagcagtgacctgctgcacatgtctgaggccgccggggccctgcggccctgccctggggccagccagccctgcatcctggagccctgccccggccccagctggcagggccccaaggccggggacagcatcctgactgtggatgtggcctag

SEQ ID NO: 153407 - DNA, 1107 bp, Artificial Sequence
  Description of Artificial Sequence: Synthetic coding sequence
atggctgatgcccagaacatcagcctggacagccctggctctgtgggcgctgtggccgtgcctgtggtgtttgccctgatcttcctgctgggcaccgtgggcaatggcctggtgctggccgtgctgctgcagcccggccccagcgcctggcaggagcccggcagcaccacagacctcttcatcctgaacctggccgtggccgacctgtgcttcatcctgtgctgcgtgcccttccaggccaccatctacaccctggatgcctggctgtttggagccctggtgtgcaaggctgtgcacctgctgatctacctgaccatgtatgccagcagcttcaccctggccgctgtgtctgtggaccgctacctggccgtgcgccaccccctgcggagccgggccctgcggaccccaagaaatgcccgggctgctgtgggcctggtgtggctgctggccgccctcttcagcgccccctacctgagctactatggaacagtgcgctacggggccctggagctgtgtgtgcctgcctgggaggatgccaggagaagagccctggatgtggccacctttgctgctggctacctgctgcctgtggccgtggtgtccctggcctacggccgcaccctgcgcttcctgtgggccgctgtgggccctgctggagctgctgctgctgaggccaggagaagagccaccggccgggccggccgggccatgctggccgtggccgccctgtatgccctgtgctggggcccccaccacgccctgatcctgtgcttctggtacggccgctttgccttctccccagccacctacgcctgccgcctggccagccactgcctggcctatgccaacagctgcctgaaccccctggtgtatgccctggccagccgccacttccgggcccgcttccggcggctgtggccctgtggcagaagaagaagacaccgggcccggcgggccctgcggcgggtgcggcctgccagcagcggccccccaggctgccctggagatgcccggcccagcggccgcctgctggccggcggcggccagggccctgagccccgggagggccctgtgcatggaggagaggccgcccggggccctgagtag

SEQ ID NO: 153408 - DNA, 1959 bp, Artificial Sequence
  Description of Artificial Sequence: Synthetic coding sequence
atgggcaacctgcagagcgagcccagcgctgggggcggcagcaggaaggtgcagcccagcgaccgggccccagacagcaggaggaccagcctggtggagcctgagatgaccagccaggccatgaggctgacccggggcctgggcgtgtggttccctggcagcgccaccccacctggcctgatggtgccccgggagccccaggccagccccagcaccctgcccctgaccctggagcggcccagccctgtgatgcctcctcctgaggaggccgctgctgtgtctgcccctcctccagccccagctggcaccctgctgcccggccccagcaagtggcagaagccagctggcacccctgtgccccgcatccggcggctgctggaggccagccaccggggccagggcgacccccccagcctgcggcccctgaagcccccacctccaccccggcagctgtctgtgaaggacacagtgccccgggcccccagccagtttcctccacccctggagacctggaagcccccaccacccctgcccagcgagcggcagcctgctgaccggcgcatcaccccagccctggccaccccagccagccccccaacagagagccaggccggccccaggaaccagggccagacagctggccgggcccggggcggggcccctcctcatgctggggagggggagatggcccagcctgctgacagcgagagcggcctgagcctgctgtgcaagatcaccttcaagagccggcccagcctggcccctcctgctgccagcagcagcctggccgccaaggccagcctgggcggcggcggcggcggcggcctgtttgctgccagcggggccatctcctatgcagaggtgctgaagcagggccccctgcccccaggggccgcccggcccctgggggaggtgtccagaggagcccaggaggccgagggcggagatggagatggagagggctgcagcggccccccatctgccccagccagccaggcccgggccctgcccccaccaccctacaccaccttccctggcagcaagcccaagtttgactgggtgtctgccccagatggccctgagcggcacttccgcttcaatggagctgggggcggcattggagccccccggcggcgggctgctgccctgagcggcccctggggcagccccccacctcctcctgagcagatccacagcgcccctggcccccggcggcctgccccagccctgctggccccacccaccttcatcttccctgcccccaccaatggagagcccatgaggcctggccccccaggcctgcaggagctgccccccctgcccccacccaccccaccacccaccctgcagcccccagccctgcagcccacccccctgcctgtggccccacccctgaccccaggcctgggccacaaggagagcgccctggcccccacagctgccccagccctgcccccagccctggccgctgaccaggccccagcccccagccctgccccagcccccaccgtggccgagcccagcccccctgtgtctgccccagccccagctgctgcccccatcaagaccaggaccaggagaaataaaggcagcagagctgcccggggggccaccaggaaggatggcctgcatggagatggcccccgggagcgggccacagccaccgtgcctgacagcagcggcggcggcggcggcggcagcggggccagccagacaggagctgccaacaccagggctgcccggcactggctgcccttccaggtgctgaacagctgcccctgcaagtgctactgccaccaccagcccaggcaccggcggctgcccagaaatgtgtctgcctggctgagcaccagcaccaaccacctgggggagcccccctgggtggccaccatcaagctgagcggcagcctggtggccaagctggagcactatgacctgcaggccacccacagcaactag

SEQ ID NO: 153409 - DNA, 675 bp, Artificial Sequence
  Description of Artificial Sequence: Synthetic coding sequence
atgggcaacctgcagagcgagcccagcgctgggggcggcagcaggaaggtgcagcccagcgaccgggccccagacagcaggaggaccagcctggtggagcctgagatgaccagccaggccatgaggctgacccggggcctgggcgtgtggttccctggcagcgccaccccacctggcctgatggtgccccgggagccccaggccagccccagcaccctgcccctgaccctggagcggcccagccctgtgatgcctcctcctgaggaggccgctgctgtgtctgcccctcctccagccccagctggcaccctgctgcccggccccagcaagtggcagaagccagctggcacccctgtgccccgcatccggcggctgctggaggccagccaccggggccagggcgacccccccagcctgcggcccctgaagcccccacctccaccccggcagctgtctgtgaaggacacagtgccccgggcccccagccagtttcctccacccctggagacctggaagcccccaccacccctgcccagcgagcggcagcctgctgaccggcgcatcaccccagccctggccaccccagcctgtgtgcgggcccggacccggggctgtgcccaccaggacccccacgcccaggagcagggcttcccctgcagccctggccgggactag

SEQ ID NO: 153410 - DNA, 2094 bp, Artificial Sequence
  Description of Artificial Sequence: Synthetic coding sequence
atggcccggctggtggccgtgtgcagagatggagaggaggagttcccctttgaaagacggcagatccccctgtacattgatgacaccctgaccatggtgatggagttcccagacaacgtgctgaacctggatggccaccagaacaatggagcccagctgaagcagttcatccagagacatggcatgctgaagcagcaggacctgagcatcgccatggtggtgaccagccgggaggtgctgagcgccctgagccagctggtgccctgtgtgggctgcagaagatctgtggagcggctcttcagccagctggtggagagcggcaacccagccctggagcccctgactgtgggccccaagggcgtgctgtctgtgaccaggagctgcatgacagatgccaagaagctgtacaccctcttctacgtgcacggcagcaagctgaatgacatgattgatgccatccccaagagcaagaagaacaagcgctgccagctgcacagcctggacacccacaagcccaagcccctgggcggctgctggatggatgtgtgggagctgatgagccaggagtgcagagatgaggtggtgctgattgacagcagctgcctgctggagaccctggagacctacctgaggaagcaccgcttctgcacagactgcaagaacaaggtgctgcgggcctacaacatcctgattggagagctggactgcagcaaggagaagggctactgtgccgccctgtatgagggcctgcgctgctgcccccatgagcggcacatccacgtgtgctgtgaaacagacttcatcgcccacctgctgggccgggcagagcctgagtttgctgggggcagaagagaaagacatgccaagaccattgatattgcccaggaggaggtgctgacctgcctgggcatccacctgtatgagcggctgcaccgcatctggcagaagctgcgggcagaggagcagacctggcagatgctgttctacctgggcgtggatgccctgaggaagagctttgagatgacagtggagaaggtgcagggcatcagccggctggagcagctgtgtgaggagttcagcgaggaggagcgggtgcgggagctgaagcaggagaagaagaggcagaagaggaagaacagaaggaagaacaagtgtgtgtgtgacatccccacccccctgcagacagcagatgagaaggaggtgtcccaggagaaggagacagacttcatcgagaacagcagctgcaaggcctgtggcagcacagaagatggcaacacctgtgtggaggtgattgtgaccaatgaaaacaccagctgcacctgccccagcagcggcaacctgctgggcagccccaagatcaagaagggcctgagcccccactgcaatggaagtgactgtggctacagcagctccatggagggcagcgagaccggcagccgggagggcagtgatgtggcctgcacagagggcatctgcaaccatgatgaacatggagatgacagctgtgtgcaccactgtgaggacaaggaggatgatggagacagctgtgtggagtgctgggccaacagtgaagaaaatgacaccaagggcaagaacaagaagaagaagaagaagagcaagatcctgaagtgtgatgagcacatccagaagctgggcagctgcatcacagaccccggcaaccgggagaccagcggcaacaccatgcacacagtgttccaccgggacaagaccaaggacacccaccctgagagctgctgcagcagcgagaagggcggccagcccctgccctggtttgagcacaggaagaatgtgccccagtttgctgagcccacagagaccctgtttggaccagattctggaaaaggagccaagagcctggtggagctgctggatgaaagtgagtgcaccagtgatgaggagatcttcatcagccaggatgagatccagagcttcatggccaacaaccagagcttctacagcaaccgggagcagtaccggcagcacctgaaggagaagttcaacaagtactgccgcctgaatgaccacaagaggcccatctgcagcggctggctgaccacagctggggccaactag

SEQ ID NO: 153411 - DNA, 1548 bp, Artificial Sequence
  Description of Artificial Sequence: Synthetic coding sequence
atgagcagccccaacatctggagcacaggcagctctgtgtacagcacccctgtgttcagccagaagatgacagtgtggatcctgctgctgctgagcctgtacccaggcttcaccagccagaagagtgatgatgattatgaagattatgccagcaacaagacctgggtgctgacccccaaggtgcctgaaggagatgtgaccgtcatcctgaacaacctgctggagggctatgacaacaagctgcggccagacattggagtgaagcccaccctcatccacacagacatgtatgtgaacagcatcggccctgtgaatgccatcaacatggagtacaccatcgacatcttctttgcccagacctggtatgaccggcggctgaagttcaacagcaccatcaaggtgctgcggctgaacagcaacatggtgggcaagatctggatcccagacaccttcttcaggaacagcaagaaggcagatgcccactggatcaccacccccaacaggatgctgcgcatctggaatgatggccgggtgctgtacaccctgcggctgaccattgatgctgagtgccagctgcagctgcacaacttccccatggatgagcacagctgccccctggagttcagctcctggagccgcagcatcgcccaggccggcatgtgcagcggggtcatcagcgcccactacagcctgcgcttctggggcagcacagatcctcccaccctggccagccgggtggccggcatcagtgatggctacccccgggaggagatcgtgtaccagtggaagaggagctctgtggaggtgggggacaccaggtcctggaggctgtaccagttctcctttgtgggcctgaggaacaccacagaggtggtgaagaccaccagcggggactatgtggtgatgtctgtgtactttgacctgagcaggaggatgggctacttcaccatccagacctacatcccctgcaccctcatcgtggtgctgtcctgggtgtccttctggatcaacaaggatgctgtgcctgcccggaccagcctgggcatcaccaccgtgctgaccatgaccaccctgagcaccatcgccaggaagagcctgcccaaggtgtcctatgtgacagccatggacctgtttgtgtctgtgtgcttcatctttgtgttcagcgccctggtggagtatggcaccctgcactactttgtgagcaacaggaagcccagcaaggacaaggacaagaagaagaagaaccccctgctgaggatgttctccttcaaggcccccaccatcgacatccggcccaggtctgccaccatccagatgaacaatgccacccacctgcaggagagagatgaggagtatggctatgaatgtctggatggcaaggactgtgccagcttcttctgctgctttgaggactgcaggactggagcctggaggcatggccgcatccacatccgcatcgccaagatggacagctatgcccgcatcttcttccccacagccttctgcctcttcaacctggtgtactgggtgtcctacctgtacctgtag

SEQ ID NO: 153412 - DNA, 762 bp, Artificial Sequence
  Description of Artificial Sequence: Synthetic coding sequence
atggcccccaagctgctgctgctgctgtgcctcttcagcggcctgcacgcccggagcaggaaggtggaggaggatgaatatgaggacagcagcagcaaccagaagtgggtgctggcccccaagagccaggacacagatgtgaccctcatcctgaacaagctgctgcgggagtatgacaagaagctgcggccagacatcggcatcaagcccaccgtgattgatgtggacatctacgtgaacagcatcggccctgtgagcagcatcaacatggagtaccagattgacatcttctttgcccagacctggacagacagccggctgcgcttcaacagcaccatgaagatcctgaccctgaacagcaacatggtgggcctcatctggatcccagacaccatcttcaggaacagcaagacagctgaggcccactggatcaccacccccaaccagctgctgcgcatctggaatgatggcaagatcctgtacaccctgcggctgaccatcaatgctgagtgccagctgcagctgcacaacttccccatggatgagcacagctgccccctcatcttcagcagctatggctaccccaaggaggagatgatctaccgctggaggaagaacagcgtggaggccgctgaccagaagtcctggaggctgtaccagtttgacttcatgggcctgaggaacaccacagagatcgtgaccaccagcgctggaagaaacctgctgaaggaggcccagctgagcaaggcccgggaggcctag

SEQ ID NO: 153413 - DNA, 1371 bp, Artificial Sequence
  Description of Artificial Sequence: Synthetic coding sequence
atgaggaagagccctggcctgagtgactgcctgtgggcctggatcctgctgctgagcaccctgaccggccgctcctatggccagcccagcctgcaggatgagctgaaggacaacaccaccgtcttcacccgcatcctggaccggctgctggatggctatgacaaccggctgcggcccggcctgggggagcgggtgacagaggtgaagacagacatctttgtgaccagctttggacctgtgtctgaccatgacatggagtacaccattgatgtgttcttccggcagagctggaaggatgagcggctgaagttcaagggccccatgacagtgctgcggctgaacaacctgatggccagcaagatctggaccccagacaccttcttccacaacgggaagaagtctgtggcccacaacatgaccatgcccaacaagctgctgcgcatcacagaagatggcaccctgctgtacaccatgaggctgactgtgcgggcagaatgtcccatgcacctggaggacttccccatggatgcccacgcctgccccctgaagtttggcagctatgcctacaccagggctgaggtggtgtatgagtggacccgggagcccgcccggtctgtggtggtggccgaggatggcagccggctgaaccagtatgacctgctgggccagacagtggacagcggcatcgtgcagagcagcactggagaatatgtggtgatgaccacccacttccacctgaagaggaagattggctactttgtgatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttcagcgccctgattgaatttgccaccgtgaactacttcaccaagaggggctacgcctgggatggcaagtctgtggtgcctgagaagcccaagaaggtgaaggaccccctcatcaagaagaacaacacctacgcccccacagccaccagctacacccccaacctggcccggggggaccccggcctggccaccatcgccaagagcgccaccatcgagcccaaggaggtgaagccagagaccaagcccccagagcccaagaagaccttcaacagcgtgtccaagattgaccggctgagcagaattgccttccccctgctgtttggcatcttcaacctggtgtactgggccacctacctgaaccgggagccccagctgaaggcccccaccccccaccagtag

SEQ ID NO: 153414 - DNA, 1371 bp, Artificial Sequence; identical to SEQ ID NO: 153413
  Description of Artificial Sequence: Synthetic coding sequence

SEQ ID NO: 153415 - DNA, 1371 bp, Artificial Sequence; identical to SEQ ID NO: 153413
  Description of Artificial Sequence: Synthetic coding sequence

SEQ ID NO: 153416 - DNA, 1371 bp, Artificial Sequence; identical to SEQ ID NO: 153413
  Description of Artificial Sequence: Synthetic coding sequence

SEQ ID NO: 153417 - DNA, 1371 bp, Artificial Sequence; identical to SEQ ID NO: 153413
  Description of Artificial Sequence: Synthetic coding sequence

SEQ ID NO: 153418 - DNA, 1371 bp, Artificial Sequence; identical to SEQ ID NO: 153413
  Description of Artificial Sequence: Synthetic coding sequence

SEQ ID NO: 153419 - DNA, 372 bp, Artificial Sequence
  Description of Artificial Sequence: Synthetic coding sequence
atgaggaagagccctggcctgagtgactgcctgtgggcctggatcctgctgctgagcaccctgaccggccgctcctatggccagcccagcctgcaggatgagctgaaggacaacaccaccgtcttcacccgcatcctggaccggctgctggatggctatgacaaccggctgcggcccggcctgggggagcgggtgacagaggtgaagacagacatctttgtgaccagctttggacctgtgtctgaccatgacatggagtacaccattgatgtgttcttccggcagagctggaaggatgagcggctgaagttcaagggccccatgacagtgctgcggctgaacaacctgatggccagcaagatctggacctag

SEQ ID NO: 153420 - DNA, 1356 bp, Artificial Sequence
  Description of Artificial Sequence: Synthetic coding sequence
atgaagaccaagctgaacatctacaacatgcagttcctgctgtttgtgttcctggtgtgggaccctgcccggctggtgctggccaacatccaggaggatgaggccaagaacaacatcaccatcttcacccgcatcctggaccggctgctggatggctatgacaaccggctgcggcccggcctgggggacagcatcacagaggtgttcaccaacatctacgtgaccagctttggacctgtgtctgacacagacatggagtacaccattgatgtgttcttccggcagaagtggaaggatgagcggctgaagttcaagggccccatgaacatcctgcggctgaacaacctgatggccagcaagatctggaccccagacaccttcttccacaacgggaagaagtctgtggcccacaacatgaccatgcccaacaagctgctgcgcatccaggatgatggcaccctgctgtacaccatgaggctgactgtgcaggctgaatgtcccatgcacctggaggacttccccatggatgcccacagctgccccctgaagtttggcagctatgcctacaccaccagcgaggtgacctacatctggacctacaatgccagtgacagcgtgcaggtggccccagatggcagccggctgaaccagtatgacctgctgggccagagcatcggcaaggagaccatcaagagcagcactggagagtacacagtgatgacagcccacttccacctgaagaggaagattggctactttgtgatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttcagcgccctgattgaatttgccaccgtgaactacttcaccaagaggggctgggcctgggatggcaagtctgtggtgaatgacaagaagaaggagaaggcctctgtgatgatccagaacaatgcctatgctgtggccgtggccaactatgcccccaacctgagcaaggaccctgtgctgagcaccatcagcaagagcgccaccaccccagagcccaacaagaagccagagaacaagccagctgaggccaagaagaccttcaacagcgtgtccaagattgacaggatgagcagaattgtgtttcctgtgctgtttggcaccttcaacctggtgtactgggccacctacctgaaccgggagcctgtgctgggcgtgagcccctag

SEQ ID NO: 153421 - DNA, 1356 bp, Artificial Sequence; identical to SEQ ID NO: 153420
  Description of Artificial Sequence: Synthetic coding sequence

SEQ ID NO: 153422 - DNA, 459 bp, Artificial Sequence
  Description of Artificial Sequence: Synthetic coding sequence
atgaagaccaagctgaacatctacaacatgcagttcctgctgtttgtgttcctggtgtgggaccctgcccggctggtgctggccaacatccaggaggatgaggccaagaacaacatcaccatcttcacccgcatcctggaccggctgctggatggctatgacaaccggctgcggcccggcctgggggacagcatcacagaggtgttcaccaacatctacgtgaccagctttggacctgtgtctgacacagacatggagtacaccattgatgtgttcttccggcagaagtggaaggatgagcggctgaagttcaagggccccatgaacatcctgcggctgaacaacctgatggccagcaagatctggaccccagacaccttcttccacaacgggaagaagtctgtggcccacaacatgaccatgcccaacaagctgctgcgcatccaggatgatggatag

SEQ ID NO: 153423 - DNA, 414 bp, Artificial Sequence
  Description of Artificial Sequence: Synthetic coding sequence
atgaagaccaagctgaacatctacaacatgcagttcctgctgtttgtgttcctggtgtgggaccctgcccggctggtgctggccaacatccaggaggatgaggccaagaacaacatcaccatcttcacccgcatcctggaccggctgctggatggctatgacaaccggctgcggcccggcctgggggacagcatcacagaggtgttcaccaacatctacgtgaccagctttggacctgtgtctgacacagacatggagtacaccattgatgtgttcttccggcagaagtggaaggatgagcggctgaagttcaagggccccatgaacatcctgcggctgaacaacctgatggccagcaagatctggaccccagacaccttcttccacaacgggaagaagtctgtggcccactag

SEQ ID NO: 153424 - DNA, 1536 bp, Artificial Sequence
  Description of Artificial Sequence: Synthetic coding sequence
atgaagaccaagctgaacatctacaacatgcagttcctgctgtttgtgttcctggtgtgggaccctgcccggctggtgctggccaacatccaggaggatgaggccaagaacaacatcaccatcttcacccgcatcctggaccggctgctggatggctatgacaaccggctgcggcccggcctgggggacagcatcacagaggtgttcaccaacatctacgtgaccagctttggacctgtgtctgacacagacatggagtacaccattgatgtgttcttccggcagaagtggaaggatgagcggctgaagttcaagggccccatgaacatcctgcggctgaacaacctgatggccagcaagatctggaccccagacaccttcttccacaacgggaagaagtctgtggcccacaacatgaccatgcccaacaagctgctgcgcatccaggatgatggcaccctgctgtacaccatgaggctgactgtgcaggctgaatgtcccatgcacctggaggacttccccatggatgcccacagctgccccctgaagtttggcagctatgcctacaccaccagcgaggtgacctacatctggacctacaatgccagtgacagcgtgcaggtggccccagatggcagccggctgaaccagtatgacctgctgggccagagcatcggcaaggagaccatcaagagcagcactggagagtacacagtgatgacagcccacttccacctgaagaggaagattggctactttgtgatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttcagcgccctgattgaatttgccaccgtgaactacttcaccaagaggggctgggcctgggatggcaagtctgtggtgaatgacaagagccccagcatcaaggccgagggcatcaccctgacctacaacagcgtgaaggccatcctgcagggcgccaagctgatctggagcaagtacatcgccttctcctggcccagcctcttccaggagaagaccctggagtacctggagaagtggatggactgcctgaccttcaagcagagcagcaagaaggagaaggcctctgtgatgatccagaacaatgcctatgctgtggccgtggccaactatgcccccaacctgagcaaggaccctgtgctgagcaccatcagcaagagcgccaccaccccagagcccaacaagaagccagagaacaagccagctgaggccaagaagaccttcaacagcgtgtccaagattgacaggatgagcagaattgtgtttcctgtgctgtttggcaccttcaacctggtgtactgggccacctacctgaaccgggagcctgtgctgggcgtgagcccctag

SEQ ID NO: 153425 - DNA, 1356 bp, Artificial Sequence; identical to SEQ ID NO: 153420
  Description of Artificial Sequence: Synthetic coding sequence

SEQ ID NO: 153426 - DNA, 1356 bp, Artificial Sequence; identical to SEQ ID NO: 153420
  Description of Artificial Sequence: Synthetic coding sequence

SEQ ID NO: 153427 - DNA, 1104 bp, Artificial Sequence
  Description of Artificial Sequence: Synthetic coding sequence
atgaagaccaagctgaacatctacaacatgcagttcctgctgtttgtgttcctggtgtgggaccctgcccggctggtgctggccaacatccaggaggatgaggccaagaacaacatcaccatcttcacccgcatcctggaccggctgctggatggctatgacaaccggctgcggcccggcctgggggacagcatcacagaggtgttcaccaacatctacgtgaccagctttggacctgtgtctgacacagacatggagtacaccattgatgtgttcttccggcagaagtggaaggatgagcggctgaagttcaagggccccatgaacatcctgcggctgaacaacctgatggccagcaagatctggaccccagacaccttcttccacaacgggaagaagtctgtggcccacaacatgaccatgcccaacaagctgctgcgcatccaggatgatggcaccctgctgtacaccatgaggctgactgtgcaggctgaatgtcccatgcacctggaggacttccccatggatgcccacagctgccccctgaagtttggcagctatgcctacaccaccagcgaggtgacctacatctggacctacaatgccagtgacagcgtgcaggtggccccagatggcagccggctgaaccagtatgacctgctgggccagagcatcggcaaggagaccatcaagagcagcactggagagtacacagtgatgacagcccacttccacctgaagaggaagattggctactttgtgatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttcagcgccctgattgaatttgccaccgtgaactacttcaccaagaggggctgggcctgggatggcaagtctgtggtgaatgacaaggtgtctgagagcttccgggtcatcatcatcaagaagatcccctag

SEQ ID NO: 153428 - DNA, 1371 bp, Artificial Sequence
  Description of Artificial Sequence: Synthetic coding sequence
atgaggctgaagatcaccctgcccagcctgcgggagttcctgacagacttctggatggtgaccatcatcggcctggaccaggactgggaggagtacaccattgatgtgttcttccggcagaagtggaaggatgagcggctgaagttcaagggccccatgaacatcctgcggctgaacaacctgatggccagcaagatctggaccccagacaccttcttccacaacgggaagaagtctgtggcccacaacatgaccatgcccaacaagctgctgcgcatccaggatgatggcaccctgctgtacaccatgaggctgactgtgcaggccgagtgccccatgcacctggaggacttccccatggatgcccacagctgccccctgaagtttggcagctatgcctacaccaccagcgaggtgacctacatctggacctacaatgccagtgacagcgtgcaggtggccccagatggcagccggctgaaccagtatgacctgctgggccagagcatcggcaaggagaccatcaagagcagcactggagagtacacagtgatgacagcccacttccacctgaagaggaagattggctacttcgtcatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttttctgccctgattgaatttgccaccgtgaactacttcaccaagaggggctgggcctgggatggcaagtctgtggtgaatgacaagagccccagcatcaaggccgagggcatcaccctgacctacaacagcgtgaaggccatcctgcagggcgccaagctgatctggagcaagtacatcgccttctcctggcccagcctcttccaggagaagaccctggagtacctggagaagtggatggactgcctgaccttcaagcagagcagcaagaaggagaaggcctctgtgatgatccagaacaatgcctatgctgtggccgtggccaactatgcccccaacctgagcaaggaccctgtgctgagcaccatcagcaagagcgccaccaccccagagcccaacaagaagccagagaacaagccagctgaggccaagaagaccttcaacagcgtgtccaagattgacaggatgagccgcatcgtgtttcctgtgctgtttggcaccttcaacctggtgtactgggccacctacctgaaccgggagcctgtgctgggcgtgagcccctag

SEQ ID NO: 153429 - DNA, 1479 bp, Artificial Sequence
  Description of Artificial Sequence: Synthetic coding sequence
atgatcatcacccagaccagccactgctacatgaccagcctgggcatcctcttcctgatcaacatcctgcccggcaccaccggccagggcgagagccggcggcaggagcccggggactttgtgaagcaggacattggaggcctgagccccaagcacgccccagacatcccagatgacagcacagacaacatcaccatcttcacccgcatcctggaccggctgctggatggctatgacaaccggctgcggcccggcctgggagatgctgtgacagaggtgaagacagacatctacgtgaccagctttggacctgtgtctgacacagacatggagtacaccattgatgtgttcttccggcagacctggcatgatgagcggctgaagtttgatggccccatgaagatcctgcccctgaacaacctgctggccagcaagatctggaccccagacaccttcttccacaacgggaagaagtctgtggcccacaacatgaccacccccaacaagctgctgcggctggtggacaatggcaccctgctgtacaccatgaggctgaccatccatgctgagtgccccatgcacctggaggacttccccatggatgtgcacgcctgccccctgaagtttggcagctatgcctacaccacagctgaggtggtgtacagctggaccctgggcaagaacaagtctgtggaggtggcccaggacggcagccggctgaaccagtatgacctgctgggccacgtggtgggcacagagatcatccgcagcagcactggagaatatgtggtgatgaccacccacttccacctgaagaggaagattggctacttcgtcatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttttctgccctgattgaatttgccaccgtgaactacttcaccaagaggtcctgggcctgggagggcaagaaggtgcctgaggccctggagatgaagaagaagaccccagctgccccagccaagaagaccagcaccaccttcaacatcgtgggcaccacctaccccatcaacctggccaaggacacagagttcagcaccatcagcaagggggccgcccccagcgccagcagcacccccaccatcatcgccagccccaaggccacctacgtgcaggacagccccacagagaccaagacctacaacagcgtgtccaaggtggacaagatcagccgcatcatcttccctgtgctgtttgccatcttcaacctggtgtactgggccacctacgtgaaccgggagagcgccatcaagggcatgatcaggaagcagtag

SEQ ID NO: 153430 - DNA, 1479 bp, Artificial Sequence; identical to SEQ ID NO: 153429
  Description of Artificial Sequence: Synthetic coding sequence

SEQ ID NO: 153431 - DNA, 339 bp, Artificial Sequence
  Description of Artificial Sequence: Synthetic coding sequence
gagtacaccattgatgtgttcttccggcagacctggcatgatgagcggctgaagtttgatggccccatgaagatcctgcccctgaacaacctgctggccagcaagatctggaccccagacaccttcttccacaacgggaagaagtctgtggcccacaacatgaccacccccaacaagctgctgcggctggtggacaatggcaccctgctgtacaccatgagaattgaggaggtgcagaagcaccgctccatgatgaagcccagcgtgtcctacacagtggccccctggatccaggagggcggccctgggggccgccaccggctgaagatggagaagtag

SEQ ID NO: 153432 - DNA, 1479 bp, Artificial Sequence; identical to SEQ ID NO: 153429
  Description of Artificial Sequence: Synthetic coding sequence

SEQ ID NO: 153433 - DNA, 1665 bp, Artificial Sequence
  Description of Artificial Sequence: Synthetic coding sequence
atggtgtctgccaagaaggtgcctgccatcgccctgtctgctggggtgtcctttgccctgctgcgcttcctgtgcctggccgtgtgcctgaatgaaagccctggccagaaccagaaggaggagaagctgtgcacagagaacttcacccgcatcctggacagcctgctggatggctatgacaaccggctgcggcccggctttggaggccctgtgacagaggtgaagacagacatctacgtgaccagctttggacctgtgtctgatgtggagatggagtacaccatggatgtgttcttccggcagacctggattgacaagaggctgaagtatgatggccccatcgagatcctgcggctgaacaacatgatggtgaccaaggtgtggaccccagacaccttcttcagaaatggcaagaagtctgtgagccacaacatgacagcccccaacaagctgttccgcatcatgagaaatggcaccatcctgtacaccatgaggctgaccatctctgcagaatgtcccatgaggctggtggacttccccatggatggccacgcctgccccctgaagtttggcagctatgcctaccccaagtctgagatgatctacacctggaccaagggccctgagaagtctgtggaggtgcccaaggagagcagcagcctggtgcagtatgacctgattggccagacagtgtcctctgagaccatcaagagcatcaccggggagtacatcgtgatgacagtgtacttccacctgcggaggaagatgggctacttcatgatccagacctacatcccctgcatcatgaccgtcatcctgagccaggtgtccttctggatcaacaaggagagcgtgcctgccaggacagtgtttggcatcaccaccgtgctgaccatgaccaccctgagcatcagcgcccggcacagcctgcccaaggtgtcctatgccacagccatggactggttcatcgctgtgtgctttgcctttgtgttcagcgccctgattgaatttgctgctgtgaactacttcaccaacatccagatggagaaggccaagaggaagaccagcaagccaccccaggaggtgcctgctgcccctgtgcagcgggagaagcaccctgaggcccccctgcagaacaccaatgccaacctgaacatgaggaagaggaccaatgccctggtgcacagcgagagtgatgtgggcaacagaacagaggtgggcaaccacagcagcaagagcagcacagtggtgcaggagagcagcaagggcacccccaggagctacctggccagcagccccaaccccttcagccgggccaatgctgctgagaccatctctgctgcccgggccctgcccagcgccagccccaccagcatcagaacaggctacatgcccaggaaggcctctgtgggcagcgccagcaccaggcatgtgtttggcagccggctgcagaggatcaagaccaccgtgaacaccatcggggccaccgggaagctgagcgccaccccaccacccagcgcccctcctccttctggcagcggcaccagcaagattgacaagtatgcccgcatcctcttccctgtgaccttcggggccttcaacatggtgtactgggtggtgtacctgagcaaggacaccatggagaagtctgagagcctgatgtag

SEQ ID NO: 153434 - DNA, 1389 bp, Artificial Sequence
  Description of Artificial Sequence: Synthetic coding sequence
atggacaatggcatgttttctggcttcatcatgatcaagaacctgctgctcttctgcatctccatgaacctgagcagccacttcggcttcagccagatgcccaccagctctgtgaaggatgagaccaatgacaacatcaccatcttcacccgcatcctggatggcctgctggatggctatgacaaccggctgcggcccggcctgggggagcgcatcacccaggtgaggacagacatctacgtgaccagctttggacctgtgtctgacacagagatggagtacaccattgatgtgttcttccggcagagctggaaggatgagcggctgcgcttcaagggccccatgcagaggctgcccctgaacaacctgctggccagcaagatctggaccccagacaccttcttccacaacgggaagaagagcatcgcccacaacatgaccacccccaacaagctgctgcggctggaggatgatggcaccctgctgtacaccatgaggctgaccatctctgctgagtgccccatgcagctggaggacttccccatggatgcccacgcctgccccctgaagtttggcagctatgcctaccccaacagcgaggtggtgtatgtgtggaccaacggcagcaccaagtctgtggtggtggctgaagatggcagccggctgaaccagtaccacctgatgggccagacagtgggcacagagaacatcagcaccagcactggagagtacaccatcatgacagcccacttccacctgaagaggaagattggctacttcgtcatccagacctacctgccctgcatcatgaccgtcatcctgagccaggtgtccttctggctgaaccgggagagcgtgcctgccaggacagtgtttggagtgaccaccgtgctgaccatgaccaccctgagcatcagcgccaggaacagcctgcccaaggtggcctatgccacagccatggactggttcatcgctgtgtgctacgcctttgtgttttctgccctgattgaatttgccaccgtgaactacttcaccaagaggggctgggcctgggatggcaagaaggccctggaggccgccaagatcaagaagaagcgggaggtgatcctgaacaagagcaccaatgccttcaccaccgggaagatgagccacccccccaacatccccaaggagcagaccccagctggcaccagcaacaccacctctgtgtctgtgaagcccagcgaggagaagaccagcgagagcaagaagacctacaacagcatcagcaagattgacaagatgagcagaattgtgtttcctgtgctgtttggcaccttcaacctggtgtactgggccacctacctgaaccgggagcctgtgatcaagggggccgccagccccaagtag

SEQ ID NO: 153435 - DNA, 1389 bp, Artificial Sequence; identical to SEQ ID NO: 153434
  Description of Artificial Sequence: Synthetic coding sequence

SEQ ID NO: 153436 - DNA, 1389 bp, Artificial Sequence; identical to SEQ ID NO: 153434
  Description of Artificial Sequence: Synthetic coding sequence

SEQ ID NO: 153437 - DNA, 261 bp, Artificial Sequence
  Description of Artificial Sequence: Synthetic coding sequence
atggacaatggcatgttttctggcttcatcatgatcaagaacctgctgctcttctgcatctccatgaacctgagcagccacttcggcttcagccagatgcccaccagctctgtgaaggatgagaccaatgacaacatcaccatcttcacccgcatcctggatggcctgctggatggctatgacaaccggctgcggcccggcctgggggagcgcatcacccaggtgaggacagacatctacgtgaccagctttggcccctag

SEQ ID NO: 153438 - DNA, 450 bp, Artificial Sequence
  Description of Artificial Sequence: Synthetic coding sequence
atggacaatggcatgttttctggcttcatcatgatcaagaacctgctgctcttctgcatctccatgaacctgagcagccacttcggcttcagccagatgcccaccagctctgtgaaggatgagaccaatgacaacatcaccatcttcacccgcatcctggatggcctgctggatggctatgacaaccggctgcggcccggcctgggggagcgcatcacccaggtgaggacagacatctacgtgaccagctttggacctgtgtctgacacagagatggagtacaccattgatgtgttcttccggcagagctggaaggatgagcggctgcgcttcaagggccccatgcagaggctgcccctgaacaacctgctggccagcaagatctggaccccagacaccttcttccacaacgggaagaagagcatcgcccacaacatgaccaccccctag

SEQ ID NO: 153439 - DNA, 501 bp, Artificial Sequence
  Description of Artificial Sequence: Synthetic coding sequence
atggacaatggcatgttttctggcttcatcatgatcaagaacctgctgctcttctgcatctccatgaacctgagcagccacttcggcttcagccagatgcccaccagctctgtgaaggatgagaccaatgacaacatcaccatcttcacccgcatcctggatggcctgctggatggctatgacaaccggctgcggcccggcctgggggagcgcatcacccaggtgaggacagacatctacgtgaccagctttggacctgtgtctgacacagagatggagtacaccattgatgtgttcttccggcagagctggaaggatgagcggctgcgcttcaagggccccatgcagaggctgcccctgaacaacctgctggccagcaagatctggaccccagacaccttcttccacaacgggaagaagagcatcgcccacaacatgaccacccccaacaagctgctgcggctggaggatgatggcaccctgctgtacaccatgaggtag

SEQ ID NO: 153440 - DNA, 51 bp, Artificial Sequence
  Description of Artificial Sequence: Synthetic coding sequence
atggacaatggcatgttttctggcttcatcatgatcaagaacctgctgtag

SEQ ID NO: 153441 - DNA, 1362 bp, Artificial Sequence
  Description of Artificial Sequence: Synthetic coding sequence
atggccagcagcctgccctggctgtgcatcatcctgtggctggagaatgccctgggcaagctggaggtggagggcaacttctacagtgaaaatgtgagccgcatcctggacaacctgctggagggctatgacaaccggctgcggcccggctttggaggagctgtgacagaggtgaagacagacatctacgtgaccagctttggacctgtgtctgatgtggagatggagtacaccatggatgtgttcttccggcagacctggacagatgagcggctgaagtttggaggccccacagagatcctgagcctgaacaacctgatggtgtccaagatctggaccccagacaccttcttcagaaatggcaagaagagcatcgcccacaacatgaccacccccaacaagctgttccgcatcatgcagaatggcaccatcctgtacaccatgaggctgaccatcaatgctgactgccccatgaggctggtgaacttccccatggatggccacgcctgccccctgaagtttggcagctatgcctaccccaagtctgagatcatctacacctggaagaagggccccctgtacagcgtggaggtgcctgaggagagcagcagcctgctgcagtatgacctgattggccagacagtgtcctctgagaccatcaagagcaacacaggagaatatgtgatcatgacagtgtacttccacctgcagaggaagatgggctacttcatgatccagatctacaccccctgcatcatgaccgtcatcctgagccaggtgtccttctggatcaacaaggagagcgtgcctgccaggacagtgtttggcatcaccaccgtgctgaccatgaccaccctgagcatcagcgcccggcacagcctgcccaaggtgtcctatgccacagccatggactggttcatcgctgtgtgctttgcctttgtgttcagcgccctgattgaatttgctgctgtgaactacttcaccaacctgcagacccagaaggccaagaggaaggcccagtttgctgccccacccaccgtgaccatcagcaaggccacagagcccctggaggccgagatcgtgctgcacccagacagcaagtaccacctgaagaagaggatcaccagcctgagcctgcccatcgtgagcagcagcgaggccaacaaggtgctgacccgggcccccatcctgcagagcacccctgtgaccccaccacccctgagccctgcctttggaggcaccagcaagattgaccagtacagccgcatcctcttccctgtggcctttgctggcttcaacctggtgtactgggtggtgtacctgagcaaggacaccatggaggtgagcagctctgtggagtag

SEQ ID NO: 153442 - DNA, 1332 bp, Artificial Sequence
  Description of Artificial Sequence: Synthetic coding sequence
atggccagcagcctgccctggctgtgcatcatcctgtggctggagaatgccctgggcaagctggaggtggagggcaacttctacagtgaaaatgtgagccgcatcctggacaacctgctggagggctatgacaaccggctgcggcccggctttggaggagctgtgacagaggtgaagacagacatctacgtgaccagctttggacctgtgtctgatgtggagatgacctggacagatgagcggctgaagtttggaggccccacagagatcctgagcctgaacaacctgatggtgtccaagatctggaccccagacaccttcttcagaaatggcaagaagagcatcgcccacaacatgaccacccccaacaagctgttccgcatcatgcagaatggcaccatcctgtacaccatgaggctgaccatcaatgctgactgccccatgaggctggtgaacttccccatggatggccacgcctgccccctgaagtttggcagctatgcctaccccaagtctgagatcatctacacctggaagaagggccccctgtacagcgtggaggtgcctgaggagagcagcagcctgctgcagtatgacctgattggccagacagtgtcctctgagaccatcaagagcaacacaggagaatatgtgatcatgacagtgtacttccacctgcagaggaagatgggctacttcatgatccagatctacaccccctgcatcatgaccgtcatcctgagccaggtgtccttctggatcaacaaggagagcgtgcctgccaggacagtgtttggcatcaccaccgtgctgaccatgaccaccctgagcatcagcgcccggcacagcctgcccaaggtgtcctatgccacagccatggactggttcatcgctgtgtgctttgcctttgtgttcagcgccctgattgaatttgctgctgtgaactacttcaccaacctgcagacccagaaggccaagaggaaggcccagtttgctgccccacccaccgtgaccatcagcaaggccacagagcccctggaggccgagatcgtgctgcacccagacagcaagtaccacctgaagaagaggatcaccagcctgagcctgcccatcgtgagcagcagcgaggccaacaaggtgctgacccgggcccccatcctgcagagcacccctgtgaccccaccacccctgagccctgcctttggaggcaccagcaagattgaccagtacagccgcatcctcttccctgtggcctttgctggcttcaacctggtgtactgggtggtgtacctgagcaaggacaccatggaggtgagcagctctgtggagtag

SEQ ID NO: 153443 - DNA, 1425 bp, Artificial Sequence
  Description of Artificial Sequence: Synthetic coding sequence
atgtggacagtgcagaaccgggagagcctgggcctgctgtccttccctgtgatgatcaccatggtgtgctgtgcccacagcaccaatgagcccagcaacatgtcctatgtgaaggagaccgtggaccggctgctgaagggctatgacatccggctgcggccagactttggaggcccccctgtggatgtgggcatgagaattgatgtggccagcattgacatggtgtctgaggtgaacatggactacaccctgaccatgtacttccagcagagctggaaggacaagaggctgagctacagcggcatccccctgaacctgaccctggacaacagagtggccgaccagctgtgggtgcctgacacctacttcctgaatgacaagaagagctttgtgcacggcgtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaatggaggagagggcgctgtgactggagtgaacaagattgagctgccccagttcagcatcgtggactacaagatggtgtccaagaaggtggagttcaccactggagcctacccccggctgagcctgtccttccggctgaagagaaatattggctacttcatcctgcagacctacatgcccagcaccctcatcaccatcctgtcctgggtgtccttctggatcaactatgatgccagcgctgcccgggtggccctgggcatcaccaccgtgctgaccatgaccaccatcagcacccacctgcgggagaccctgcccaagatcccctacgtgaaggccatcgacatctacctgatgggctgctttgtgtttgtgttcctggccctgctggagtatgcctttgtgaactacatcttcttcggcaagggcccccagaagaagggggccagcaagcaggaccagagcgccaatgagaagaacaagctggagatgaacaaggtgcaggtggatgcccacggcaacatcctgctgagcaccctggagatcagaaatgagaccagcggcagcgaggtgctgacctctgtgtctgaccccaaggccaccatgtacagctatgattctgccagcatccagtacaggaagcccctgagcagccgggaggcctacggccgggccctggacagacatggagtgcccagcaagggccgcatcagaagaagagccagccagctgaaggtgaagatcccagacctgacagatgtgaacagcattgacaagtggagcaggatgttcttccccatcaccttcagcctcttcaacgtggtgtactggctgtactacgtgcactag

SEQ ID NO: 153444 - DNA, 1215 bp, Artificial Sequence
  Description of Artificial Sequence: Synthetic coding sequence
atgacctttgcctgtggccgcaccagcgaggactacaccctgaccatgtacttccagcagagctggaaggacaagaggctgagctacagcggcatccccctgaacctgaccctggacaacagagtggccgaccagctgtgggtgcctgacacctacttcctgaatgacaagaagagctttgtgcacggcgtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaatggaggagagggcgctgtgactggagtgaacaagattgagctgccccagttcagcatcgtggactacaagatggtgtccaagaaggtggagttcaccactggagcctacccccggctgagcctgtccttccggctgaagagaaatattggctacttcatcctgcagacctacatgcccagcaccctcatcaccatcctgtcctgggtgtccttctggatcaactatgatgccagcgctgcccgggtggccctgggcatcaccaccgtgctgaccatgaccaccatcagcacccacctgcgggagaccctgcccaagatcccctacgtgaaggccatcgacatctacctgatgggctgctttgtgtttgtgttcctggccctgctggagtatgcctttgtgaactacatcttcttcggcaagggcccccagaagaagggggccagcaagcaggaccagagcgccaatgagaagaacaagctggagatgaacaaggtgcaggtggatgcccacggcaacatcctgctgagcaccctggagatcagaaatgagaccagcggcagcgaggtgctgacctctgtgtctgaccccaaggccaccatgtacagctatgattctgccagcatccagtacaggaagcccctgagcagccgggaggcctacggccgggccctggacagacatggagtgcccagcaagggccgcatcagaagaagagccagccagctgaaggtgaagatcccagacctgacagatgtgaacagcattgacaagtggagcaggatgttcttccccatcaccttcagcctcttcaacgtggtgtactggctgtactacgtgcactag

SEQ ID NO: 153445 - DNA, 1539 bp, Artificial Sequence
  Description of Artificial Sequence: Synthetic coding sequence
atgtggagggtgaggaagaggggctacttcggcatctggagcttccccctcatcatcgctgctgtgtgtgcccagagcgtgaatgaccccagcaacatgagcctggtgaaggagaccgtggaccggctgctgaagggctatgacatccggctgcggccagactttggaggcccccctgtggccgtgggcatgaacatcgacatcgccagcattgacatggtgtctgaggtgaacatggactacaccctgaccatgtacttccagcaggcctggagggacaagaggctgagctacaacgtcatccccctgaacctgaccctggacaacagagtggccgaccagctgtgggtgcctgacacctacttcctgaatgacaagaagagctttgtgcatggagtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggagaggagatgacaatgctgtgactggagtgaccaagattgagctgccccagttcagcatcgtggactacaagctgatcaccaagaaggtggtgttcagcacaggcagctacccccggctgagcctgtccttcaagctgaagaggaacatcggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcatggccctgctggagtatgccctggtgaactacatcttcttcggccggggcccccagaggcagaagaaggctgctgagaaggccgccagcgccaacaatgagaagatgaggctggatgtgaacaagatcttctacaaggacatcaagcagaatggcacccagtaccgcagcctgtgggaccccactggaaacctgagccccaccaggaggaccaccaactatgacttcagcctgtacaccatggacccccatgagaacatcctgctgagcaccctggagatcaagaatgagatggccaccagcgaggccgtgatgggcctgggggaccccaggagcaccatgctggcctatgatgccagcagcatccagtacaggaaggccggcctgcccaggcacagctttggaagaaatgccctggagagacatgtggcccagaagaagagccggctgcggcggcgggccagccagctgaagatcaccatcccagacctgacagatgtgaatgccatcgaccgctggagccgcatcttcttccctgtggtgttctccttcttcaacatcgtgtactggctgtactacgtgaactag

SEQ ID NO: 153446 - DNA, 1425 bp, Artificial Sequence
  Description of Artificial Sequence: Synthetic coding sequence
atgtggagggtgaggaagaggggctacttcggcatctggagcttccccctcatcatcgctgctgtgtgtgcccagagcgtgaatgaccccagcaacatgagcctggtgaaggagaccgtggaccggctgctgaagggctatgacatccggctgcggccagactttggaggcccccctgtggccgtgggcatgaacatcgacatcgccagcattgacatggtgtctgaggtgaacatggactacaccctgaccatgtacttccagcaggcctggagggacaagaggctgagctacaacgtcatccccctgaacctgaccctggacaacagagtggccgaccagctgtgggtgcctgacacctacttcctgaatgacaagaagagctttgtgcatggagtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggagaggagatgacaatgctgtgactggagtgaccaagattgagctgccccagttcagcatcgtggactacaagctgatcaccaagaaggtggtgttcagcacaggcagctacccccggctgagcctgtccttcaagctgaagaggaacatcggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcatggccctgctggagtatgccctggtgaactacatcttcttcggccggggcccccagaggcagaagaaggctgctgagaaggccgccagcgccaacaatgagaagatgaggctggatgtgaacaagatggacccccatgagaacatcctgctgagcaccctggagatcaagaatgagatggccaccagcgaggccgtgatgggcctgggggaccccaggagcaccatgctggcctatgatgccagcagcatccagtacaggaaggccggcctgcccaggcacagctttggaagaaatgccctggagagacatgtggcccagaagaagagccggctgcggcggcgggccagccagctgaagatcaccatcccagacctgacagatgtgaatgccatcgaccgctggagccgcatcttcttccctgtggtgttctccttcttcaacatcgtgtactggctgtactacgtgaactag

SEQ ID NO: 153447 - DNA, 1539 bp, Artificial Sequence; identical to SEQ ID NO: 153445
  Description of Artificial Sequence: Synthetic coding sequence

SEQ ID NO: 153448 - DNA, 945 bp, Artificial Sequence
  Description of Artificial Sequence: Synthetic coding sequence
atgatggacctgcggcgctaccccctggatgagcagaactgcaccctggagattgagagctatggctacaccacagatgacatcgagttctactggagaggagatgacaatgctgtgactggagtgaccaagattgagctgccccagttcagcatcgtggactacaagctgatcaccaagaaggtggtgttcagcacaggcagctacccccggctgagcctgtccttcaagctgaagaggaacatcggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcatggccctgctggagtatgccctggtgaactacatcttcttcggccggggcccccagaggcagaagaaggctgctgagaaggccgccagcgccaacaatgagaagatgaggctggatgtgaacaagatggacccccatgagaacatcctgctgagcaccctggagatcaagaatgagatggccaccagcgaggccgtgatgggcctgggggaccccaggagcaccatgctggcctatgatgccagcagcatccagtacaggaaggccggcctgcccaggcacagctttggaagaaatgccctggagagacatgtggcccagaagaagagccggctgcggcggcgggccagccagctgaagatcaccatcccagacctgacagatgtgaatgccatcgaccgctggagccgcatcttcttccctgtggtgttctccttcttcaacatcgtgtactggctgtactacgtgaactag

SEQ ID NO: 153449 - DNA, 1236 bp, Artificial Sequence
  Description of Artificial Sequence: Synthetic coding sequence
atgaacattgatattgccagcattgacatggtgtctgaggtgaacatggactacaccctgaccatgtacttccagcaggcctggagggacaagaggctgagctacaacgtcatccccctgaacctgaccctggacaacagagtggccgaccagctgtgggtgcctgacacctacttcctgaatgacaagaagagctttgtgcacggcgtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggagaggagatgacaatgctgtgactggagtgaccaagattgagctgccccagttcagcatcgtggactacaagctgatcaccaagaaggtggtgttcagcacaggcagctacccccggctgagcctgtccttcaagctgaagagaaatattggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcatggccctgctggagtatgccctggtgaactacatcttcttcggccggggcccccagaggcagaagaaggctgctgagaaggccgccagcgccaacaatgagaagatgaggctggatgtgaacaagatggacccccatgagaacatcctgctgagcaccctggagatcaagaatgagatggccaccagcgaggccgtgatgggcctgggggaccccaggagcaccatgctggcctatgatgccagcagcatccagtacaggaaggccggcctgcccaggcacagctttggaagaaatgccctggagcggcacgtggcccagaagaagagccggctgcggcggcgggccagccagctgaagatcaccatcccagacctgacagatgtgaatgccatcgaccgctggagccgcatcttcttccctgtggtgttctccttcttcaacatcgtgtactggctgtactacgtgaactag

SEQ ID NO: 153450 - DNA, 1425 bp, Artificial Sequence; identical to SEQ ID NO: 153446
  Description of Artificial Sequence: Synthetic coding sequence

SEQ ID NO: 153451 - DNA, 1422 bp, Artificial Sequence
  Description of Artificial Sequence: Synthetic coding sequence
atgtgcagcggcctgctggagctgctgctgcccatctggctgtcctggaccctgggcacccggggcagcgagcccaggtctgtgaatgaccccggcaacatgagctttgtgaaggagaccgtggacaagctgctgaagggctatgacatccggctgcggccagactttggaggcccccctgtgtgtgtgggcatgaacattgatattgccagcattgacatggtgtctgaggtgaacatggactacaccctgaccatgtacttccagcagtactggagggacaagaggctggcctacagcggcatccccctgaacctgaccctggacaacagagtggccgaccagctgtgggtgcctgacacctacttcctgaatgacaagaagagctttgtgcacggcgtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaggggcggggacaaggctgtgactggagtggagcgcatcgagctgccccagttcagcatcgtggagcaccggctggtgtccagaaatgtggtgtttgccactggagcctacccccggctgagcctgtccttccggctgaagagaaatattggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcctggccctgctggagtatgcctttgtgaactacatcttcttcggccggggcccccagaggcagaagaagctggccgagaagacagccaaggccaagaatgacaggagcaagtctgagagcaacagagtggatgcccacggcaacatcctgctgaccagcctggaggtgcacaatgagatgaatgaggtgtctgggggcattggagacaccagaaattctgccatcagctttgacaacagcggcatccagtacaggaagcagagcatgccccgggagggccacggccgcttcctgggggacaggagcctgccccacaagaagacccacctgcggcggcgcagcagccagctgaagatcaagatcccagacctgacagatgtgaatgccatcgaccgctggagccgcatcgtgttccccttcaccttcagcctcttcaacctggtgtactggctgtactacgtgaactag

SEQ ID NO: 153452 - DNA, 1422 bp, Artificial Sequence
  Description of Artificial Sequence: Synthetic coding sequence
atgtggggcctggccggcggccgcctgtttggcatcttcagcgcccctgtgctggtggccgtggtgtgctgtgcccagagcgtgaatgaccccggcaacatgagctttgtgaaggagaccgtggacaagctgctgaagggctatgacatccggctgcggccagactttggaggcccccctgtgtgtgtgggcatgaacattgatattgccagcattgacatggtgtctgaggtgaacatggactacaccctgaccatgtacttccagcagtactggagggacaagaggctggcctacagcggcatccccctgaacctgaccctggacaacagagtggccgaccagctgtgggtgcctgacacctacttcctgaatgacaagaagagctttgtgcacggcgtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaggggcggggacaaggctgtgactggagtggagcgcatcgagctgccccagttcagcatcgtggagcaccggctggtgtccagaaatgtggtgtttgccactggagcctacccccggctgagcctgtccttccggctgaagagaaatattggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcctggccctgctggagtatgcctttgtgaactacatcttcttcggccggggcccccagaggcagaagaagctggccgagaagacagccaaggccaagaatgacaggagcaagtctgagagcaacagagtggatgcccacggcaacatcctgctgaccagcctggaggtgcacaatgagatgaatgaggtgtctgggggcattggagacaccagaaattctgccatcagctttgacaacagcggcatccagtacaggaagcagagcatgccccgggagggccacggccgcttcctgggggacaggagcctgccccacaagaagacccacctgcggcggcgcagcagccagctgaagatcaagatcccagacctgacagatgtgaatgccatcgaccgctggagccgcatcgtgttccccttcaccttcagcctcttcaacctggtgtactggctgtactacgtgaactag

SEQ ID NO: 153453 - DNA, 1209 bp, Artificial Sequence
  Description of Artificial Sequence: Synthetic coding sequence
atgtgggccacctaccagacagaggaggactacaccctgaccatgtacttccagcagtactggagggacaagaggctggcctacagcggcatccccctgaacctgaccctggacaacagagtggccgaccagctgtgggtgcctgacacctacttcctgaatgacaagaagagctttgtgcatggagtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaggggcggggacaaggctgtgactggagtggagagaattgagctgccccagttcagcatcgtggagcaccggctggtgtccagaaatgtggtgtttgccaccggggcctacccccggctgagcctgtccttccggctgaagaggaacatcggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcctggccctgctggagtatgcctttgtgaactacatcttcttcggccggggcccccagaggcagaagaagctggccgagaagacagccaaggccaagaatgacaggagcaagtctgagagcaacagagtggatgcccacggcaacatcctgctgaccagcctggaggtgcacaatgagatgaatgaggtgtctgggggcatcggggacaccaggaacagcgccatcagctttgacaacagcggcatccagtacaggaagcagagcatgccccgggagggccacggccgcttcctgggggacaggagcctgccccacaagaagacccacctgcggcggcgcagcagccagctgaagatcaagatcccagacctgacagatgtgaatgccatcgaccgctggagcagaattgtgttccccttcaccttcagcctcttcaacctggtgtactggctgtactacgtgaactag

SEQ ID NO: 153454 - DNA, 1167 bp, Artificial Sequence
  Description of Artificial Sequence: Synthetic coding sequence
atgtacttccagcagtactggagggacaagaggctggcctacagcggcatccccctgaacctgaccctggacaacagagtggccgaccagctgtgggtgcctgacacctacttcctgaatgacaagaagagctttgtgcatggagtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaggggcggggacaaggctgtgactggagtggagagaattgagctgccccagttcagcatcgtggagcaccggctggtgtccagaaatgtggtgtttgccaccggggcctacccccggctgagcctgtccttccggctgaagaggaacatcggctacttcatcctgcagacctacatgcccagcatcctgatcaccatcctgtcctgggtgtccttctggatcaactatgatgccagcgctgcccgggtggccctgggcatcaccaccgtgctgaccatgaccaccatcaacacccacctgcgggagaccctgcccaagatcccctacgtgaaggccatcgacatgtacctgatgggctgctttgtgtttgtgttcctggccctgctggagtatgcctttgtgaactacatcttcttcggccggggcccccagaggcagaagaagctggccgagaagacagccaaggccaagaatgacaggagcaagtctgagagcaacagagtggatgcccacggcaacatcctgctgaccagcctggaggtgcacaatgagatgaatgaggtgtctgggggcatcggggacaccaggaacagcgccatcagctttgacaacagcggcatccagtacaggaagcagagcatgccccgggagggccacggccgcttcctgggggacaggagcctgccccacaagaagacccacctgcggcggcgcagcagccagctgaagatcaagatcccagacctgacagatgtgaatgccatcgaccgctggagcagaattgtgttccccttcaccttcagcctcttcaacctggtgtactggctgtactacgtgaactag

SEQ ID NO: 153455 - DNA, 417 bp, Artificial Sequence
  Description of Artificial Sequence: Synthetic coding sequence
atgtacttccagcagtactggagggacaagaggctggcctacagcggcatccccctgaacctgaccctggacaacagagtggccgaccagctgtgggtgcctgacacctacttcctgaatgacaagaagagctttgtgcatggagtgacagtgaagaacaggatgatccggctgcacccagatggcaccgtgctgtatggcctgcgcatcaccaccacagctgcctgcatgatggacctgcggcgctaccccctggatgagcagaactgcaccctggagattgagagctatggctacaccacagatgacatcgagttctactggaggggcggggacaaggctgtgactggagtggagagaattgagctgccccagttcagcatcgtggagcaccggctggtgtccagaaatgtgtag

SEQ ID NO: 153456 - DNA, 1359 bp, Artificial Sequence
  Description of Artificial Sequence: Synthetic coding sequence
atggatgccccagcccggctgctggcccccctgctgctgctgtgtgcccagcagctgcggggcacccgggccatgaatgacatcggggactatgtgggcagcaacctggagatctcctggctgcccaacctggatggcctgattgctggctacgccaggaacttccggcccggcattggaggcccccctgtgaatgtggccctggccctggaggtggccagcattgaccacatcagcgaggccaacatggagtacaccatgaccgtcttcctgcaccagagctggagggacagccggctgagctacaaccacaccaatgagaccctgggcctggacagcagatttgtggacaagctgtggctgcctgacaccttcatcgtgaatgccaagagcgcctggttccatgatgtgacagtggagaacaagctgatccggctgcagccagatggagtcatcctgtacagcatccgcatcaccagcacagtggcctgtgacatggacctggccaagtaccccatggatgagcaggagtgcatgctggacctggagagctatggctacagcagcgaggacatcgtgtactactggagcgagagccaggagcacatccacggcctggacaagctgcagctggcccagttcaccatcaccagctaccgcttcaccacagagctgatgaacttcaagtctgctggccagttcccccggctgagcctgcacttccacctgcggaggaacagaggagtgtacatcatccagagctacatgcccagcgtgctgctggtggccatgtcctgggtgtccttctggatcagccaggccgctgtgcctgcccgggtgtccctgggcatcaccaccgtgctgaccatgaccaccctgatggtgtctgcccggagcagcctgccccgggccagcgccatcaaggccctggatgtgtacttctggatctgctacgtgtttgtgtttgctgccctggtggagtatgcctttgcccacttcaatgctgactacaggaagaagcagaaggccaaggtgaaggtgtcccggcccagggctgagatggatgtgagaaatgccatcgtgctcttcagcctgtctgctgctggggtgacccaggagctggccatcagccggcggcagaggagagtgcccggcaacctgatgggcagctacagatctgtgggcgtggagaccggggagaccaagaaggagggcgccgcccggagcggcggccagggcggcatccgggcccggctgcggcccattgatgctgacaccatcgacatctatgcccgggctgtgtttcctgctgcctttgctgctgtgaatgtcatctactgggccgcctatgccatgtag

SEQ ID NO: 153457 - DNA, 1521 bp, Artificial Sequence
  Description of Artificial Sequence: Synthetic coding sequence
atgctgagcaaggtgctgcctgtgctgctgggcatcctgctgatcctgcagagccgggtggagggcccccagacagagagcaagaatgaggccagcagcagagatgtggtgtatggcccccagccccagcccctggagaaccagctgctgtctgaggagaccaagagcacagaaacagaaacaggcagccgggtgggcaagctgcctgaggccagccgcatcctgaacaccatcctgagcaactatgaccacaagctgcggcccggcatcggggagaagcccaccgtggtgacagtggagatctctgtgaacagcctgggccccctgagcatcctggacatggagtacaccatcgacatcatcttcagccagacctggtatgatgagcggctgtgctacaatgacacctttgagagcctggtgctgaatggaaatgtggtgtcccagctgtggatcccagacaccttcttcaggaacagcaagaggacccatgagcacgagatcaccatgcccaaccagatggtgcgcatctacaaggatggcaaggtgctgtacaccatccgcatgaccattgatgctggctgcagcctgcacatgctgcgcttccccatggacagccacagctgccccctgtccttcagcagcttctcctacccagaaaatgagatgatctacaagtgggagaacttcaagctggagatcaatgagaagaacagctggaagctgttccagtttgacttcaccggggtgagcaacaagacagagatcatcaccacccctgtgggggacttcatggtgatgaccatcttcttcaacgtgtccagaagatttggctacgtggccttccagaactacgtgcccagctctgtgaccaccatgctgtcctgggtgtccttctggatcaagacagaaagtgccccagcccggaccagcctgggcatcacctctgtgctgaccatgaccaccctgggcaccttcagcaggaagaacttcccccgggtgtcctacatcacagccctggacttctacatcgccatctgctttgtgttctgcttctgtgccctgctggagtttgctgtgctgaacttcctgatctacaaccagaccaaggcccacgccagccccaagctgcggcacccccgcatcaacagccgggcccacgcccggacccgggcccggagccgggcctgtgcccggcagcaccaggaggcctttgtgtgccagatcgtgaccacagagggcagtgatggagaggagcggcccagctgcagcgcccagcagccccccagccctggcagccctgagggccccaggagcctgtgcagcaagctggcctgctgtgagtggtgcaagcgcttcaagaagtacttctgcatggtgcctgactgtgagggcagcacctggcagcagggccgcctgtgcatccacgtgtaccgcctggacaactacagccgggtggtgtttcctgtgaccttcttcttcttcaacgtgctgtactggctggtgtgcctgaacctgtag

SEQ ID NO: 153458 - DNA, 420 bp, Artificial Sequence
  Description of Artificial Sequence: Synthetic coding sequence
atgaggagcccctgccccacccgctggagcgccagcaccaggatggcccgctgctgcacccagctggtgtcctacccagaaaatgagatgatctacaagtgggagaacttcaagctggagatcaatgagaagaacagctggaagctgttccagtttgacttcaccggggtgagcaacaagacagagatcatcaccacccctgtgggggacctgaatgaggagccccgggacctgccccgggtggccccccgggccaccctggagaccctcttcacccacccagaccaggtgcagggcagcgagggcacagccctgattgtgtccaggatgtggatggagcctgtgacccagcctgccatctgccgggagcggcacctggtgctgctgcccttcaagatcccccggcaggaggacttctag

SEQ ID NO: 153459 - DNA, 1398 bp, Artificial Sequence
  Description of Artificial Sequence: Synthetic coding sequence
atgggccccctgaaggccttcctgttcagccccttcctgctgcggagccagagccggggcgtgcggctggtgttcctgctgctgaccctgcacctgggcaactgtgtggacaaggcagatgatgaagatgatgaggacctgactgtgaacaagacctgggtgctggcccccaagatccacgagggggacatcacccagatcctgaacagcctgctgcagggctatgacaacaagctgcggccagacattggagtgcggcccaccgtcatcgagacagatgtgtatgtgaacagcatcggccctgtggaccccatcaacatggagtacaccatcgacatcatctttgcccagacctggtttgacagccggctgaagttcaacagcaccatgaaggtgctgatgctgaacagcaacatggtgggcaagatctggatcccagacaccttcttcaggaacagcaggaagagtgatgcccactggatcaccacccccaaccggctgctgcgcatctggaatgatggccgggtgctgtacaccctgcggctgaccatcaatgctgagtgctacctgcagctgcacaacttccccatggatgagcacagctgccccctggagttcagcagctatggctaccccaagaatgaaattgagtacaagtggaagaagcccagcgtggaggtggccgaccccaagtactggaggctgtaccagtttgcctttgtgggcctgaggaacagcacagagatcacccacaccatcagcggggactatgtgatcatgaccatcttctttgacctgagcaggaggatgggctacttcaccatccagacctacatcccctgcatcctgactgtggtgctgtcctgggtgtccttctggatcaacaaggatgctgtgcctgcccggaccagcctgggcatcaccaccgtgctgaccatgaccaccctgagcaccatcgccaggaagagcctgcccaaggtgtcctatgtgacagccatggacctgtttgtgtctgtgtgcttcatctttgtgtttgctgccctgatggagtatggcaccctgcactacttcaccagcaaccagaagggcaagacagccaccaaggacaggaagctgaagaacaaggcctccatgaccccaggcctgcaccctggcagcaccctcatccccatgaacaacatctctgtgccccaggaggatgattatggctaccagtgcctggagggcaaggactgtgccagcttcttctgctgctttgaggactgcaggacaggctcctggagggagggccgcatccacatccgcatcgccaagattgacagctacagccgcatcttcttccccacagcctttgccctcttcaacctggtgtactgggtgggctacctgtacctgtag

SEQ ID NO: 153460 - DNA, 1260 bp, Artificial Sequence
  Description of Artificial Sequence: Synthetic coding sequence
atgggccccctgaaggccttcctgttcagccccttcctgctgcggagccagagccggggcgtgcggctggtgttcctgctgctgaccctgcacctgggcaactgtgtggacaaggcagatgatgaagatgatgaggacctgactgtgaacaagacctgggtgctggcccccaagatccacgagggggacatcacccagatcctgaacagcctgctgcagggctatgacaacaagctgcggccagacattggagtgcggcccaccgtcatcgagacagatgtgtatgtgaacagcatcggccctgtggaccccatcaacatggagtacaccatcgacatcatctttgcccagacctggtttgacagccggctgaagttcaacagcaccatgaaggtgctgatgctgaacagcaacatggtgggcaagatctggatcccagacaccttcttcaggaacagcaggaagagtgatgcccactggatcaccacccccaaccggctgctgcgcatctggaatgatggccgggtgctgtacaccctgcggctgaccatcaatgctgagtgctacctgcagctgcacaacttccccatggatgagcacagctgccccctggagttcagcagctatggctaccccaagaatgaaattgagtacaagtggaagaagcccagcgtggaggtggccgaccccaagtactggaggctgtaccagtttgcctttgtgggcctgaggaacagcacagagatcacccacaccatcagcggggactatgtgatcatgaccatcttctttgacctgagcaggaggatgggctacttcaccatccagacctacatcccctgcatcctgactgtggtgctgtcctgggtgtccttctggatcaacaaggatgctgtgcctgcccggaccagcctgggcatcaccaccgtgctgaccatgaccaccctgagcaccatcgccaggaagagcctgcccaaggtgtcctatgtgacagccatggacctgtttgtgtctgtgtgcttcatctttgtgtttgctgccctgatggagtatggcaccctgcactacttcaccagcaaccagaagggcaagacagccaccaaggacaggaagctgaagaacaaggcctccatgaccccaggcctgcaccctggcagcaccctcatccccatgaacaacatctctgtgccccaggaggatgattatggctaccagtgcctggagggcaggaaggacacccacacccactgccagaactag

SEQ ID NO: 153461 - DNA, 1428 bp, Artificial Sequence
  Description of Artificial Sequence: Synthetic coding sequence
atgagcagccccaacatctggagcacaggcagctctgtgtacagcacccctgtgttcagccagaagatgacagtgtggatcctgctgctgctgagcctgtacccaggcttcaccagccagaagagtgatgatgattatgaagattatgccagcaacaagacctgggtgctgacccccaaggtgcctgaaggagatgtgaccgtcatcctgaacaacctgctggagggctatgacaacaagctgcggccagacattggagtgaagcccaccctcatccacacagacatgtatgtgaacagcatcggccctgtgaatgccatcaacatggagtacaccatcgacatcttctttgcccagacctggtatgaccggcggctgaagttcaacagcaccatcaaggtgctgcggctgaacagcaacatggtgggcaagatctggatcccagacaccttcttcaggaacagcaagaaggcagatgcccactggatcaccacccccaacaggatgctgcgcatctggaatgatggccgggtgctgtacaccctgcggctgaccattgatgctgagtgccagctgcagctgcacaacttccccatggatgagcacagctgccccctggagttcagcagctatggctacccccgggaggagatcgtgtaccagtggaagaggagctctgtggaggtgggggacaccaggtcctggaggctgtaccagttctcctttgtgggcctgaggaacaccacagaggtggtgaagaccaccagcggggactatgtggtgatgtctgtgtactttgacctgagcaggaggatgggctacttcaccatccagacctacatcccctgcaccctcatcgtggtgctgtcctgggtgtccttctggatcaacaaggatgctgtgcctgcccggaccagcctgggcatcaccaccgtgctgaccatgaccaccctgagcaccatcgccaggaagagcctgcccaaggtgtcctatgtgacagccatggacctgtttgtgtctgtgtgcttcatctttgtgttcagcgccctggtggagtatggcaccctgcactactttgtgagcaacaggaagcccagcaaggacaaggacaagaagaagaagaaccccctgctgaggatgttctccttcaaggcccccaccatcgacatccggcccaggtctgccaccatccagatgaacaatgccacccacctgcaggagagagatgaggagtatggctatgaatgtctggatggcaaggactgtgccagcttcttctgctgctttgaggactgcaggactggagcctggaggcatggccgcatccacatccgcatcgccaagatggacagctatgcccgcatcttcttccccacagccttctgcctcttcaacctggtgtactgggtgtcctacctgtacctgtag

SEQ ID NO: 153462 - DNA, 1404 bp, Artificial Sequence
  Description of Artificial Sequence: Synthetic coding sequence
atgagcagccccaacatctggagcacaggcagctctgtgtacagcacccctgtgttcagccagaagatgacagtgtggatcctgctgctgctgagcctgtacccaggcttcaccagccagaagagtgatgatgattatgaagattatgccagcaacaagacctgggtgctgacccccaaggtgcctgaaggagatgtgaccgtcatcctgaacaacctgctggagggctatgacaacaagctgcggccagacattggagtgaagcccaccctcatccacacagacatgtatgtgaacagcatcggccctgtgaatgccatcaacatggagtacaccatcgacatcttctttgcccagacctggtatgaccggcggctgaagttcaacagcaccatcaaggtgctgcggctgaacagcaacatggtgggcaagatctggatcccagacaccttcttcaggaacagcaagaaggcagatgcccactggatcaccacccccaacaggatgctgcgcatctggaatgatggccgggtgctgtacaccctgcggctgaccattgatgctgagtgccagctgcagctgcacaacttccccatggatgagcacagctgccccctggagttcagcagctatggctacccccgggaggagatcgtgtaccagtggaagaggagctctgtggaggtgggggacaccaggtcctggaggctgtaccagttctcctttgtgggcctgaggaacaccacagaggtggtgaagaccaccagcggggactatgtggtgatgtctgtgtactttgacctgagcaggaggatgggctacttcaccatccagacctacatcccctgcaccctcatcgtggtgctgtcctgggtgtccttctggatcaacaaggatgctgtgcctgcccggaccagcctgggcatcaccaccgtgctgaccatgaccaccctgagcaccatcgccaggaagagcctgcccaaggtgtcctatgtgacagccatggacctgtttgtgtctgtgtgcttcatctttgtgttcagcgccctggtggagtatggcaccctgcactactttgtgagcaacaggaagcccagcaaggacaaggacaagaagaagaagaacccagcccccaccatcgacatccggcccaggtctgccaccatccagatgaacaatgccacccacctgcaggagagagatgaggagtatggctatgaatgtctggatggcaaggactgtgccagcttcttctgctgctttgaggactgcaggactggagcctggaggcatggccgcatccacatccgcatcgccaagatggacagctatgcccgcatcttcttccccacagccttctgcctcttcaacctggtgtactgggtgtcctacctgtacctgtag

SEQ ID NO: 153463 - DNA, 1119 bp, Artificial Sequence
  Description of Artificial Sequence: Synthetic coding sequence
atgtatgtgaacagcatcggccctgtgaatgccatcaacatggagtacaccatcgacatcttctttgcccagacctggtatgaccggcggctgaagttcaacagcaccatcaaggtgctgcggctgaacagcaacatggtgggcaagatctggatcccagacaccttcttcaggaacagcaagaaggcagatgcccactggatcaccacccccaacaggatgctgcgcatctggaatgatggccgggtgctgtacaccctgcggctgaccattgatgctgagtgccagctgcagctgcacaacttccccatggatgagcacagctgccccctggagttcagcagctatggctacccccgggaggagatcgtgtaccagtggaagaggagctctgtggaggtgggggacaccaggtcctggaggctgtaccagttctcctttgtgggcctgaggaacaccacagaggtggtgaagaccaccagcggggactatgtggtgatgtctgtgtactttgacctgagcaggaggatgggctacttcaccatccagacctacatcccctgcaccctgattgtggtgctgtcctgggtgtccttctggatcaacaaggatgctgtgcctgcccggaccagcctgggcatcaccaccgtgctgaccatgaccaccctgagcaccatcgccaggaagagcctgcccaaggtgtcctatgtgacagccatggacctgtttgtgtctgtgtgcttcatctttgtgttttctgccctggtggagtatggcaccctgcactactttgtgagcaacaggaagcccagcaaggacaaggacaagaagaagaagaacccagcccccaccatcgacatccggcccaggtctgccaccatccagatgaacaatgccacccacctgcaggagagagatgaggagtatggctatgagtgcctggatggcaaggactgtgccagcttcttctgctgctttgaggactgcaggactggagcctggaggcatggccgcatccacatcagaattgccaagatggacagctatgcccgcatcttcttccccacagccttctgcctcttcaacctggtgtactgggtgtcctacctgtacctgtag

SEQ ID NO: 153464 - DNA, 1404 bp, Artificial Sequence
  Description of Artificial Sequence: Synthetic coding sequence
atggcccccaagctgctgctgctgctgtgcctcttcagcggcctgcacgcccggagcaggaaggtggaggaggatgaatatgaggacagcagcagcaaccagaagtgggtgctggcccccaagagccaggacacagatgtgaccctcatcctgaacaagctgctgcgggagtatgacaagaagctgcggccagacatcggcatcaagcccaccgtgattgatgtggacatctacgtgaacagcatcggccctgtgagcagcatcaacatggagtaccagattgacatcttctttgcccagacctggacagacagccggctgcgcttcaacagcaccatgaagatcctgaccctgaacagcaacatggtgggcctcatctggatcccagacaccatcttcaggaacagcaagacagctgaggcccactggatcaccacccccaaccagctgctgcgcatctggaatgatggcaagatcctgtacaccctgcggctgaccatcaatgctgagtgccagctgcagctgcacaacttccccatggatgagcacagctgccccctcatcttcagcagctatggctaccccaaggaggagatgatctaccgctggaggaagaacagcgtggaggccgctgaccagaagtcctggaggctgtaccagtttgacttcatgggcctgaggaacaccacagagatcgtgaccaccagcgctggggactatgtggtgatgaccatctactttgagctgagcaggaggatgggctacttcaccatccagacctacatcccctgcatcctgactgtggtgctgtcctgggtgtccttctggatcaagaaggatgccaccccagccaggacagccctgggcatcaccaccgtgctgaccatgaccaccctgagcaccatcgccaggaagagcctgccccgggtgtcctatgtgacagccatggacctgtttgtgacagtgtgcttcctgtttgtgtttgctgccctgatggagtatgccaccctgaactactacagcagctgcaggaagcccaccaccaccaagaagaccaccagcctgctgcacccagacagcagccgctggatccctgagcgcatcagcctgcaggcccccagcaactacagcctgctggacatgaggcccccacccacagccatgatcaccctgaacaacagcgtgtactggcaggagtttgaggacacctgtgtgtatgaatgtctggatggcaaggactgccagagcttcttctgctgctatgaggagtgcaagagcggctcctggaggaagggccgcatccacatcgacatcctggagctggacagctacagcagggtcttcttccccaccagcttcctgctcttcaacctggtgtactgggtgggctacctgtacctgtag

SEQ ID NO: 153465 - DNA, 1323 bp, Artificial Sequence
  Description of Artificial Sequence: Synthetic coding sequence
atgaactacagcctgcacctggcctttgtgtgcctgagcctcttcacagagaggatgtgcatccagggcagccagttcaacgtggaggtgggccgcagtgacaagctgagcctgcccggctttgagaacctgacagctggctacaacaagttcctgcggcccaactttggaggagagcctgtgcagatcgccctgaccctggacatcgccagcatcagcagcatcagcgagagcaacatggactacacagccaccatctacctgcggcagcgctggatggaccagaggctggtgtttgagggcaacaagagcttcaccctggatgcccggctggtggagttcctgtgggtgcctgacacctacatcgtggagagcaagaagagcttcctgcacgaggtgacagtgggcaacagactcatccgcctcttcagcaatggaacagtgctgtatgccctgcgcatcaccaccaccgtggcctgcaacatggacctgagcaagtaccccatggacacccagacctgcaagctgcagctggagagctggggctatgatggaaatgatgtggagttcacctggctgcggggaaatgacagcgtgcggggcctggagcacctgcggctggcccagtacaccatcgagcgctacttcaccctggtgaccaggagccagcaggagaccggcaactacacccggctggtgctgcagtttgagctgcggagaaatgtgctgtacttcatcctggagacctacgtgcccagcaccttcctggtggtgctgtcctgggtgtccttctggatcagcctggacagcgtgcctgcccggacctgcattggagtgaccaccgtgctgtccatgaccaccctgatgattggcagcaggaccagcctgcccaacaccaactgcttcatcaaggccattgatgtgtacctgggcatctgcttctcctttgtgtttggagccctgctggagtatgctgtggcccactacagcagcctgcagcagatggccgccaaggaccggggcaccaccaaggaggtggaggaggtgtccatcaccaacatcatcaacagcagcatcagcagcttcaagaggaagatcagctttgccagcattgagatcagcagtgacaacgtggactacagcgacctgaccatgaagaccagtgacaagttcaagtttgtgttccgggagaagatgggccgcatcgtggactacttcaccatccagaaccccagcaatgtggaccactacagcaagctgctcttccccctcatcttcatgctggccaacgtgttctactgggcctactacatgtacttctag

SEQ ID NO: 153466 - DNA, 159 bp, Artificial Sequence
  Description of Artificial Sequence: Synthetic coding sequence
atgaactacagcctgcacctggcctttgtgtgcctgagcctcttcacagagaggatgtgcatccagggcagccagttcaacgtggaggtgggccgcagtgacaagctgagcctgcccggctttgagaacctgacagctggctacaacaagttcctgtag

SEQ ID NO: 153467 - DNA, 1323 bp, Artificial Sequence; identical to SEQ ID NO: 153465
  Description of Artificial Sequence: Synthetic coding sequence

SEQ ID NO: 153468 - DNA, 180 bp, Artificial Sequence
  Description of Artificial Sequence: Synthetic coding sequence
atgaactacagcctgcacctggcctttgtgtgcctgagcctcttcacagagaggatgtgcatccagggcagccagttcaacgtggaggtgggccgcagtgacaagctgagcctgcccggctttgagaacctgacagctggctacaacaagttcctgcggcccaactttggaggagagtag

SEQ ID NO: 153469 - DNA, 279 bp, Artificial Sequence
  Description of Artificial Sequence: Synthetic coding sequence
atgaactacagcctgcacctggcctttgtgtgcctgagcctcttcacagagaggatgtgcatccagggcagccagttcaacgtggaggtgggccgcagtgacaagctgagcctgcccggctttgagaacctgacagctggctacaacaagttcctgcggcccaactttggaggagagcctgtgcagatcgccctgaccctggacatcgccagcatcagcagcatcagcgagagcaacatggactacacagccaccatctacctgcggcagcgctggtag

SEQ ID NO: 153470 - DNA, 516 bp, Artificial Sequence
  Description of Artificial Sequence: Synthetic coding sequence
atgaactacagcctgcacctggcctttgtgtgcctgagcctcttcacagagaggatgtgcatccagggcagccagttcaacgtggaggtgggccgcagtgacaagctgagcctgcccggctttgagaacctgacagctggctacaacaagttcctgcggcccaactttggaggagagcctgtgcagatcgccctgaccctggacatcgccagcatcagcagcatcagcgagagcaacatggactacacagccaccatctacctgcggcagcgctggatggaccagaggctggtgtttgagggcaacaagagcttcaccctggatgcccggctggtggagttcctgtgggtgcctgacacctacatcgtggagagcaagaagagcttcctgcacgaggtgacagtgggcaacagactcatccgcctcttcagcaatggaacagtgctgtatgccctgcgcatcaccaccaccgtggcctgcaacatggacctgagcaagtaccccatggacacctag

SEQ ID NO: 153471 - DNA, 570 bp, Artificial Sequence
  Description of Artificial Sequence: Synthetic coding sequence
atgaactacagcctgcacctggcctttgtgtgcctgagcctcttcacagagaggatgtgcatccagggcagccagttcaacgtggaggtgggccgcagtgacaagctgagcctgcccggctttgagaacctgacagctggctacaacaagttcctgcggcccaactttggaggagagcctgtgcagatcgccctgaccctggacatcgccagcatcagcagcatcagcgagagcaacatggactacacagccaccatctacctgcggcagcgctggatggaccagaggctggtgtttgagggcaacaagagcttcaccctggatgcccggctggtggagttcctgtgggtgcctgacacctacatcgtggagagcaagaagagcttcctgcacgaggtgacagtgggcaacagactcatccgcctcttcagcaatggaacagtgctgtatgccctgcgcatcaccaccaccgtggcctgcaacatggacctgagcaagtaccccatggacacccagacctgcaagctgcagctggagagctggggctatgatggaaatgatgtggagtag

SEQ ID NO: 153472 - DNA, 564 bp, Artificial Sequence
  Description of Artificial Sequence: Synthetic coding sequence
atggactacacagccaccatctacctgcggcagcgctggatggaccagaggctggtgtttgagggcaacaagagcttcaccctggatgaggtgacagtgggcaacagactcatccgcctcttcagcaatggaacagtgctgtatgccctgcgcatcaccaccaccgtggcctgcaacatggacctgagcaagtaccccatggacacccagacctgcaagctgcagctggagagctggggctatgatggaaatgatgtggagttcacctggctgcggggaaatgacagcgtgcggggcctggagcacctgcggctggcccagtacaccatcgagcgctacttcaccctggtgaccaggagccagcaggagaccggcaactacacccggctggtgctgcagtttgagctgcggagaaatgtgctgtacttcatcctggagacctacgtgcccagcaccttcctggtggtgctgtcctgggtgtccttctggatcagcctggacagcgtgcctgcccggacctgcattggagacaacaagggcagccgccgcagccagtactactag

SEQ ID NO: 153473 - DNA, 2826 bp, Artificial Sequence
  Description of Artificial Sequence: Synthetic coding sequence
atggccagccccaggagcagcggccagcccggccccccacctcctcctcctcctcctccagcccggctgctgctgctgctgctgctgcccctgctgctgcccctggcccctggggcctggggctgggcccggggggccccccggcccccacccagcagcccccccctgagcatcatgggcctgatgcccctgaccaaggaggtggccaagggcagcatcggccggggcgtgctgcctgctgtggagctggccatcgagcagatcagaaatgaaagcctgctgcggccctacttcctggacctgcggctgtatgacacagaatgtgacaatgccaagggcctgaaggccttctatgatgccatcaagtatggccccaaccacctgatggtgtttggaggagtgtgccccagcgtgaccagcatcatcgccgagagcctgcagggctggaacctggtgcagctgagctttgctgccaccacccctgtgctggccgacaagaagaagtacccctacttcttcagaacagtgcccagcgacaatgctgtgaacccagccatcctgaagctgctgaagcactaccagtggaagagggtgggcaccctgacccaggatgtgcagcgcttcagcgaggtgagaaatgacctgactggagtgctgtatggagaggacatcgagatcagtgacacagagagcttcagcaatgacccctgcacctctgtgaagaagctgaagggaaatgatgtgcgcatcatcctgggccagtttgaccagaacatggccgccaaggtgttctgctgtgcctatgaggagaacatgtatggcagcaagtaccagtggatcatccctggctggtatgagcccagctggtgggagcaggtgcacacagaggccaacagcagccgctgcctgaggaagaacctgctggccgccatggagggctacatcggcgtggactttgagcccctgagcagcaagcagatcaagaccatcagcggcaagaccccccagcagtatgaaagagagtacaacaacaagaggtctggagtgggccccagcaagttccacggctacgcctatgatggcatctgggtgattgccaagaccctgcagagggccatggagaccctgcacgccagcagccgccaccagaggatccaggacttcaactacacagaccacaccctgggccgcatcatcctgaatgccatgaatgagaccaacttctttggagtgacaggccaggtggtgttcagaaatggagagaggatgggcaccatcaagttcacccagttccaggacagccgggaggtgaaggtgggggagtacaatgctgtggccgacaccctggagatcatcaatgacaccatccgcttccagggcagcgagccccccaaggacaagaccatcatcctggagcagctgaggaagatcagcctgcccctgtacagcatcctgagcgccctgaccatcctgggcatgatcatggccagcgccttcctgttcttcaacatcaagaacagaaaccagaagctgatcaagatgagcagcccctacatgaacaacctgatcatcctgggcggcatgctgtcctatgccagcatcttcctgtttggcctggatggcagctttgtgtctgagaagacctttgagaccctgtgcaccgtgaggacctggatcctgactgtgggctacaccacagccttcggggccatgtttgccaagacctggagggtgcacgccatcttcaagaatgtgaagatgaagaagaagatcatcaaggaccagaagctgctggtgattgtgggcggcatgctgctgattgacctgtgcatcctgatctgctggcaggccgtggaccccctgcggaggacagtggagaagtacagcatggagccagaccctgctggccgggacatcagcatccggcccctgctggagcactgtgagaacacccacatgaccatctggctgggcatcgtgtatgcctacaagggcctgctgatgctgtttggctgcttcctggcctgggagaccagaaatgtgtccatcccagccctgaatgacagcaagtacatcggcatgtctgtgtacaacgtgggcatcatgtgcatcattggagctgctgtgtccttcctgacccgggaccagcccaacgtgcagttctgcatcgtggccctggtgatcatcttctgcagcaccatcaccctgtgcctggtgtttgtgcccaagctgatcaccctgcggaccaacccagatgctgccacccagaacagacgcttccagttcacccagaaccagaagaaggaggacagcaagaccagcacctctgtgacctctgtgaaccaggccagcaccagccggctggagggcctgcagagcgagaaccaccggctgaggatgaagatcacagagctggacaaggacctggaggaggtgaccatgcagctgcaggacaccccagagaagaccacctacatcaagcagaaccactaccaggagctgaatgacatcctgaacctgggcaacttcacagagagcacagatggcggcaaggccatcctgaagaaccacctggaccagaacccccagctgcagtggaacaccacagagcccagcaggacctgcaaggaccccatcgaggacatcaacagccctgagcacatccagaggcggctgagcctgcagctgcccatcctgcaccacgcctacctgcccagcattggaggagtggatgccagctgtgtgagcccctgtgtgagccccacagccagccccaggcacagacatgtgcccccatccttccgggtgatggtgtctggcctgtag

SEQ ID NO: 153474 - DNA, 1179 bp, Artificial Sequence
  Description of Artificial Sequence: Synthetic coding sequence
atgaggcctggctttggaggccctgccatccctgtgggcgtggatgtgcaggtggagagcctggacagcatcagcgaggtggacatggacttcaccatgaccctgtacctgcggcactactggaaggatgagcggctgtccttccccagcaccaacaacctgtccatgacctttgatggccgcctggtgaagaagatctgggtgcctgacatgttctttgtgcacagcaagaggagcttcatccatgacaccaccacagacaacgtgatgctgcgggtgcagccagatggcaaggtgctgtacagcctgcgggtgacagtgacagccatgtgcaacatggacttcagccgcttccccctggacacccagacctgcagcctggagattgagagctatgcctacacagaagatgacctgatgctgtactggaagaagggaaatgacagcctgaagacagatgagcgcatcagcctgagccagttcctgatccaggagttccacaccaccaccaagctggccttctacagcagcacaggctggtacaaccggctgtacatcaacttcaccctgcggcggcacatcttcttcttcctgctgcagacctacttccctgccaccctgatggtgatgctgtcctgggtgtccttctggattgaccggcgggctgtgcctgcccgggtgcccctgggcatcaccaccgtgctgaccatgagcaccatcatcaccggggtgaatgcctccatgccccgggtgtcctacatcaaggctgtggacatctacctgtgggtgtcctttgtgtttgtgttcctgtctgtgctggagtatgctgctgtgaactacctgaccaccgtgcaggagaggaaggagcagaagctgcgggagaagctgccctgcaccagcggcctgcccccacccaggacagccatgctggatggcaactacagtgatggagaggtgaatgacctggacaactacatgccagaaaatggagagaagccagacaggatgatggtgcagctgaccctggccagcgagaggagcagcccccagaggaagagccagaggagcagctatgtgtccatgagaattgacacccacgccatcgacaagtacagccgcatcatcttccctgctgcctacatcctcttcaacctgatctactggagcatcttctcctag

SEQ ID NO: 153475 - DNA, 1389 bp, Artificial Sequence
  Description of Artificial Sequence: Synthetic coding sequence
atgctggccgtgcccaacatgagatttggcatcttcctgctgtggtggggctgggtgctggccacagagagcaggatgcactggccaggccgggaggtgcatgagatgagcaagaagggcagccccatcctgcggcgcagcccagacatcaccaagagccccctgaccaagtctgagcagctgctgagaattgatgaccatgacttctccatgaggcctggctttggaggccctgccatccctgtgggcgtggatgtgcaggtggagagcctggacagcatcagcgaggtggacatggacttcaccatgaccctgtacctgcggcactactggaaggatgagcggctgtccttccccagcaccaacaacctgtccatgacctttgatggccgcctggtgaagaagatctgggtgcctgacatgttctttgtgcacagcaagaggagcttcatccatgacaccaccacagacaacgtgatgctgcgggtgcagccagatggcaaggtgctgtacagcctgcgggtgacagtgacagccatgtgcaacatggacttcagccgcttccccctggacacccagacctgcagcctggagattgagagctatgcctacacagaagatgacctgatgctgtactggaagaagggaaatgacagcctgaagacagatgagcgcatcagcctgagccagttcctgatccaggagttccacaccaccaccaagctggccttctacagcagcacaggctggtacaaccggctgtacatcaacttcaccctgcggcggcacatcttcttcttcctgctgcagacctacttccctgccaccctgatggtgatgctgtcctgggtgtccttctggattgaccggcgggctgtgcctgcccgggtgcccctgggcatcaccaccgtgctgaccatgagcaccatcatcaccggggtgaatgcctccatgccccgggtgtcctacatcaaggctgtggacatctacctgtgggtgtcctttgtgtttgtgttcctgtctgtgctggagtatgctgctgtgaactacctgaccaccgtgcaggagaggaaggagcagaagctgcgggagaagctgccctgcaccagcggcctgcccccacccaggacagccatgctggatggcaactacagtgatggagaggtgaatgacctggacaactacatgccagaaaatggagagaagccagacaggatgatggtgcagctgaccctggccagcgagaggagcagcccccagaggaagagccagaggagcagctatgtgtccatgagaattgacacccacgccatcgacaagtacagccgcatcatcttccctgctgcctacatcctcttcaacctgatctactggagcatcttctcctag

SEQ ID NO: 153476 - DNA, 1179 bp, Artificial Sequence; identical to SEQ ID NO: 153474
  Description of Artificial Sequence: Synthetic coding sequence

SEQ ID NO: 153477 - DNA, 1440 bp, Artificial Sequence
  Description of Artificial Sequence: Synthetic coding sequence
atgctggccgtgcccaacatgagatttggcatcttcctgctgtggtggggctgggtgctggccacagagagcaggatgcactggccaggccgggaggtgcatgagatgagcaagaagggccggccccagaggcagaggcgggaggtgcatgaagatgcccacaagcaggtgagccccatcctgcggcgcagcccagacatcaccaagagccccctgaccaagtctgagcagctgctgagaattgatgaccatgacttctccatgaggcctggctttggaggccctgccatccctgtgggcgtggatgtgcaggtggagagcctggacagcatcagcgaggtggacatggacttcaccatgaccctgtacctgcggcactactggaaggatgagcggctgtccttccccagcaccaacaacctgtccatgacctttgatggccgcctggtgaagaagatctgggtgcctgacatgttctttgtgcacagcaagaggagcttcatccatgacaccaccacagacaacgtgatgctgcgggtgcagccagatggcaaggtgctgtacagcctgcgggtgacagtgacagccatgtgcaacatggacttcagccgcttccccctggacacccagacctgcagcctggagattgagagctatgcctacacagaagatgacctgatgctgtactggaagaagggaaatgacagcctgaagacagatgagcgcatcagcctgagccagttcctgatccaggagttccacaccaccaccaagctggccttctacagcagcacaggctggtacaacagactctacatcaacttcaccctgcggcggcacatcttcttcttcctgctgcagacctacttccctgccaccctgatggtgatgctgtcctgggtgtccttctggattgacagaagagctgtgcctgcccgggtgcccctgggcatcaccaccgtgctgaccatgagcaccatcatcactggagtgaatgcctccatgccccgggtgtcctacatcaaggctgtggacatctacctgtgggtgtcctttgtgtttgtgttcctgtctgtgctggagtatgctgctgtgaactacctgaccaccgtgcaggagaggaaggagcagaagctgcgggagaagctgccctgcaccagcggcctgcccccacccaggacagccatgctggatggcaactacagtgatggagaggtgaatgacctggacaactacatgccagaaaatggagagaagccagacaggatgatggtgcagctgaccctggccagcgagaggagcagcccccagaggaagagccagaggagcagctatgtgtccatgagaattgacacccacgccatcgacaagtacagccgcatcatcttccctgctgcctacatcctcttcaacctgatctactggagcatcttctcctag

SEQ ID NO: 153478 - DNA, 1473 bp, Artificial Sequence
  Description of Artificial Sequence: Synthetic coding sequence
atggtgaagccaggcggcatctgcagcgccaccggctactggaaggccgccttctgcctgacagatgtgcacaagatgccctacttcaccaggctcatcctcttcctgttctgcctgatggtgctggtggagagcaggaagcccaagaggaagcgctggacaggccaggtggagatgcccaagcccagccacctgtacaagaagaacctggatgtgaccaagatcaggaagggcaagccccagcagctgctgcgggtggatgaacatgacttctccatgaggcctgcctttggaggccctgccatccctgtgggcgtggatgtgcaggtggagagcctggacagcatcagcgaggtggacatggacttcaccatgaccctgtacctgcggcactactggaaggatgagcggctggccttcagcagcgccagcaacaagtccatgacctttgatggccgcctggtgaagaagatctgggtgcctgatgtgttctttgtgcacagcaagaggagcttcacccatgacaccaccacagacaacatcatgctgcgggtcttcccagatggccacgtgctgtacagcatgaggatcaccgtgacagccatgtgcaacatggacttcagccacttccccctggacagccagacctgcagcctggagctggagagctatgcctacacagatgaggacctgatgctgtactggaagaatggagatgagagcctgaagacagatgagaagatcagcctgagccagttcctgatccagaagttccacaccaccagccggctggccttctacagcagcacaggctggtacaaccggctgtacatcaacttcaccctgcggcggcacatcttcttcttcctgctgcagacctacttccctgccaccctgatggtgatgctgtcctgggtgtccttctggattgaccggcgggctgtgcctgcccgggtgtccctgggcatcaccaccgtgctgaccatgaccaccatcatcaccggggtgaatgcctccatgccccgggtgtcctatgtgaaggctgtggacatctacctgtgggtgtcctttgtgtttgtgttcctgtctgtgctggagtatgctgctgtgaactacctgaccaccgtgcaggagaggaaggagaggaagctgcgggagaagttcccctgcatgtgtggcatgctgcacagcaagaccatgatgctggatggcagctacagcgagagcgaggccaacagcctggccggctaccccaggagccacatcctgacagaggaggagcggcaggacaagatcgtggtgcacctgggcctgtctggagaggccaatgctgccaggaagaagggcctgctgaagggccagacaggcttccgcatcttccagaacacccacgccatcgacaagtacagccgcctcatcttccctgccagctacatcttcttcaacctgatctactggagcgtcttctcctag

SEQ ID NO: 153479 - DNA, 453 bp, Artificial Sequence
  Description of Artificial Sequence: Synthetic coding sequence
atgctgcgggctgctgtgatcctgctgctgatccgcacctggctggccgagggcaactaccccagccccatccccaagttccactttgagttcagcagcgctgtgcctgaggtggtgctgaacctcttcaactgcaagaactgtgccaatgaggccgtggtgcagaagatcctggacagagtgctgagccgctatgatgtgcggctgcggcccaactttggaggagtgctggagaccaacagcacctggggcctgaatgatgatgagctgatggcccacggccaggagaaggacagcagcagcgagagcgaggacagctgcccccccagccctggctgcagcttcacagagggcttctcctttgacctcttcaacccagactatgtgcccaaggtggacaagtggagccgcttcctgttccccctggccttcggcctcttcaacatcgtgtag

SEQ ID NO: 153480 - DNA, 1899 bp, Artificial Sequence
  Description of Artificial Sequence: Synthetic coding sequence
atgggcatccggggcatgctgcgggccgccgtcatcctgctgctgatccgcacctggctggccgagggcaactaccccagccccatccccaagttccactttgagttcagcagcgctgtgcctgaggtggtgctgaacctcttcaactgcaagaactgtgccaatgaagctgtggtgcagaagatcctggacagagtgctgagccgctatgatgtgcggctgcggcccaactttggaggagcccctgtgcctgtgcgcatcagcatctacgtgaccagcattgagcagatcagcgagatgaacatggactacaccatcaccatgttcttccaccagacctggaaggacagccggctggcctactatgagaccaccctgaacctgaccctggactacaggatgcatgagaagctgtgggtgcctgactgctacttcctgaacagcaaggatgcctttgtgcatgatgtgacagtggagaacagagtcttccagctgcacccagatggcaccgtgcgctatggcatccggctgaccaccacagctgcctgcagcctggacctgcacaagttccccatggacaagcaggcctgcaacctggtggtggagagctatggctacacagtggaggacatcatcctcttctgggatgacaatggaaatgccatccacatgacagaggagctgcacatcccccagttcaccttcctgggccgcaccatcaccagcaaggaggtgtacttctacacaggcagctacatccgcctcatcctgaagttccaggtgcagcgggaggtgaacagctacctggtgcaggtgtactggcccaccgtgctgaccaccatcacctcctggatctccttctggatgaactatgacagcagcgctgcccgggtgaccatcggcctgacctccatgctgatcctgaccaccatcgacagccacctgcgggacaagctgcccaacatcagctgcatcaaggccatcgacatctacatcctggtgtgcctcttctttgtgttcctgagcctgctggagtatgtgtacatcaactacctgttctacagccggggcccccggcggcagcccaggaggcaccggcggcccaggagggtcatcgcccgctaccgctaccagcaggtggtggtgggcaatgtgcaggacggcctcatcaacgtggaggatggagtgagcagcctgcccatcaccccagcccaggcccccctggccagccctgagagcctgggcagcctgaccagcaccagcgagcaggcccagctggccaccagcgagagcctgagccccctgaccagcctgagcggccaggcccccctggccaccggggagagcctgagtgacctgcccagcaccagcgagcaggcccggcacagctatggagtgcgcttcaacggcttccaggctgatgacagcatcttccccacagagatccggaacagagtggaggcccacggccatggagtgacccatgaccacgaggacagcaatgaaagcctgagcagtgatgagcggcacggccacggccccagcggcaagcccatgctgcaccacggggagaagggcgtgcaggaggccggctgggacctggatgacaacaatgacaagagtgactgcctggccatcaaggagcagttcaagtgtgacaccaacagcacctggggcctgaatgatgatgagctgatggcccacggccaggagaaggacagcagcagcgagagcgaggacagctgcccccccagccctggctgcagcttcacagagggcttctcctttgacctcttcaacccagactatgtgcccaaggtggacaagtggagccgcttcctgttccccctggccttcggcctcttcaacatcgtgtactgggtgtaccacatgtactag

SEQ ID NO: 153481 - DNA, 1083 bp, Artificial Sequence
  Description of Artificial Sequence: Synthetic coding sequence
atggacagcagcaactgcaaggtgattgcccccctgctgagccagcgctacagaaggatggtgaccaaggatggccacagcaccctgcagatggatggagcccagaggggcctggcctacctgagagatgcctggggcatcctgatggacatgcgctggcgctggatgatgctggtgttttctgccagctttgtggtgcactggctggtgtttgctgtgctgtggtacgtgctggccgagatgaatggagacctggagctggaccatgatgcccctcctgagaaccacaccatctgtgtgaagtacatcaccagcttcaccgctgccttctccttcagcctggagacccagctgaccatcggctacggcaccatgttccccagcggggactgccccagcgccatcgccctgctggccatccagatgctgctgggcctgatgctggaggccttcatcactggagcctttgtggccaagatcgcccggcccaagaacagagccttcagcatccgcttcacagacacagctgtggtggcccacatggatggcaagcccaacctgatcttccaggtggccaacacccggcccagccccctgacctctgtgcgggtgtctgctgtgctgtaccaggagagagaaaatggcaagctgtaccagacctctgtggacttccacctggatggcatcagcagtgatgaatgtcccttcttcatcttccccctgacctactaccacagcatcacccccagcagccccctggccaccctgctgcagcacgagaaccccagccactttgagctggtggtgttcctgagcgccatgcaggagggcaccggggagatctgccagaggaggaccagctacctgcccagcgagatcatgctgcaccactgctttgccagcctgctgacccggggcagcaagggggagtaccagatcaagatggagaactttgacaagacagtgcctgagttccccacccccctggtgtccaagagccccaacagaacagacctggacatccacatcaatggccagagcattgacaacttccagatcagcgagaccggcctgacagaatag

SEQ ID NO: 153482 - DNA, 2106 bp, Artificial Sequence
  Description of Artificial Sequence: Synthetic coding sequence
atggctgtgtctgctggcagcgcccggaccagccccagcagcggcttcctgatggtgctggacatcccccaggagcggggcctgagcagcctggacaggaagtacctggatggcctggatgtgtgccgcttccccctgctggatgccctgcggcccctgcccctggactggatgtacctggtgtacaccatcatgttcctgggcgccctgggcatgatgctgggcctgtgctaccgcatcagctgtgtgctcttcctgctgccctactggtacgtgttcctgctggacaagacctcctggaacaaccacagctacctgtatggcctgctggccttccagctgaccttcatggatgccaaccactactggagcgtggatggcctgctgaatgcccacagaagaaatgcccacgtgcccctgtggaactatgctgtgctgcggggccagatcttcatcgtgtacttcatcgccggcgtgaagaagctggatgctgactgggtggagggctacagcatggagtacctgagccgccactggctgttcagccccttcaagctgctgctgtctgaggagctgaccagcctgctggtggtgcactggggcggcctgctgctggacctgtctgctggcttcctgctcttctttgatgtgagccgcagcatcggcctcttctttgtgtcctacttccactgcatgaacagccagctgttcagcatcggcatgttctcctatgtgatgctggccagcagccccctcttctgcagccctgagtggcccaggaagctggtgtcctactgcccccggcggctgcagcagctgctgcccctgaaggccgccccccagcccagcgtgtcctgtgtgtacaagaggagccggggcaagagcggccagaagccaggcctgcggcaccagctgggcgccgccttcaccctgctgtacctgctggagcagctgttcctgccctacagccacttcctgacccagggctacaacaactggaccaacggcctgtatggctacagctgggacatgatggtgcacagccgcagccaccagcacgtgaagatcacctacagagatggccgcactggagagctgggctacctgaaccctggggtcttcacccagagccgccgctggaaggaccacgccgacatgctgaagcagtatgccacctgcctgagccggctgctgcccaagtacaacgtgacagagccccagatctactttgacatctgggtgtccatcaatgaccgcttccagcagaggatctttgacccccgggtggacatcgtgcaggccgcctggagccccttccagaggacctcctgggtgcagcccctgctgatggacctgagcccctggagggccaagctgcaggagatcaagagcagcctggacaaccacacagaggtggtgttcatcgctgacttccctggcctgcacctggagaactttgtgtctgaggacctgggcaacaccagcatccagctgctgcagggcgaggtgacagtggagctggtggccgagcagaagaaccagaccctgcgggagggggagaagatgcagctgcctgctggggagtaccacaaggtgtacaccaccagccccagccccagctgctacatgtatgtgtatgtgaacaccacagagctggccctggagcaggacctggcctacctgcaggagctgaaggagaaggtggagaatggcagcgagaccggccccctgcccccagagctgcagcccctgctggagggggaggtgaagggcggccctgagcccacccccctggtgcagaccttcctgcggcggcagcagaggctgcaggagattgaaagaagaagaaacacccccttccacgagcgcttcttccgcttcctgctgaggaagctgtatgtgttccgccgctccttcctgatgacctgcatcagcctgaggaacctgatcctgggccggcccagcctggagcagctggcccaggaggtgacctacgccaacctgcggccctttgaagctgtgggggagctgaaccccagcaacacagacagcagccacagcaaccccccagagagcaacccagaccctgtgcacagcgagttctag

SEQ ID NO: 153483 - DNA, 957 bp, Artificial Sequence
  Description of Artificial Sequence: Synthetic coding sequence
atggccagccctggctgcctgctgtgtgtgctgggcctgctgctgtgtggggccgccagcctggagctgagccggccccatggagacacagccaagaagcccatcatcggcatcctgatgcagaagtgcaggaacaaggtgatgaagaactacggccgctactacatcgccgccagctatgtgaagtacctggagagcgctggggcccgggtggtgcctgtgcggctggacctgacagagaaggactatgagatcctcttcaagagcatcaatggcatcctcttccctgggggctctgtggacctgcggcggagtgactatgccaaggtggccaagatcttctacaacctgagcatccagagctttgatgatggagactacttccctgtgtggggcacctgcctgggctttgaggagctgagcctgctgatctctggagaatgtctgctgacagccacagacacagtggatgtggccatgcccctgaacttcaccggcggccagctgcacagcaggatgttccagaacttccccacagagctgctgctgagcctggccgtggagcccctgacagccaacttccacaagtggagcctgtctgtgaagaacttcaccatgaatgagaagctgaagaagttcttcaacgtgctgaccaccaacacagatggcaagattgagttcatcagcaccatggagggctacaagtaccctgtgtatggagtgcagtggcaccctgagaaggccccctatgagtggaagaacctggatggcatcagccacgccccaaatgctgtgaagacagccttctacctggccgagttctttgtgaatgaggccaggaagaacaaccaccacttcaagtctgagagcgaggaggagaaggccctgatctaccagttcagccccatctacacaggcaacatcagcagcttccagcagtgctacatctttgattag

SEQ ID NO: 153484 - DNA, 345 bp, Artificial Sequence
  Description of Artificial Sequence: Synthetic coding sequence
atggccaacagcggctgcaaggatgtgacaggcccagatgaggagagcttcctgtactttgcctacggcagcaacctgctgacagagcgcatccacctgaggaaccccagcgctgccttcttctgtgtggcccggctgcaggacttcaagctggactttggaaacagccagggcaagaccagccagacctggcatggaggcatcgccaccatcttccagagccctggagatgaggtgtggggcgtggtgtggaagatgaacaagagcaacctgaacagcctggatgagctgtttgcctgggtgcagaagaagatggtgtgccgctggagcatcaagaggagctag

SEQ ID NO: 153485 - DNA, 567 bp, Artificial Sequence
  Description of Artificial Sequence: Synthetic coding sequence
atggccaacagcggctgcaaggatgtgacaggcccagatgaggagagcttcctgtactttgcctacggcagcaacctgctgacagagcgcatccacctgaggaaccccagcgctgccttcttctgtgtggcccggctgcaggacttcaagctggactttggaaacagccagggcaagaccagccagacctggcatggaggcatcgccaccatcttccagagccctggagatgaggtgtggggcgtggtgtggaagatgaacaagagcaacctgaacagcctggatgagcaggagggcgtgaagagcggcatgtatgtggtgattgaggtgaaggtggccacccaggagggcaaggagatcacctgccgcagctacctgatgaccaactatgagagcgccccacccagcccccagtacaagaagatcatctgcatgggcgccaaggaaaatggcctgcccctggagtaccaggagaagctgaaggccatcgagcccaatgactacacaggcaaggtgtctgaggagattgaggacatcatcaagaagggggagacccagaccctgtag

SEQ ID NO: 153486 - DNA, 384 bp, Artificial Sequence
  Description of Artificial Sequence: Synthetic coding sequence
atgttcaaccccatccaccacctggactactacaagaagaccctgcccagcgagctgaactggctgggccagatgtggctgaagtttggctgcagcggcttccggcaggagggcgtgaagagcggcatgtatgtggtgattgaggtgaaggtggccacccaggagggcaaggagatcacctgccgcagctacctgatgaccaactatgaaagtgccccacccagcccccagtacaagaagatcatctgcatgggcgccaaggaaaatggcctgcccctggagtaccaggagaagctgaaggccatcgagcccaatgactacaccgggaaggtgtctgaggagattgaggacatcatcaagaagggggagacccagaccctgtag

SEQ ID NO: 153487 - DNA, 285 bp, Artificial Sequence
  Description of Artificial Sequence: Synthetic coding sequence
atggccaacagcggctgcaaggatgtgacaggcccagatgaggagagcttcctgtactttgcctacggcagcaacctgctgacagagcgcatccacctgaggaaccccagcgctgccttcttctgtgtggcccggctgcagatcatctgcatgggcgccaaggaaaatggcctgcccctggagtaccaggagaagctgaaggccatcgagcccaatgactacacaggcaaggtgtctgaggagattgaggacatcatcaagaagggggagacccagaccctgtag

SEQ ID NO: 153488 - DNA, 501 bp, Artificial Sequence
  Description of Artificial Sequence: Synthetic coding sequence
atggccaacagcggctgcaaggatgtgacaggcccagatgaggagagcttcctgtactttgcctacggcagcaacctgctgacagagcgcatccacctgaggaaccccagcgctgccttcttctgtgtggcccggctgcaggacttcaagctggactttggaaacagccagggcaagaccagccagacctggcatggaggcatcgccaccatcttccagagccctggagatgaggtgtggggcgtggtgtggaagatgaacaagagcaacctgaacagcctggatgagtggaggaagaagaggcacacagccttccagaaccagggcaaccacccctgcaagcacaagaccaggatgtgggaccgggaccccaagatccctgtgcagaacctgagcctggccctgtgctggcaggcccagagcggccacggcacctgcaacagactctttgcctgggtgcagaagaagatggtgtgccgctggagcatcaagaggagctag

SEQ ID NO: 153489 - DNA, 1710 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgccaccatgttcaacagcagcgagcagagccagaagggcggcctgtctgtggccgtgcctggagagatccggggctatgagctggcccaccagagacatggccgcctgccctgggcccggctcttccagcccagcatccagctggcccggcagggcttccctgtgggcaagggcctggccgccgccctggagaacaagaggacagtgattgagcagcagcctgtgctgtgtgaggtgttctgccgggacaggaaggtgctgcgggagggggagcggctgaccctgccccagctggccgacacctatgagaccctggccatcgagggcgcccaggccttctacaacggcagcctgacagcccagatcgtgaaggacatccaggccgccggcggcatcgtgacagctgaggacctgaacaactacagagctgagctgattgagcaccccctgaacatcagcctgggagatgtggtgctgtacatgcccagcgcccccctgagcggccctgtgctggccctgatcctgaacatcctgaagggctacaacttcagccgggagagcgtggagagccctgagcagaagggcctgacctaccaccgcatcgtggaggccttccgctttgcctatgccaagaggaccctgctgggggaccccaagtttgtggatgtgacagaggtggtgaggaacatgaccagcgagttctttgctgcccagctgcgggcccagatcagtgatgacaccacccaccccatctcctactacaagccagagttctacaccccagatgatggcggcacagcccacctgtctgtggtggctgaagatggcagcgctgtgtctgccaccagcaccatcaacctgtacttcggcagcaaggtgcgcagccctgtgtctggcatcctcttcaacaatgagatggatgacttcagcagccccagcatcaccaatgaatttggagtgccccccagccctgccaacttcatccagcccgggaagcagcccctgagctccatgtgccccaccatcatggtgggccaggacggccaggtgaggatggtggtgggcgccgccggcggcacccagatcaccacagccacagccctggccatcatctacaacctgtggtttggctatgatgtgaagagagctgtggaggagccccggctgcacaaccagctgctgcccaacgtgaccaccgtggagagaaatattgaccaggccgtgacagctgccctggagaccaggcaccaccacacccagatcgccagcaccttcatcgctgtggtgcaggccatcgtgaggacagctgggggctgggccgccgccagtgacagcaggaagggcggggagcctgctggctactag

SEQ ID NO: 153490 - DNA, 1710 bp, Artificial Sequence; identical to SEQ ID NO: 153489
  Description of Artificial Sequence: Synthetic coding sequence

SEQ ID NO: 153491 - DNA, 1710 bp, Artificial Sequence; identical to SEQ ID NO: 153489
  Description of Artificial Sequence: Synthetic coding sequence

SEQ ID NO: 153492 - DNA, 1710 bp, Artificial Sequence; identical to SEQ ID NO: 153489
  Description of Artificial Sequence: Synthetic coding sequence

SEQ ID NO: 153493 - DNA, 678 bp, Artificial Sequence
  Description of Artificial Sequence: Synthetic coding sequence
atgaccagcgagttctttgctgcccagctgcgggcccagatcagtgatgacaccacccaccccatctcctactacaagccagagttctacaccccagatgatggcggcacagcccacctgtctgtggtggctgaagatggcagcgctgtgtctgccaccagcaccatcaacctgtacttcggcagcaaggtgcgcagccctgtgtctggcatcctcttcaacaatgagatggatgacttcagcagccccagcatcaccaatgaatttggagtgccccccagccctgccaacttcatccagcccgggaagcagcccctgagctccatgtgccccaccatcatggtgggccaggacggccaggtgaggatggtggtgggcgccgccggcggcacccagatcaccacagccacagccctggccatcatctacaacctgtggtttggctatgatgtgaagagagctgtggaggagccccggctgcacaaccagctgctgcccaacgtgaccaccgtggagagaaatattgaccaggccgtgacagctgccctggagaccaggcaccaccacacccagatcgccagcaccttcatcgctgtggtgcaggccatcgtgaggacagctgggggctgggccgccgccagtgacagcaggaagggcggggagcctgctggctactag

SEQ ID NO: 153494 - DNA, 678 bp, Artificial Sequence; identical to SEQ ID NO: 153493
  Description of Artificial Sequence: Synthetic coding sequence

SEQ ID NO: 153495 - DNA, 678 bp, Artificial Sequence; identical to SEQ ID NO: 153493
  Description of Artificial Sequence: Synthetic coding sequence

SEQ ID NO: 153496 - DNA, 1710 bp, Artificial Sequence; identical to SEQ ID NO: 153489
  Description of Artificial Sequence: Synthetic coding sequence

SEQ ID NO: 153497 - DNA, 363 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgccaccatgttcaactag

SEQ ID NO: 153498 - DNA, 1392 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgccaccatgttcaacagcagcgagcagagccagaagggcggcctgtctgtggccgtgcctggagagatccggggctatgagctggcccaccagagacatggccgcctgccctgggcccggctcttccagcccagcatccagctggcccggcagggcttccctgtgggcaagggcctggccgccgccctggagaacaagaggacagtgattgagcagcagcctgtgctgtgtgaggtgttctgccgggacaggaaggtgctgcgggagggggagcggctgaccctgccccagctggccgacacctatgagaccctggccatcgagggcgcccaggccttctacaacggcagcctgacagcccagatcgtgaaggacatccaggccgccggcggcatcgtgacagctgaggacctgaacaactacagagctgagctgattgagcaccccctgaacatcagcctgggagatgtggtgctgtacatgcccagcgcccccctgagcggccctgtgctggccctgatcctgaacatcctgaagggctacaacttcagccgggagagcgtggagagccctgagcagaagggcctgacctaccaccgcatcgtggaggccttccgctttgcctatgccaagaggaccctgctgggggaccccaagtttgtggatgtgacagaggtggtgaggaacatgaccagcgagttctttgctgcccagctgcgggcccagatcagtgatgacaccacccaccccatctcctactacaagccagagttctacaccccagatgatggcggcacagcccacctgtctgtggtggctgaagatggcagcgctgtgtctgccaccagcaccatcaacctgtacttcggcagcaaggtgcgcagccctgtgtctggcatcctcttcaacaatgagatggatgacttcagcagccccagcatcaccaatgaatttggagtgccccccagccctgccaacttcatccagcccgggaagcagcccctgagctccatgtgccccaccatcatggtgggccaggacggctag

SEQ ID NO: 153499 - DNA, 243 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcctag

SEQ ID NO: 153500 - DNA, 525 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgccaccatgttcaacagcagcgagcagagccagaagggcggcctgtctgtggccgtgcctggagagatccggggctatgagctggcccaccagagacatggccgcctgccctgggcccggctcttccagcccagcatccagctggcccggcagggcttccctgtgggcaagggcctgtag

SEQ ID NO: 153501 - DNA, 381 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgccaccatgttcaacagcagcgagcagagccagtag

SEQ ID NO: 153502 - DNA, 330 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtgtag

SEQ ID NO: 153503 - DNA, 336 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccctag

SEQ ID NO: 153504 - DNA, 114 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtag

SEQ ID NO: 153505 - DNA, 207 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgcctag

SEQ ID NO: 153506 - DNA, 381 bp, Artificial Sequence; identical to SEQ ID NO: 153501
  Description of Artificial Sequence: Synthetic coding sequence

SEQ ID NO: 153507 - DNA, 351 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgcctag

SEQ ID NO: 153508 - DNA, 384 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccaccaggaaggccgaggtgatcaatgcccgggaggtggccccccggctggcctttgccaccatgttcaacagcagcgagcagagccagaagtag

SEQ ID NO: 153509 - DNA, 297 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgctgtggccgcagatgccaagcagtgcagcaagattggaagagatgccctgagagatggcggcagcgctgtggatgctgccatcgccgccctgctgtgtgtgggcctgatgaatgcccacagcatgggcattggaggcggcctcttcctgaccatctacaacagcaccacctag

SEQ ID NO: 153510 - DNA, 93 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagctag

SEQ ID NO: 153511 - DNA, 1710 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgccatggctgctgatgccaagcagtgcctggagatcggccgggacaccctgagagatggcggcagcgctgtggatgctgccatcgccgccctgctgtgtgtgggcctgatgaatgcccacagcatgggcattggagtgggcctcttcctgaccatctacaacagcaccaccaggaaggccgaggtgatcaatgcccgggaggtggccccccggctggcctttgcctccatgttcaacagcagcgagcagagccagaagggcggcctgtctgtggccgtgcctggagagatccggggctatgagctggcccaccagagacatggccgcctgccctgggcccggctcttccagcccagcatccagctggcccggcagggcttccctgtgggcaagggcctggccgctgtgctggagaacaagaggacagtgattgagcagcagcctgtgctgtggtacgtgttctgccgggacaggaaggtgctgcgggagggggagcggctgaccctgccccggctggccgacacctatgagatgctggccatcgagggcgcccaggccttctacaacggcagcctgatggcccagatcgtgaaggacatccaggccgccggcggcatcgtgacagctgaggacctgaacaactacagagctgagctgattgagcaccccctgaacatcagcctgggagatgctgtgctgtacatgcccagcgcccggctgagcggccctgtgctggccctgatcctgaacatcctgaagggctacaacttcagccgggagagcgtggagaccccagagcagaagggcctgacctaccaccgcatcgtggaggccttccgctttgcctatgccaagaggaccctgctgggggaccccaagtttgtggatgtgacagaggtggtgaggaacatgaccagcgagttctttgctgcccagctgcggagccagatcagtgaccacaccacccaccccatctcctactacaagccagagttctacaccccagatgatggcggcacagcccacctgtctgtggtggctgaagatggcagcgctgtgtctgccaccagcaccatcaacctgtacttcggcagcaaggtgtgcagccctgtgtctggcatcctcttcaacaatgagtggaccaccagcgccctgcctgccttcaccaatgaatttggagccccacccagccctgccaacttcatccagcccgggaagcagcccctgctgtccatgtgcctgaccatcatggtgggccaggacggccaggtgaggatggtggtgggcgccgccggcggcacccagatcaccacagacacagccctggccatcatctacaacctgtggtttggctatgatgtgaagagagctgtggaggagccccggctgcacaacaagctgctgcccaacgtgaccaccgtggagagaaatattgaccaggccgtgacagctgccctggagaccaggcaccaccacacccagatcgccagcaccttcatcgctgtggtgcaggccatcgtgaggacagctgggggctgggccgccgccagtgacagcaggaagggcggggagcctgctggctactag

SEQ ID NO: 153512 - DNA, 1680 bp, Artificial Sequence
  Description of Artificial Sequence: Synthetic coding sequence
atgaagaagaagctggtggtgctgggcctgctggccgtggtgctggtgctggtgattgtgggcctgtgcctgtggctgcccagcgccagcaaggagccagacaaccacgtgtacaccagggctgccatggctgctgatgccaagcagtgcctggagatcggccgggacaccctgagagatggcggcagcgctgtggatgctgccatcgccgccctgctgtgtgtgggcctgatgaatgcccacagcatgggcattggagtgggcctcttcctgaccatctacaacagcaccaccaggaaggccgaggtgatcaatgcccgggaggtggccccccggctggcctttgcctccatgttcaacagcagcgagcagagccagaagggcggcctgtctgtggccgtgcctggagagatccggggctatgagctggcccaccagagacatggccgcctgccctgggcccggctcttccagcccagcatccagctggcccggcagggcttccctgtgggcaagggcctggccgctgtgctggagaacaagaggacagtgattgagcagcagcctgtgctgtggtacgtgttctgccgggacaggaaggtgctgcgggagggggagcggctgaccctgccccggctggccgacacctatgagatgctggccatcgagggcgcccaggccttctacaacggcagcctgatggcccagatcgtgaaggacatccaggccgccggcggcatcgtgacagctgaggacctgaacaactacagagctgagctgattgagcaccccctgaacatcagcctgggagatgctgtgctgtacatgcccagcgcccggctgagcggccctgtgctggccctgatcctgaacatcctgaagggctacaacttcagccgggagagcgtggagaccccagagcagaagggcctgacctaccaccgcatcgtggaggccttccgctttgcctatgccaagaggaccctgctgggggaccccaagtttgtggatgtgacagaggtggtgaggaacatgaccagcgagttctttgctgcccagctgcggagccagatcagtgaccacaccacccaccccatctcctactacaagccagagttctacaccccagatgatggcggcacagcccacctgtctgtggtggctgaagatggcagcgctgtgtctgccaccagcaccatcaacctgtatggcatcctcttcaacaatgagtggaccaccagcgccctgcctgccttcaccaatgaatttggagccccacccagccctgccaacttcatccagcccgggaagcagcccctgctgtccatgtgcctgaccatcatggtgggccaggacggccaggtgaggatggtggtgggcgccgccggcggcacccagatcaccacagacacagccctggccatcatctacaacctgtggtttggctatgatgtgaagagagctgtggaggagccccggctgcacaacaagctgctgcccaacgtgaccaccgtggagagaaatattgaccaggccgtgacagctgccctggagaccaggcaccaccacacccagatcgccagcaccttcatcgctgtggtgcaggccatcgtgaggacagctgggggctgggccgccgccagtgacagcaggaagggcggggagcctgctggctactag

SEQ ID NO: 153513 - DNA, 1710 bp, Artificial Sequence; identical to SEQ ID NO: 153511
  Description of Artificial Sequence: Synthetic coding sequence

SEQ ID NO: 153514 - DNA, 1665 bp, Artificial Sequence
  Description of Artificial Sequence: Synthetic coding sequence
atggcccggggctatggagccaccgtgtccctggtgctgctgggcctgggcctggccctggccgtgattgtgctggccgtggtgctgagccgccaccaggccccctgtggcccccaggcctttgcccacgccgctgtggccgctgacagcaaggtgtgcagcgacatcggccgggccatcctgcagcagcagggcagccctgtggatgccaccatcgccgccctggtgtgcacctctgtggtgaacccccagagcatgggcctgggcggcggcgtcatcttcaccatctacaacgtgaccactggagcccagtggattggagtgcctggagagctgcggggctacgccgaggcccaccggcggcacggccgcctgccctgggcccagctgttccagcccaccatcgccctgctgcggggcggccacgtggtggcccctgtgctgagccgcttcctgcacaacagcatcctgcggcccagcctgcaggccagcaccctgcggcagctgttcttcaacggcacagagcccctgcggccccaggaccccctgccctggccagccctggccaccaccctggagaccgtggccacagaaggagtggaggtgttctacacaggccgcctgggccagatgctggtggaggacatcgccaaggagggcagccagctgaccctgcaggacctggccaagttccagcctgaggtggtggatgccctggaggtgcccctgggggactacaccctgtacagccccccacctcctgctggaggagccatcctgtccttcatcctgaatgtgctgcggggcttcaacttcagcacagagagcatggcccggcctgagggccgggtgaatgtgtaccaccacctggtggagaccctgaagtttgccaagggccagcgctggaggctgggggaccccaggagccaccccaagctgcagaatgccagccgggacctgctgggggagaccctggcccagctgatccggcagcagattgatggccgcggggaccaccagctgagccactacagcctggccgaggcctggggccacggcaccggcaccagccacgtgtctgtgctgggggaggatggcagcgctgtggccgccaccagcaccatcaacaccccatttggagccatggtgtacagccccaggacaggcatcatcctgaacaatgagctgctggacctgtgtgagcgctgcccccggggcagcggcaccacccccagccctgtgtctggggacagagtgggcggggcccctggccgctgctggccccctgtgcctggagagaggagccccagctccatggtgcccagcatcctgatcaacaaggcccagggcagcaagctggtgattggaggagctggaggagagctgatcatctctgctgtggcccaggccatcatgagcaagctgtggctgggctttgacctgcgggccgccatcgccgcccccatcctgcacgtgaacagcaagggctgtgtggagtatgagcccaacttcagccaggaggtgcagaggggcctgcaggaccggggccagaaccagacccagaggcccttcttcctgaatgtggtgcaggccgtgtcccaggagggcgcctgtgtgtatgctgtgtctgacctgaggaagagcggggaggccgccggctactag

SEQ ID NO: 153515 - DNA, 1761 bp, Artificial Sequence
  Description of Artificial Sequence: Synthetic coding sequence
atggcccggggctatggagccaccgtgtccctggtgctgctgggcctgggcctggccctggccgtgattgtgctggccgtggtgctgagccgccaccaggccccctgtggcccccaggcctttgcccacgccgctgtggccgctgacagcaaggtgtgcagcgacatcggccgggccatcctgcagcagcagggcagccctgtggatgccaccatcgccgccctggtgtgcacctctgtggtgaacccccagagcatgggcctgggcggcggcgtcatcttcaccatctacaacgtgaccaccgggaaggtggaggtgatcaatgcccgggagaccgtgcctgccagccacgcccccagcctgctggaccagtgtgcccaggccctgcccctgggcactggagcccagtggattggagtgcctggagagctgcggggctacgccgaggcccaccggcggcacggccgcctgccctgggcccagctgttccagcccaccatcgccctgctgcggggcggccacgtggtggcccctgtgctgagccgcttcctgcacaacagcatcctgcggcccagcctgcaggccagcaccctgcggcagctgttcttcaacggcacagagcccctgcggccccaggaccccctgccctggccagccctggccaccaccctggagaccgtggccacagaaggagtggaggtgttctacacaggccgcctgggccagatgctggtggaggacatcgccaaggagggcagccagctgaccctgcaggacctggccaagttccagcctgaggtggtggatgccctggaggtgcccctgggggactacaccctgtacagccccccacctcctgctggaggagccatcctgtccttcatcctgaatgtgctgcggggcttcaacttcagcacagagagcatggcccggcctgagggccgggtgaatgtgtaccaccacctggtggagaccctgaagtttgccaagggccagcgctggaggctgggggaccccaggagccaccccaagctgcagaatgccagccgggacctgctgggggagaccctggcccagctgatccggcagcagattgatggccgcggggaccaccagctgagccactacagcctggccgaggcctggggccacggcaccggcaccagccacgtgtctgtgctgggggaggatggcagcgctgtggccgccaccagcaccatcaacaccccatttggagccatggtgtacagccccaggacaggcatcatcctgaacaatgagctgctggacctgtgtgagcgctgcccccggggcagcggcaccacccccagccctgtgtctggggacagagtgggcggggcccctggccgctgctggccccctgtgcctggagagaggagccccagctccatggtgcccagcatcctgatcaacaaggcccagggcagcaagctggtgattggaggagctggaggagagctgatcatctctgctgtggcccaggccatcatgagcaagctgtggctgggctttgacctgcgggccgccatcgccgcccccatcctgcacgtgaacagcaagggctgtgtggagtatgagcccaacttcagccaggaggtgcagaggggcctgcaggaccggggccagaaccagacccagaggcccttcttcctgaatgtggtgcaggccgtgtcccaggagggcgcctgtgtgtatgctgtgtctgacctgaggaagagcggggaggccgccggctactag

SEQ ID NO: 153516 - DNA, 1764 bp, Artificial Sequence
  Description of Artificial Sequence: Synthetic coding sequence
atggcccggggctatggagccaccgtgtccctggtgctgctgggcctgggcctggccctggccgtgattgtgctggccgtggtgctgagccgccaccaggccccctgtggcccccaggcctttgcccacgccgctgtggccgctgacagcaaggtgtgcagcgacatcggccgggccatcctgcagcagcagggcagccctgtggatgccaccatcgccgccctggtgtgcacctctgtggtgaacccccagagcatgggcctgggcggcggcgtcatcttcaccatctacaacgtgaccaccgggaaggtggaggtgatcaatgcccgggagaccgtgcctgccagccacgcccccagcctgctggaccagtgtgcccaggccctgcccctgggcactggagcccagtggattggagtgcctggagagctgcggggctacgccgaggcccaccggcggcacggccgcctgccctgggcccagctgttccagcccaccatcgccctgctgcggggcggccacgtggtggcccctgtgctgagccgcttcctgcacaacagcatcctgcggcccagcctgcaggccagcaccctgcggcagctgttcttcaacggcacagagcccctgcggccccaggaccccctgccctggccagccctggccaccaccctggagaccgtggccacagaaggagtggaggtgttctacacaggccgcctgggccagatgctggtggaggacatcgccaaggagggcagccagctgaccctgcaggacctggccaagttccagcctgaggtggtggatgccctggaggtgcccctgggggactacaccctgtacagccccccacctcctgctggaggagccatcctgtccttcatcctgaatgtgctgcggggcttcaacttcagcacagagagcatggcccggcctgagggccgggtgaatgtgtaccaccacctggtggagaccctgaagtttgccaagggccagcgctggaggctgggggaccccaggagccaccccaagctgcagaatgccagccgggacctgctgggggagaccctggcccagctgatccggcagcagattgatggccgcggggaccaccagctgagccactacagcctggccgaggcctggggccacggcaccggcaccagccacgtgtctgtgctgggggaggatggcagcgctgtggccgccaccagcaccatcaacaccccatttggagccatggtgtacagccccaggacaggcatcatcctgaacaatgagctgctggacctgtgtgagcgctgcccccggggcagcggcaccacccccagccctgctgtgtctggggacagagtgggcggggcccctggccgctgctggccccctgtgcctggagagaggagccccagctccatggtgcccagcatcctgatcaacaaggcccagggcagcaagctggtgattggaggagctggaggagagctgatcatctctgctgtggcccaggccatcatgagcaagctgtggctgggctttgacctgcgggccgccatcgccgcccccatcctgcacgtgaacagcaagggctgtgtggagtatgagcccaacttcagccaggaggtgcagaggggcctgcaggaccggggccagaaccagacccagaggcccttcttcctgaatgtggtgcaggccgtgtcccaggagggcgcctgtgtgtatgctgtgtctgacctgaggaagtctggagaggccgccggctactag

SEQ ID NO: 153517 - DNA, 1533 bp, Artificial Sequence
  Description of Artificial Sequence: Synthetic coding sequence
atggcccggggctatggagccaccgtgtccctggtgctgctgggcctgggcctggccctggccgtgattgtgctggccgtggtgctgagccgccaccaggccccctgtggcccccaggcctttgcccacgccgctgtggccgctgacagcaaggtgtgcagcgacatcggccggggccctgtggacagaggagcccggggggccccctggctgtgccggggccccccaccaccctggcccccagccctgggcgctgctgtgcctgcccaccacagagctgcccccaggggggcctgtggcggcccctgcccccagcccttccctgcccagcagcaccctgctgccttcctggccggcgtgaacccagccctcttcttcaatggaacagagcccctgcggccccaggaccccctgccctggccagccctggccaccaccctggagaccgtggccacagagggcgtggaggtgttctacacaggccgcctgggccagatgctggtggaggacatcgccaaggagggcagccagctgaccctgcaggacctggccaagttccagcctgaggtggtggatgccctggaggtgcccctgggggactacaccctgtacagccccccacctcctgctgggggcgccatcctgtccttcatcctgaatgtgctgcggggcttcaacttcagcacagagagcatggcccggcctgagggccgggtgaatgtgtaccaccacctggtggagaccctgaagtttgccaagggccagcgctggaggctgggggaccccaggagccaccccaagctgcagaatgccagccgggacctgctgggggagaccctggcccagctgatccggcagcagattgatggccgcggggaccaccagctgagccactacagcctggccgaggcctggggccatggaacaggcaccagccacgtgtctgtgctgggagaagatggcagcgctgtggccgccaccagcaccatcaacaccccatttggagccatggtgtacagccccaggacaggcatcatcctgaacaatgagctgctggacctgtgtgagcgctgcccccggggcagcggcaccacccccagccctgctgtgtctggggacagagtgggcggggcccctggccgctgctggccccctgtgcctggagagaggagccccagctccatggtgcccagcatcctgatcaacaaggcccagggcagcaagctggtgattggaggagctggaggagagctgatcatctctgctgtggcccaggccatcatgagcaagctgtggctgggctttgacctgcgggccgccatcgccgcccccatcctgcacgtgaacagcaagggctgtgtggagtatgagcccaacttcagccaggaggtgcagaggggcctgcaggaccggggccagaaccagacccagaggcccttcttcctgaatgtggtgcaggccgtgtcccaggagggcgcctgtgtgtatgctgtgtctgacctgaggaagagcggggaggccgccggctactag

SEQ ID NO: 153518 - DNA, 1506 bp, Artificial Sequence
  Description of Artificial Sequence: Synthetic coding sequence
atgggcctgggcggcggcgtcatcttcaccatctacaacgtgaccaccgggaaggtggaggtgatcaatgcccgggagaccgtgcctgccagccacgcccccagcctgctggaccagtgtgcccaggccctgcccctgggcaccggggcccagtggattggagtgcctggagagctgcggggctatgcagaggcccacagaagacatggccgcctgccctgggcccagctgttccagcccaccatcgccctgctgcggggcggccacgtggtggcccctgtgctgagccgcttcctgcacaacagcatcctgcggcccagcctgcaggccagcaccctgcggcagctgttcttcaatggaacagagcccctgcggccccaggaccccctgccctggccagccctggccaccaccctggagaccgtggccacagagggcgtggaggtgttctacacaggccgcctgggccagatgctggtggaggacatcgccaaggagggcagccagctgaccctgcaggacctggccaagttccagcctgaggtggtggatgccctggaggtgcccctgggggactacaccctgtacagccccccacctcctgctgggggcgccatcctgtccttcatcctgaatgtgctgcggggcttcaacttcagcacagagagcatggcccggcctgagggccgggtgaatgtgtaccaccacctggtggagaccctgaagtttgccaagggccagcgctggaggctgggggaccccaggagccaccccaagctgcagaatgccagccgggacctgctgggggagaccctggcccagctgatccggcagcagattgatggccgcggggaccaccagctgagccactacagcctggccgaggcctggggccatggaacaggcaccagccacgtgtctgtgctgggagaagatggcagcgctgtggccgccaccagcaccatcaacaccccatttggagccatggtgtacagccccaggacaggcatcatcctgaacaatgagctgctggacctgtgtgagcgctgcccccggggcagcggcaccacccccagccctgtgtctggggacagagtgggcggggcccctggccgctgctggccccctgtgcctggagagaggagccccagctccatggtgcccagcatcctgatcaacaaggcccagggcagcaagctggtgattggaggagctggaggagagctgatcatctctgctgtggcccaggccatcatgagcaagctgtggctgggctttgacctgcgggccgccatcgccgcccccatcctgcacgtgaacagcaagggctgtgtggagtatgagcccaacttcagccaggaggtgcagaggggcctgcaggaccggggccagaaccagacccagaggcccttcttcctgaatgtggtgcaggccgtgtcccaggagggcgcctgtgtgtatgctgtgtctgacctgaggaagtctggagaggccgccggctactag

SEQ ID NO: 153519 - DNA, 1386 bp, Artificial Sequence
  Description of Artificial Sequence: Synthetic coding sequence
atggagcgggcagaggagcctgtggtgtaccagaagctgctgccctgggagcccagcctggagagcgaggaggaggtggaggaggaggagaccagcgaggccctggtgctgaacccccggcggcaccaggacagcagcaggaacaaggccggcggcctgcccggcacctgggcccgggtggtggccgccctgctgctgctggccgtgggctgcagcctggccgtgcggcagctgcagaaccagggccgcagcacaggcagcctgggctctgtggcccctcctcctgggggccacagccacggccctggggtgtaccaccacggggccatcatcagccctgctggggccatgttctggggcctcttccatgacagcagcagcggcaacagcacagccctgaccagcggccctgcccagaccctggcccctggcctgggcctgcctgctgccctgcccaccctgcacctgctgcacgccaggtttggccgcctgccctggccccggctgctggtgggccccaccaccctggcccaggagggcttcctggtggacacccccctggcccgggccctggtggcccggggcacagagggcctgtgccccctgctgtgccacgcagatggcacccccctgggcgctggggcccgggccaccaacccccagctggccgctgtgctgcggtctgctgccctggcccccaccagtgacctggccggagatgccctgctgagcctgctggccggggacctgggcgtggaggtgcccagcgctgtgccccggcccaccctggagcctgctgagcagctgcctgtgccccagggcatcctcttcaccacccccagccccagcgctggccctgagctgctggccctgctggaggccgccctgcggagcggggcccccatcccagacccctgcccccccttcctgcagacagctgtgtccccagagagcagcgccctggccgctgtggacagcagcggctctgtgctgctgctgaccagcagcctgaactgcagctttggaagtgcccacctgagccccagcactggagtgctgctgagcaacctggtggccaagagcaccaccagcgcctgggcctgccccctcatcctgcggggcagcctggatgacacagaagcagatgtgctgggcctggtggccagcggcaccccagatgtggcccgggccatgacccacaccctgctgcggcacctggccgcccggccccccacccaggcccagcaccagcaccagggccagcaggagcccacagagcaccccagcacctgtggccagggcaccctgctgcaggtggccgcccacacagaacatgcccacgtgtcctctgtgccccacgcctgctgccccttccagggcttctag

SEQ ID NO: 153520 - DNA, 1482 bp, Artificial Sequence
  Description of Artificial Sequence: Synthetic coding sequence
atggagcgggcagaggagcctgtggtgtaccagaagctgctgccctgggagcccagcctggagagcgaggaggaggtggaggaggaggagaccagcgaggccctggtgctgaacccccggcggcaccaggacagcagcaggaacaaggccggcggcctgcccggcacctgggcccgggtggtggccgccctgctgctgctggccgtgggctgcagcctggccgtgcggcagctgcagaaccagggccgcagcacaggcagcctgggctctgtggcccctcctcctgggggccacagccacggccctggggtgtaccaccacggggccatcatcagccctgctggccgggagctgctggtggccggcggcaatgtggtggatgctggggtgggcgccgccctgtgcctggccgtggtgcacccccacgccaccggcctgggcgccatgttctggggcctcttccatgacagcagcagcggcaacagcacagccctgaccagcggccctgcccagaccctggcccctggcctgggcctgcctgctgccctgcccaccctgcacctgctgcacgccaggtttggccgcctgccctggccccggctgctggtgggccccaccaccctggcccaggagggcttcctggtggacacccccctggcccgggccctggtggcccggggcacagagggcctgtgccccctgctgtgccacgcagatggcacccccctgggcgctggggcccgggccaccaacccccagctggccgctgtgctgcggtctgctgccctggcccccaccagtgacctggccggagatgccctgctgagcctgctggccggggacctgggcgtggaggtgcccagcgctgtgccccggcccaccctggagcctgctgagcagctgcctgtgccccagggcatcctcttcaccacccccagccccagcgctggccctgagctgctggccctgctggaggccgccctgcggagcggggcccccatcccagacccctgcccccccttcctgcagacagctgtgtccccagagagcagcgccctggccgctgtggacagcagcggctctgtgctgctgctgaccagcagcctgaactgcagctttggaagtgcccacctgagccccagcactggagtgctgctgagcaacctggtggccaagagcaccaccagcgcctgggcctgccccctcatcctgcggggcagcctggatgacacagaagcagatgtgctgggcctggtggccagcggcaccccagatgtggcccgggccatgacccacaccctgctgcggcacctggccgcccggccccccacccaggcccagcaccagcaccagggccagcaggagcccacagagcaccccagcacctgtggccagggcaccctgctgcaggtggccgcccacacagaacatgcccacgtgtcctctgtgccccacgcctgctgccccttccagggcttctag

SEQ ID NO: 153521 - DNA, 1038 bp, Artificial Sequence
  Description of Artificial Sequence: Synthetic coding sequence
atgttctggggcctcttccatgacagcagcagcggcaacagcacagccctgaccagcggccctgcccagaccctggcccctggcctgggcctgcctgctgccctgcccaccctgcacctgctgcacgccaggtttggccgcctgccctggccccggctgctggtgggccccaccaccctggcccaggagggcttcctggtggacacccccctggcccgggccctggtggcccggggcacagagggcctgtgccccctgctgtgccacgcagatggcacccccctgggcgctggggcccgggccaccaacccccagctggccgctgtgctgcggtctgctgccctggcccccaccagtgacctggccggagatgccctgctgagcctgctggccggggacctgggcgtggaggtgcccagcgctgtgccccggcccaccctggagcctgctgagcagctgcctgtgccccagggcatcctcttcaccacccccagccccagcgctggccctgagctgctggccctgctggaggccgccctgcggagcggggcccccatcccagacccctgcccccccttcctgcagacagctgtgtccccagagagcagcgccctggccgctgtggacagcagcggctctgtgctgctgctgaccagcagcctgaactgcagctttggaagtgcccacctgagccccagcactggagtgctgctgagcaacctggtggccaagagcaccaccagcgcctgggcctgccccctcatcctgcggggcagcctggatgacacagaagcagatgtgctgggcctggtggccagcggcaccccagatgtggcccgggccatgacccacaccctgctgcggcacctggccgcccggccccccacccaggcccagcaccagcaccagggccagcaggagcccacagagcaccccagcacctgtggccagggcaccctgctgcaggtggccgcccacacagaacatgcccacgtgtcctctgtgccccacgcctgctgccccttccagggcttctag

SEQ ID NO: 153522 - DNA, 1482 bp, Artificial Sequence; identical to SEQ ID NO: 153520
  Description of Artificial Sequence: Synthetic coding sequence

SEQ ID NO: 153523 - DNA, 678 bp, Artificial Sequence
  Description of Artificial Sequence: Synthetic coding sequence
atgaccagcgagttcttcagcgcccagctgcgggcccagatcagtgatgacaccacccaccccatctcctactacaagccagagttctacatgccagatgatggcggcacagcccacctgtctgtggtggctgaagatggcagcgctgtgtctgccaccagcaccatcaacctgtacttcggcagcaaggtgcgcagccctgtgtctggcatcctgctgaacaatgagatggatgacttcagcagcaccagcatcaccaatgaatttggagtgccccccagccctgccaacttcatccagcccgggaagcagcccctgagctccatgtgccccaccatcatggtgggccaggacggccaggtgaggatggtggtgggcgccgccggcggcacccagatcaccatggccacagccctggccatcatctacaacctgtggtttggctatgatgtgaagtgggccgtggaggagccccggctgcacaaccagctgctgcccaacgtgaccaccgtggagagaaatattgaccaggaggtgacagctgccctggagaccaggcaccaccacacccagatcaccagcaccttcatcgctgtggtgcaggccatcgtgaggatggccggcggctgggccgccgccagtgacagcaggaagggcggggagcctgctggctactag

SEQ ID NO: 153524 - DNA, 678 bp, Artificial Sequence; identical to SEQ ID NO: 153523
  Description of Artificial Sequence: Synthetic coding sequence

SEQ ID NO: 153525 - DNA, 678 bp, Artificial Sequence; identical to SEQ ID NO: 153523
  Description of Artificial Sequence: Synthetic coding sequence

SEQ ID NO: 153526 - DNA, 678 bp, Artificial Sequence
  Description of Artificial Sequence: Synthetic coding sequence
atgaccagcgagttctttgctgcccagctgcgggcccagatcagtgatgacaccacccaccccatctcctactacaagccagagttctacacccctgtggatggcggcacagcccacctgtctgtggtggctgaagatggcagcgctgtgtctgccaccagcaccatcaacctgtacttcggcagcaaggtgcgcagccctgtgtctgagatcctcttcaatgatgagatggatgacttcagcagccccaacatcaccaatgaatttggagtgccccccagccctgccaacttcatccagcccgggaagcagcccctgagctccatgtgccccaccatcatggtgggccaggacggccaggtgaggatggtggtgggcgccgccggcggcacccagatcaccacagccacagccctggccatcatctacaacctgtggtttggctatgatgtgaagagagctgtggaggagccccggctgcacaaccagctgctgcccaacgtgaccaccgtggagagaaatattgaccaggccgtgacagctgccctggagaccaggcaccaccacacccagatcgccagcaccttcatcgctgtggtgcaggccatcgtgaggacagctgggggctgggccgccgccagtgacagcaggaagggcggggagcctgctggctactag

SEQ ID NO: 153527 - DNA, 657 bp, Artificial Sequence
  Description of Artificial Sequence: Synthetic coding sequence
atgaccagcgagttctttgctgcccagctgcgggcccagatcagtgatgacaccacccaccccatctcctactacaagccagagttctacacccctgtggatggcggcacagcccacctgtctgtggtggctgaagatggcagcgctgtgtctgccaccagcaccatcaacctgtacttcggcagcaaggtgcgcagccctgtgtctgagatcctcttcaatgatgagatggatgacttcagcagccccaacatcaccaatgaatttggagtgccccccagccctgccaacttcatccagcccgggaagcagcccctgagctccatgtgccccaccatcatggtgggccaggacggccagccccccagccatgctgaccacacccccatgccccaggccatcatctacaacctgtggtttggctatgatgtgaagagagctgtggaggagccccggctgcacaaccagctgctgcccaacgtgaccaccgtggagaggaacatcgaccaggccgtgacagctgccctggagaccaggcaccaccacacccagatcgccagcaccttcatcgctgtggtgcaggccatcgtgaggacagctgggggctgggccgccgccagtgacagcaggaaaggaggagagcccgccggctactag

SEQ ID NO: 153528 - DNA, 678 bp, Artificial Sequence
  Description of Artificial Sequence: Synthetic coding sequence
atgaccagcgagttctttgctgcccagctgcggagccagatcagtgaccacaccacccaccccatctcctactacaagccagagttctacaccccagatgatggcggcacagcccacctgtctgtggtggctgaagatggcagcgctgtgtctgccaccagcaccatcaacctgtacttcggcagcaaggtgtgcagccctgtgtctggcatcctcttcaacaatgagtggaccaccagcgccctgcctgccttcaccaatgaatttggagccccacccagccctgccaacttcatccagcccgggaagcagcccctgctgtccatgtgccccaccatcatggtgggccaggacggccaggtgaggatggtggtgggcgccgccggcggcacccagatcaccacagacacagccctggccatcatctacaacctgtggtttggctatgatgtgaagagagctgtggaggagccccggctgcacaacaagctgctgcccaacgtgaccaccgtggagagaaatattgaccaggccgtgacagctgccctggagaccaggcaccaccacacccagatcgccagcaccttcatcgctgtggtgcaggccatcgtgaggacagctgggggctgggccgccgccagtgacagcaggaagggcggggagcctgctggctactag

SEQ ID NO: 153529 - DNA, 711 bp, Artificial Sequence
  Description of Artificial Sequence: Synthetic coding sequence
ccagccctgggcagccagcaggtggtgaggaacatgaccagcgagttctttgctgcccagctgcggagccagatcagtgaccacaccacccaccccatctcctactacaagccagagttctacaccccagatgatggcggcacagcccacctgtctgtggtggccgaggatggcagcgctgtgtctgccaccagcaccatcaacctgtacttcggcagcaaggtgtgcagccctgtgtctggcatcctcttcaacaatgagtggaccaccagcgccctgcctgccttcaccaatgaatttggagccccacccagccctgccaacttcatccagcccgggaagcagcccctgctgtccatgtgccccaccatcatggtgggccaggacggccaggtgaggatggtggtgggcgctgctgggggcacccagatcaccacagacacagccctggccatcatctacaacctgtggtttggctatgatgtgaagagagctgtggaggagccccggctgcacaacaagctgctgcccaacgtgaccaccgtggagaggaacatcgaccaggccgtgacagctgccctggagaccaggcaccaccacacccagatcgccagcaccttcatcgctgtggtgcaggccatcgtgaggacagctgggggctgggccgccgccagtgacagcaggaaaggaggagagcccgccggctactag

SEQ ID NO: 153530 - DNA, 675 bp, Artificial Sequence
  Description of Artificial Sequence: Synthetic coding sequence
atggtggccgctgtgctgctgggcctgtcctggctgtgcagccccctgggcgccctggtgctggacttcaacaacatccgcagcagcgctgacctgcatggagccaggaagggcagccagtgcctgagtgacacagactgcaacaccaggaagttctgcctgcagcccagagatgagaagcccttctgtgccacctgccggggcctgcggcggcgctgccagagagatgccatgtgctgccccggcaccctgtgtgtgaatgatgtgtgcaccaccatggaggatgccacccccatcctggagcggcagctggatgagcaggacggcacccacgccgagggcaccaccggccaccctgtgcaggagaaccagcccaagaggaagcccagcatcaagaagagccagggcaggaagggccaggagggggagagctgcctgcggacctttgactgtggccctggcctgtgctgtgcccggcacttctggaccaagatctgcaagcctgtgctgctggagggccaggtgtgcagccggcggggccacaaggacacagcccaggcccctgagatcttccagagatgtgactgtggccctggcctgctgtgccgcagccagctgaccagcaaccggcagcacgcccggctgcgggtgtgccagaagattgagaagctgtag

SEQ ID NO: 153531 - DNA, 873 bp, Artificial Sequence
  Description of Artificial Sequence: Synthetic coding sequence
atgaggctgaacagcactggagaggtgcctgtgctgatccacggggagaacatcatctgtgaggccacccagatcatcgactacctggagcagaccttcctggatgagaggaccccccggctgatgccagacaaggagagcatgtactacccccgggtgcagcactaccgggagctgctggacagcctgcccatggatgcctacacccacggctgcatcctgcaccctgagctgactgtggacagcatgatcccagcctatgccaccacccgcatccgcagccagatcggcaacacagaaagtgagctgaagaagctggccgaggagaacccagacctgcaggaggcctacatcgccaagcagaagaggctgaagagcaagctgctggaccatgacaacgtgaagtacctgaagaagatcctggatgagctggagaaggtgctggaccaggtggagacagagctgcagaggagaaatgaggagaccccagaggagggccagcagccctggctgtgtggggagagcttcaccctggctgatgtgtccctggccgtgaccctgcaccggctgaagttcctgggctttgcccggaggaactggggcaatggcaagaggcccaacctggagacctactatgaaagagtgctgaagaggaagaccttcaacaaggtgctgggccacgtgaacaacatcctgatctctgctgtgctgcccacagccttccgggtggccaagaagagggcccccaaggtgctgggcaccaccctggtggtgggcctgctggccggcgtgggctactttgccttcatgctgttcaggaagaggctgggctccatgatcctggccttccggccccggcccaactacttctag

SEQ ID NO: 153532 - DNA, 1632 bp, Artificial Sequence
  Description of Artificial Sequence: Synthetic coding sequence
atgggagactggaacctgctgggcggcatcctggaggaggtgcacagccacagcaccatcgtgggcaagatctggctgaccatcctcttcatcttcaggatgctggtgctgcgggtggccgcagaagatgtgtgggatgatgagcagagcgcctttgcctgcaacacccggcagcccggctgcaacaacatctgctatgatgatgccttccccatcagcctcatccgcttctgggtgctgcagatcatctttgtgagcagccccagcctggtgtacatgggccacgccctgtaccgcctgcgggcctttgagaaggaccggcagaggaagaagagccacctgcgggcccagatggagaacccagacctggacctggaggagcagcagagaattgaccgggagctgcggcggctggaggagcagaagaggatccacaaggtgcccctgaagggctgcctgctgcggacctacgtgctgcacatcctgaccaggtctgtgctggaggtgggcttcatgattggccagtacatcctgtatggcttccagatgcaccccctgtacaagtgcacccagcccccctgccccaatgctgtggactgctttgtgtcccggcccacagagaagaccatcttcatgctgttcatgcacagcattgctgccatcagcctgctgctgaacatcctggagatcttccacctgggcatcaggaagatcatgaggaccctgtacaagaagagcagcagcgagggcattgaagatgaaacaggcccccccttccacctgaagaagtacagcgtggcccagcagtgcatgatctgcagcagcctgcctgagcgcatcagccccctgcaggccaacaaccagcagcaggtgatccgggtgaatgtgcccaagagcaagaccatgtggcagatcccccagccccggcagctggaggtggaccccagcaatggcaagaaggactggagcgagaaggaccagcacagcggccagctgcacgtgcacagcccctgcccctgggccggcagcgctggcaaccagcacctgggccagcagagcgaccacagcagctttggcctgcagaacaccatgagccagagctggctgggcaccaccacagcccccaggaactgccccagctttgctgtgggcacctgggagcagagccaggaccctgagcccagcggggagcccctgacagacctgcacagccactgccgggacagcgagggctccatgagggagagcggcgtgtggattgacaggagcaggcctggcagcaggaaggccagcttcctgagccggctgctgtctgagaagaggcacctgcacagcgacagcggcagcagcggcagcaggaacagcagctgcctggacttcccccactgggagaacagccccagccccctgcccagcgtgacaggccacaggacctccatggtgcggcaggccgccctgcccatcatggagctgagccaggagctgttccacagcggctgcttcctgttccccttcttcctgcccggggtgtgcatgtatgtgtgtgtggaccgggaggctgatggcggcggggactacctgtggagggacaagatcatccacagcatccacagcgtgaagttcaacagctag

SEQ ID NO: 153533 - DNA, 1308 bp, Artificial Sequence
  Description of Artificial Sequence: Synthetic coding sequence
atgggagactggagcttcctgggccgcctgctggagaatgcccaggagcacagcacagtgattggcaaggtgtggctgactgtgctcttcatcttccgcatcctggtgctgggcgctgctgctgaagatgtgtggggagatgagcagagcgacttcacctgcaacacccagcagcccggctgtgaaaatgtgtgctatgaccgggccttccccatcagccacatccgcttctgggccctgcagatcatctttgtgtccacccccaccctcatctacctgggccacgtgctgcacatcgtgaggatggaggagaagaagaaggagcgggaggaggaggagcagctgaagcgggagagccccagccccaaggagcccccccaggacaaccccagcagcagagatgaccggggccgggtgaggatggccggggccctgctgcggacctacgtgttcaacatcatcttcaagaccctgtttgaggtgggcttcatcgccggccagtacttcctgtatggctttgagctgaagcccctgtaccgctgtgaccgctggccctgccccaacacagtggactgcttcatcagccggcccacagagaagaccatcttcatcatcttcatgctggccgtggcctgtgccagcctgctgctgaacatgctggagatctaccacctgggctggaagaagctgaagcagggcgtgaccagccggctgggcccagatgccagcgaggcccccctgggcacagctgaccccccacccctgccccccagcagcaggcctcctgctgtggccatcggcttccccccctactatgcccacacagctgcccccctgggccaggcccgggctgtgggctacccaggggcccctcctcctgctgctgacttcaagctgctggccctgacagaggcccggggcaagggccagagcgccaagctgtacaacggccaccaccacctgctgatgacagagcagaactgggccaaccaggccgctgagcggcagcccccagccctgaaggcctacccagctgccagcaccccagctgcccccagccctgtgggcagcagcagcccccccctggcccacgaggccgaggccggggccgcccccctgctgctggatggcagcggcagcagcctggagggcagcgccctggccggcaccccagaggaggaggagcaggccgtgaccacagctgcccagatgcaccagccccccctgcccctgggggaccccggccgggccagcaaggccagccgggccagcagcggccgggcccggcctgaggacctggccatctag

SEQ ID NO: 153534 - DNA, 1002 bp, Artificial Sequence
  Description of Artificial Sequence: Synthetic coding sequence
atgggagactggggcttcctggagaagctgctggaccaggtgcaggagcacagcacagtggtgggcaagatctggctgactgtgctcttcatcttccgcatcctgatcctgggcctggccggggagagcgtgtggggagatgagcagagcgactttgagtgcaacacagcccagcccggctgcaccaacgtgtgctatgaccaggccttccccatcagccacatccgctactgggtgctgcagttcctgtttgtgtccacccccaccctggtgtacctgggccacgtgatctacctgagcagaagagaggagcggctgcggcagaaggagggggagctgcgggccctgcctgccaaggacccccaggtggagcgggccctggccgctgtggagcggcagatggccaagatctctgtggctgaagatggccgcctgcgcatccggggggccctgatgggcacctacgtggcctctgtgctgtgcaagtctgtgctggaggccggcttcctgtatggccagtggaggctgtatggctggaccatggagcctgtgtttgtgtgccagagggccccctgcccctacctggtggactgctttgtgtcccggcccacagagaagaccatcttcatcatcttcatgctggtggtgggcctcatcagcctggtgctgaacctgctggagctggtgcacctgctgtgccgctgcctgagccggggcatgagggcccggcagggccaggatgccccacccacccagggcaccagcagtgacccctacacagaccaggtgttcttctacctgcctgtgggccagggccccagcagccccccctgccccacctacaacggcctgagcagcagcgagcagaactgggccaacctgaccacagaggagcggctggccagcagcaggcctcctctcttcctggaccccccaccccagaatggccagaagccacccagccggcccagcagcagcgccagcaagaagcagtatgtgtag

SEQ ID NO: 153535 - DNA, 879 bp, Artificial Sequence
  Description of Artificial Sequence: Synthetic coding sequence
atgggagactggggcttcctggagaagctgctggaccaggtgcaggagcacagcacagtggtgggcaagatctggctgactgtgctcttcatcttccgcatcctgatcctgggcctggccggggagagcgtgtggggagatgagcagagcgactttgagtgcaacacagcccagcccggctgcaccaacgtgtgctatgaccaggccttccccatcagccacatccgctactgggtgctgcagttcctgtttgtgtccacccccaccctggtgtacctgggccacgtgatctacctgagcagaagagaggagcggctgcggcagaaggagggggagctgcgggccctgcctgccaaggacccccaggtggagcgggccctggccgctgtggagcggcagatggccaagatctctgtggctgaagatggccgcctgcgcatccggggggccctgatgggcacctacgtggcctctgtgctgtgcaagtctgtgctggaggccggcttcctgtatggccagtggaggctgtatggctggaccatggagcctgtgtttgtgtgccagagggccccctgcccctacctggtggactgctttgtgtcccggcccacagagaagaccatcttcatcatcttcatgctggtggtgggcctcatcagcctggtgctgaacctgctggagctggtgcacctgctgtgccgctgcctgagccggggcatgagggcccggcagggccaggatgccccacccacccagggcaccagcagtgacccctacacagaccaggtgttcttctacctgcctgtgggccagggccccagcagccccccctgccccacctacaacggcctgagcagcagcgagcagaactgggcctag

SEQ ID NO: 153536 - DNA, 882 bp, Artificial Sequence
  Description of Artificial Sequence: Synthetic coding sequence
atgggagactggggcttcctggagaagctgctggaccaggtgcaggagcacagcacagtggtgggcaagatctggctgactgtgctcttcatcttccgcatcctgatcctgggcctggccggggagagcgtgtggggagatgagcagagcgactttgagtgcaacacagcccagcccggctgcaccaacgtgtgctatgaccaggccttccccatcagccacatccgctactgggtgctgcagttcctgtttgtgtccacccccaccctggtgtacctgggccacgtgatctacctgagcagaagagaggagcggctgcggcagaaggagggggagctgcgggccctgcctgccaaggacccccaggtggagcgggccctggccgctgtggagcggcagatggccaagatctctgtggctgaagatggccgcctgcgcatccggggggccctgatgggcacctacgtggcctctgtgctgtgcaagtctgtgctggaggccggcttcctgtatggccagtggaggctgtatggctggaccatggagcctgtgtttgtgtgccagagggccccctgcccctacctggtggactgctttgtgtcccggcccacagagaagaccatcttcatcatcttcatgctggtggtgggcctcatcagcctggtgctgaacctgctggagctggtgcacctgctgtgccgctgcctgagccggggcatgagggcccggcagggccaggatgccccacccacccagggcaccccccagaccctgaccaggaccaggagcagcagcaccagcccctgggcccggggcccccacccccaccacgccccacccaccatgggcagccaccctgtgtccaggacaggccccacctag

SEQ ID NO: 153537 - DNA, 1077 bp, Artificial Sequence
  Description of Artificial Sequence: Synthetic coding sequence
atgggagactggagcttcctgggcaacttcctggaggaggtgcacaagcacagcacagtggtgggcaaggtgtggctgactgtgctcttcatcttcaggatgctggtgctgggcacagctgctgagagctcctggggagatgagcaggccgacttccgctgtgacaccatccagcccggctgccagaatgtgtgctatgaccaggccttccccatcagccacatccgctactgggtgctgcagatcatctttgtgtccacccccagcctggtgtacatgggccacgccatgcacacagtgaggatgcaggagaagaggaagctgcgggaggccgagcgggccaaggaggtgcggggcagcggcagctatgagtaccctgtggccgagaaggccgagctgagctgctgggaggagggcaatggaagaattgccctgcagggcaccctgctgaacacctacgtgtgcagcatcctgatccgcaccaccatggaggtgggcttcatcgtgggccagtacttcatctacggcatcttcctgaccaccctgcacgtgtgccgccgcagcccctgcccccaccctgtgaactgctacgtgtcccggcccacagagaagaatgtgttcatcgtgttcatgctggccgtggccgccctgagcctgctgctgagcctggccgagctgtaccacctgggctggaagaagatccggcagagatttgtgaagccccggcagcacatggccaagtgccagctgagcggccccagcgtgggcatcgtgcagagctgcaccccacctccagacttcaaccagtgcctggagaatggacctgggggcaagttcttcaaccccttcagcaacaacatggccagccagcagaacacagacaacctggtgacagagcaggtgcggggccaggagcagaccccaggagagggcttcatccaggtgcgctatggccagaagccagaggtgcccaatggagtgtccccaggccaccggctgccccacggctaccacagcgacaagaggcggctgagcaaggccagcagcaaggcccggagtgatgacctgtctgtgtag

SEQ ID NO: 153538 - DNA, 1077 bp, Artificial Sequence; identical to SEQ ID NO: 153537
  Description of Artificial Sequence: Synthetic coding sequence

SEQ ID NO: 153539 - DNA, 759 bp, Artificial Sequence
  Description of Artificial Sequence: Synthetic coding sequence
atgggagactggagcttcctgggcaacttcctggaggaggtgcacaagcacagcacagtggtgggcaaggtgtggctgactgtgctcttcatcttcaggatgctggtgctgggcacagctgctgagagctcctggggagatgagcaggccgacttccgctgtgacaccatccagcccggctgccagaatgtgtgctatgaccaggccttccccatcagccacatccgctactgggtgctgcagatcatctttgtgtccacccccagcctggtgtacatgggccacgccatgcacacagtgaggatgcaggagaagaggaagctgcgggaggccgagcgggccaaggaggtgcggggcagcggcagctatgagtaccctgtggccgagaaggccgagctgagctgctgggaggagggcaatggaagaattgccctgcagggcaccctgctgaacacctacgtgtgcagcatcctgatccgcaccaccatggaggtgggcttcatcgtgggccagtacttcatctacggcatcttcctgaccaccctgcacgtgtgccgccgcagcccctgcccccaccctgtgaactgctacgtgtcccggcccacagagaagaatgtgttcatcgtgttcatgctggccgtggccgccctgagcctgctgctgagcctggccgagctgtaccacctgggctggaagaagatccggcagagatttgtgaagccccggcagcacatggccaagtgccagctgtctggatag

SEQ ID NO: 153540 - DNA, 1302 bp, Artificial Sequence
  Description of Artificial Sequence: Synthetic coding sequence
atgggagactggagcttcctgggcaacatcctggaggaggtgaatgagcacagcacagtgattggccgggtgtggctgactgtgctcttcatcttccgcatcctgatcctgggcacagctgctgagtttgtgtggggagatgagcagagcgactttgtgtgcaacacccagcagcccggctgtgaaaatgtgtgctatgatgaggccttccccatcagccacatccggctgtgggtgctgcagatcatctttgtgtccacccccagcctgatgtatgtgggccatgctgtgcactacgtgaggatggaggagaagaggaagagccgggaggccgaggagctgggccagcaggccggcaccaatggaggccctgaccagggctctgtgaagaagagcagcggcagcaagggcaccaagaagttccggctggagggcaccctgctgcggacctacatctgccacatcatcttcaagaccctgtttgaggtgggcttcatcgtgggccactacttcctgtatggcttccgcatcctgcccctgtaccgctgcagccgctggccctgccccaacgtggtggactgctttgtgtcccggcccacagagaagaccatcttcatcctcttcatgctgtctgtggcctctgtgtccctcttcctgaatgtgatggagctgggccacctgggcctgaagggcatccgcagcgccctgaagaggcctgtggagcagcccctgggggagatccctgagaagagcctgcacagcattgctgtgagcagcatccagaaggccaagggctaccagctgctggaggaggagaagatcgtgagccactacttccccctgacagaggtgggcatggtggagaccagccccctgcctgccaagcccttcaaccagtttgaggagaagatcagcacaggccccctgggggacctgagccggggctaccaggagaccctgcccagctatgcccaggtgggcgcccaggaggtggagggggagggccccccagctgaggagggcgctgagcctgaggtgggggagaagaaggaggaggccgagcggctgaccacagaggagcaggagaaggtggccgtgcctgagggggagaaggtggagaccccaggagtggacaaggagggggagaaggaggagccccagagcgagaaggtgtccaagcagggcctgcctgctgagaagacccccagcctgtgcccagagctgaccacagatgatgcccggcccctgagccggctgagcaaggccagcagccgggcccggagtgatgacctgactgtgtag

SEQ ID NO: 153541 - DNA, 1302 bp, Artificial Sequence; identical to SEQ ID NO: 153540
  Description of Artificial Sequence: Synthetic coding sequence

SEQ ID NO: 153542 - DNA, 1548 bp, Artificial Sequence
  Description of Artificial Sequence: Synthetic coding sequence
atgggagactggaacctgctgggggacaccctggaggaggtgcacatccacagcaccatgattggcaagatctggctgaccatcctcttcatcttcaggatgctggtgctgggcgtggccgcagaagatgtgtggaatgatgagcagagcggcttcatctgcaacacagagcagcccggctgcagaaatgtgtgctatgaccaggccttccccatcagcctcatccgctactgggtgctgcaggtgatctttgtgagcagccccagcctggtgtacatgggccacgccctgtaccgcctgcgggtgctggaggaggagcggcagaggatgaaggcccagctgcgggtggagctggaggaggtggagtttgagatgccccgggacagaagaaggctggagcaggagctgtgccagctggagaagaggaagctgaacaaggcccccctgcggggcaccctgctgtgcacctacgtgatccacatcttcaccaggtctgtggtggaggtgggcttcatgattggccagtacctgctgtatggcttccacctggagcccctcttcaagtgccacggccacccctgccccaacatcatcgactgctttgtgtcccggcccacagagaagaccatcttcctgctcttcatgcagagcatcgccaccatcagcctcttcctgaacatcctggagatcttccacctgggcttcaagaagatcaagaggggcctgtggggcaagtacaagctgaagaaggagcacaatgagttccacgccaacaaggccaagcagaatgtggccaagtaccagagcaccagcgccaacagcctgaagaggctgcccagcgccccagactacaacctgctggtggagaagcagacccacacagctgtgtaccccagcctgaacagcagcagcgtcttccagcccaacccagacaaccacagcgtgaatgatgagaagtgcatcctggatgagcaggagaccgtgctgagcaatgagatcagcaccctgagcaccagctgcagccacttccagcacatcagcagcaacaacaacaaggacacccacaagatctttgggaaggagctgaatggaaaccagctgatggagaagcgggagacagagggcaaggacagcaagaggaactactacagccggggccacaggagcatccctggggtggccattgatggagagaacaacatgaggcagagcccccagacagtgttcagcctgcctgccaactgtgactggaagccccgctggctgcgggccacctggggcagcagcacagaacatgaaaatagaggcagcccccccaagggcaacctgaagggccagttcagaaaaggaacagtgaggaccctgccccccagccagggcgacagccagagcctggacatccccaacacagctgacagcctgggcggcctgagctttgagcccggcctggtgaggacctgcaacaaccctgtgtgcccccccaaccacgtggtgtccctgaccaacaacctgattggaagaagagtgcccacagacctgcagatctag

SEQ ID NO: 153543 - DNA, 1548 bp, Artificial Sequence; identical to SEQ ID NO: 153542
  Description of Artificial Sequence: Synthetic coding sequence

SEQ ID NO: 153544 - DNA, 1545 bp, Artificial Sequence
  Description of Artificial Sequence: Synthetic coding sequence
atgggagactggaacctgctgggggacaccctggaggaggtgcacatccacagcaccatgattggcaagatctggctgaccatcctcttcatcttcaggatgctggtgctgggcgtggccgcagaagatgtgtggaatgatgagcagagcggcttcatctgcaacacagagcagcccggctgcagaaatgtgtgctatgaccaggccttccccatcagcctcatccgctactgggtgctgcaggtgatctttgtgagcagccccagcctggtgtacatgggccacgccctgtaccgcctgcgggtgctggaggaggagcggcagaggatgaaggcccagctgcgggtggagctggaggaggtggagtttgagatgccccgggacagaagaaggctggagcaggagctgtgccagctggagaagaggaagctgaacaaggcccccctgcggggcaccctgctgtgcacctacgtgatccacatcttcaccaggtctgtggtggaggtgggcttcatgattggccagtacctgctgtatggcttccacctggagcccctcttcaagtgccacggccacccctgccccaacatcatcgactgctttgtgtcccggcccacagagaagaccatcttcctgctcttcatgcagagcatcgccaccatcagcctcttcctgaacatcctggagatcttccacctgggcttcaagaagatcaagaggggcctgtggggcaagtacaagctgaagaaggagcacaatgagttccacgccaacaaggccaagcagaatgtggccaagtaccagagcaccagcgccaacagcctgaagaggctgcccagcgccccagactacaacctgctggtggagaagcagacccacacagctgtgtaccccagcctgaacagcagcagcgtcttccagcccaacccagacaaccacagcgtgaatgatgagaagtgcatcctggatgagcaggagaccgtgctgagcaatgagatcagcaccctgagcaccagctgcagccacttccagcacatcagcagcaacaacaacaaggacacccacaagatctttgggaaggagctgaatggaaaccagctgatggagaagcgggagacagagggcaaggacagcaagaggaactactacagccggggccacaggagcatccctggggtggccattgatggagagaacaacatgaggcagagcccccagacagtgttcagcctgcctgccaactgtgactggaagccccgctggctgcgggccacctggggcagcagcacagaacatgaaaatagaggcagcccccccaaggtgcccggcagcaaggccacagccagcagcctgctgctgatcctgcagaggcccaccagcagccagccccggctgaaggagacccccaagatcaaggccgaggccaagatctatgacagcaagcaccccccccggctgctgcagagcacagtgtccaccttcagcggccgggagcccaggagccctgcccccatgggccaccacagcttccggggccccaggtag

SEQ ID NO: 153545 - DNA, 852 bp, Artificial Sequence
  Description of Artificial Sequence: Synthetic coding sequence
atgaactggacaggcctgtacaccctgctgtctggagtgaacagacacagcacagccatcggccgggtgtggctgagcgtcatcttcatcttccgcatcatggtgctggtggtggccgctgagagcgtgtggggagatgagaagagcagcttcatctgcaacaccctgcagcccggctgcaacagcgtgtgctatgaccagttcttccccatcagccacgtgcggctgtggagcctgcagctgatcctggtgtccaccccagccctgctggtggccatgcacgtggcccaccagcagcacatcgagaagaagatgctgcggctggagggccatggagaccccctgcacctggaggaggtgaagaggcacaaggtgcacatcagcggcaccctgtggtggacctacgtgatctctgtggtgttccggctgctgtttgaagctgtgttcatgtatgtgttctacctgctgtacccaggctacgccatggtgcggctggtgaagtgtgatgtgtacccctgccccaacacagtggactgctttgtgtcccggcccacagagaagacagtgttcaccgtcttcatgctggccgccagcggcatctgcatcatcctgaatgtggccgaggtggtgtacctgatcatccgggcctgtgcccggcgggcccagaggaggagcaacccccccagcaggaaaggaagtggcttcggccaccggctgagccctgagtacaagcagaatgagatcaacaagctgctgtctgagcaggacggcagcctgaaggacatcctgcggcgcagccctggcactggagctggcctggccgagaagagtgaccgctgcagcgcctgctag

SEQ ID NO: 153546 - DNA, 852 bp, Artificial Sequence; identical to SEQ ID NO: 153545
  Description of Artificial Sequence: Synthetic coding sequence

SEQ ID NO: 153547 - DNA, 852 bp, Artificial Sequence; identical to SEQ ID NO: 153545
  Description of Artificial Sequence: Synthetic coding sequence

SEQ ID NO: 153548 - DNA, 255 bp, Artificial Sequence
  Description of Artificial Sequence: Synthetic coding sequence
atgaactggacaggcctgtacaccctgctgtctggagtgaacagacacagcacagccatcggccgggtgtggctgagcgtcatcttcatcttccgcatcatggtgctggtggtggccgctgagagcgtgtggggagatgagaagagcagcttcatctgcaacaccctgcagcccggctgcaacagcgtgtgctatgaccagttcttccccatcagccacgtgcggctgtggagcctgcagctgatcctggtgtag

SEQ ID NO: 153549 - DNA, 681 bp, Artificial Sequence
  Description of Artificial Sequence: Synthetic coding sequence
atggactggggcaccctgcagaccatcctgggcggcgtgaacaagcacagcaccagcatcggcaagatctggctgactgtgctcttcatcttccgcatcatgatcctggtggtggccgccaaggaggtgtggggagatgagcaggccgactttgtgtgcaacaccctgcagcccggctgcaagaatgtgtgctatgaccactacttccccatcagccacatccggctgtgggccctgcagctgatctttgtgtccaccccagccctgctggtggccatgcacgtggcctacagaagacatgagaagaagaggaagttcatcaagggggagatcaagtctgagttcaaggacatcgaggagatcaagacccagaaggtgcgcatcgagggcagcctgtggtggacctacaccagcagcatcttcttccgggtcatctttgaggccgccttcatgtatgtgttctacgtgatgtatgatggcttctccatgcagaggctggtgaagtgcaatgcctggccctgccccaacacagtggactgctttgtgtcccggcccacagagaagacagtgttcaccgtcttcatgattgctgtgtctggcatctgcatcctgctgaatgtgacagagctgtgctacctgctgatccgctactgcagcggcaagagcaagaagcctgtgtag

SEQ ID NO: 153550 - DNA, 681 bp, Artificial Sequence; identical to SEQ ID NO: 153549
  Description of Artificial Sequence: Synthetic coding sequence

SEQ ID NO: 153551 - DNA, 813 bp, Artificial Sequence
  Description of Artificial Sequence: Synthetic coding sequence
atggactggaagaccctgcaggccctgctgtctggagtgaacaagtacagcacagccttcggccgcatctggctgtctgtggtgtttgtgttccgggtgctggtgtatgtggtggccgctgagcgggtgtggggagatgagcagaaggactttgactgcaacaccaagcagcccggctgcaccaacgtgtgctatgacaactacttccccatcagcaacatccggctgtgggccctgcagctgatctttgtgacctgccccagcctgctggtgatcctgcacgtggcctaccgggaggagcgggagaggaggcaccggcagaagcatggagaccagtgtgccaagctgtatgacaatgctgggaagaagcacggcggcctgtggtggacctacctgttcagcctcatcttcaagctgatcatcgagttcctgttcctgtacctgctgcacaccctgtggcacggcttcaacatgccccggctggtgcagtgtgccaacgtggccccctgccccaacatcgtggactgctacatcgcccggcccacagagaagaagatcttcacctacttcatggtgggcgccagcgctgtgtgcatcgtgctgaccatctgtgagctgtgctacctgatctgccaccgggtgctgcggggcctgcacaaggacaagccccggggcggctgcagccccagcagcagcgccagccgggccagcacctgccgctgccaccacaagctggtggaggccggggaggtggaccctgaccccggcaacaacaagctgcaggccagcgcccccaacctgacccccatctag

SEQ ID NO: 153552 - DNA, 813 bp, Artificial Sequence; identical to SEQ ID NO: 153551
  Description of Artificial Sequence: Synthetic coding sequence

SEQ ID NO: 153553 - DNA, 765 bp, Artificial Sequence
  Description of Artificial Sequence: Synthetic coding sequence
atggactggaagaccctgcaggccctgctgtctggagtgaacaagtacagcacagccttcggccgcatctggctgtctgtggtgtttgtgttccgggtgctggtgtatgtggtggccgctgagcgggtgtggggagatgagcagaaggactttgactgcaacaccaagcagcccggctgcaccaacgtgtgctatgacaactacttccccatcagcaacatccggctgtgggccctgcagctgatctttgtgacctgccccagcctgctggtgatcctgcacgtggcctaccgggaggagcgggagaggaggcaccggcagaagcatggagaccagtgtgccaagctgtatgacaatgctgggaagaagcacggcggcctgtggtggacctacctgctgcacaccctgtggcacggcttcaacatgccccggctggtgcagtgtgccaacgtggccccctgccccaacatcgtggactgctacatcgcccggcccacagagaagaagatcttcacctacttcatggtgggcgccagcgctgtgtgcatcgtgctgaccatctgtgagctgtgctacctgatctgccaccgggtgctgcggggcctgcacaaggacaagccccggggcggctgcagccccagcagcagcgccagccgggccagcacctgccgctgccaccacaagctggtggaggccggggaggtggaccctgaccccggcaacaacaagctgcaggccagcgcccccaacctgacccccatctag

SEQ ID NO: 153554 - DNA, 801 bp, Artificial Sequence
  Description of Artificial Sequence: Synthetic coding sequence
atgaactgggccttcctgcagggcctgctgtctggagtgaacaagtacagcacagtgctgagccgcatctggctgtctgtggtgttcatcttccgggtgctggtgtatgtggtggccgctgaggaggtgtgggatgatgagcagaaggactttgtgtgcaacaccaagcagcccggctgccccaacgtgtgctatgatgagttcttccctgtgagccacgtgcggctgtgggccctgcagctgatcctggtgacctgccccagcctgctggtggtgatgcacgtggcctaccgggaggagcgggagaggaagcaccacctgaagcacggccccaatgcccccagcctgtatgacaacctgagcaagaagagaggaggcctgtggtggacctacctgctgagcctcatcttcaaggctgctgtggatgctggcttcctgtacatcttccaccggctgtacaaggactatgacatgccccgggtggtggcctgcagcgtggagccctgcccccacacagtggactgctacatcagccggcccacagagaagaaggtgttcacctacttcatggtgaccacagctgccatctgcatcctgctgaacctgtctgaggtgttctacctggtgggcaagcgctgcatggagatcttcggccccaggcaccggcggccccgctgccgggagtgcctgcctgacacctgccccccctacgtgctgagccagggcggccacccagaagatggcaacagcgtgctgatgaaggccggcagcgcccctgtggatgctgggggctacccctag

SEQ ID NO: 153555 - DNA, 822 bp, Artificial Sequence
  Description of Artificial Sequence: Synthetic coding sequence
atgaactggagcatctttgagggcctgctgtctggagtgaacaagtacagcacagccttcggccgcatctggctgagcctggtgttcatcttccgggtgctggtgtacctggtgacagctgagcgggtgtggagcgatgaccacaaggactttgactgcaacacccggcagcccggctgcagcaatgtgtgctttgatgagttcttccctgtgagccacgtgcggctgtgggccctgcagctgatcctggtgacctgccccagcctgctggtggtgatgcacgtggcctaccgggaggtgcaggagaagaggcaccgggaggcccatggagaaaattctggccgcctgtacctgaaccctgggaagaagagaggaggcctgtggtggacctacgtgtgcagcctggtgttcaaggcctctgtggacatcgccttcctgtatgtgttccacagcttctaccccaagtacatcctgccccctgtggtgaagtgccacgccgacccctgccccaacatcgtggactgcttcatcagcaagcccagcgagaagaacatcttcaccctcttcatggtggccacagctgccatctgcatcctgctgaacctggtggagctgatctacctggtgtccaagcgctgccatgaatgtctggccgccaggaaggcccaggccatgtgcaccggccaccacccccacggcaccaccagcagctgcaagcaggatgacctgctgagcggggacctgatcttcctgggcagtgacagccacccccccctgctgcctgaccggccccgggaccacgtgaagaagaccatcctgtag

SEQ ID NO: 153556 - DNA, 786 bp, Artificial Sequence
  Description of Artificial Sequence: Synthetic coding sequence
atggactggggcaccctgcacaccttcatcggcggcgtgaacaagcacagcaccagcatcggcaaggtgtggatcaccgtcatcttcatcttccgggtgatgatcctggtggtggccgcccaggaggtgtggggagatgagcaggaggactttgtgtgcaacaccctgcagcccggctgcaagaatgtgtgctatgaccacttcttccctgtgagccacatccggctgtgggccctgcagctgatctttgtgtccaccccagccctgctggtggccatgcacgtggcctactacagacatgagaccaccaggaagttcagaagaggagagaagagaaatgacttcaaggacatcgaggacatcaagaagcagaaggtgcgcatcgagggcagcctgtggtggacctacaccagcagcatcttcttccgcatcatctttgaggccgccttcatgtatgtgttctacttcctgtacaacggctaccacctgccctgggtgctgaagtgtggcatcgacccctgccccaacctggtggactgcttcatcagccggcccacagagaagacagtgttcaccatcttcatgatcagcgccagcgtcatctgcatgctgctgaatgtggccgagctgtgctacctgctgctgaaggtgtgcttccgccgcagcaagagggcccagacccagaagaaccaccccaaccacgccctgaaggagagcaagcagaatgagatgaatgaactcatcagtgacagcggccagaatgccatcaccggcttccccagctag

SEQ ID NO: 153557 - DNA, 786 bp, Artificial Sequence; identical to SEQ ID NO: 153556
  Description of Artificial Sequence: Synthetic coding sequence

SEQ ID NO: 153558 - DNA, 786 bp, Artificial Sequence; identical to SEQ ID NO: 153556
  Description of Artificial Sequence: Synthetic coding sequence

SEQ ID NO: 153559 - DNA, 786 bp, Artificial Sequence; identical to SEQ ID NO: 153556
  Description of Artificial Sequence: Synthetic coding sequence

SEQ ID NO: 153560 - DNA, 672 bp, Artificial Sequence
  Description of Artificial Sequence: Synthetic coding sequence
atgtcctggatgttcctgcgggacctgctgtctggagtgaacaagtacagcacaggcaccggctggatctggctggccgtggtgtttgtgttccggctgctggtgtacatggtggccgctgagcacgtgtggaaggatgagcagaaggagtttgagtgcaacagccggcagcccggctgcaagaatgtgtgctttgatgacttcttccccatcagccaggtgcggctgtgggccctgcagctgatcatggtgtccacccccagcctgctggtggtgctgcacgtggcctaccacgagggccgggagaagaggcacaggaagaagctgtatgtgtccccaggcaccatggatggcggcctgtggtacgcctacctgatcagcctgattgtgaagacaggctttgagatcggcttcctggtgctcttctacaagctgtatgatggcttctctgtgccctacctgatcaagtgtgacctgaagccctgccccaacacagtggactgcttcatcagcaagcccacagagaagaccatcttcatcctcttcctggtgatcaccagctgcctgtgcatcgtgctgaacttcatcgagctgtccttcctggtgctgaagtgcttcatcaagtgctgcctgcagaagtacctgaagaagccccaggtgctgtctgtgtag

SEQ ID NO: 153561 - DNA, 492 bp, Artificial Sequence
  Description of Artificial Sequence: Synthetic coding sequence
atgtcctggatgttcctgcgggacctgctgtctggagtgaacaagtacagcacaggcaccggctggatctggctggccgtggtgtttgtgttccggctgctggtgtacatggtggccgctgagcacgtgtggaaggatgagcagaaggagtttgagtgcaacagccggcagcccggctgcaagaatgtgtgctttgatgacttcttccccatcagccaggtgcggctgtgggccctgcagctgatcatggtgtccacccccagcctgctggtggtgctgcacgtggcctaccacgagggccgggagaagaggcacaggaagaagctgtatgtgtccccaggcaccatggatggcggcctgtggtacgcctacctgatcagcctgattgtgaagacaggctttgagatcggcttcctggtgctcttctacaagctgtatgatggcttctctgtgccctacctgatcaagtgtgacctgaagccctgcccctag

SEQ ID NO: 153562 - DNA, 672 bp, Artificial Sequence; identical to SEQ ID NO: 153560
  Description of Artificial Sequence: Synthetic coding sequence

SEQ ID NO: 153563 - DNA, 966 bp, Artificial Sequence
  Description of Artificial Sequence: Synthetic coding sequence
atgggagagtggaccatcctggagcggctgctggaggccgctgtgcagcagcacagcaccatgattggccgcatcctgctgactgtggtggtgatcttccgcatcctgattgtggccatcgtgggggagaccgtgtatgatgatgagcagaccatgtttgtgtgcaacaccctgcagcccggctgcaaccaggcctgctatgaccgggccttccccatcagccacatccgctactgggtgttccagatcatcatggtgtgcacccccagcctgtgcttcatcacctacagcgtgcaccagagcgccaagcagcgggagcggcgctacagcacagtgttcctggccctggaccgggaccccccagagagcatcggcggccctgggggcaccggcggcggcggcagcggcggcggcaagcgggaggacaagaagctgcagaatgccatcgtgaatggagtgctgcagaacacagagaacaccagcaaggagacagagccagactgcctggaggtgaaggagctgaccccccaccccagcggcctgaggacagccagcaagagcaagctgcggcggcaggagggcatcagccgcttctacatcatccaggtggtgttcagaaatgccctggagatcggcttcctggtgggccagtacttcctgtatggcttctctgtgcccggcctgtatgagtgcaaccgctacccctgcatcaaggaggtggagtgctacgtgtcccggcccacagagaagacagtgttcctggtgttcatgtttgctgtgtctggcatctgtgtggtgctgaacctggccgagctgaaccacctgggctggaggaagatcaagctggccgtgcggggggcccaggccaagaggaagagcatctatgagatccggaacaaggacctgccccgggtgtctgtgcccaactttggccgcacccagagcagtgacagcgcctacgtgtag

SEQ ID NO: 153564 - DNA, 891 bp, Artificial Sequence
  Description of Artificial Sequence: Synthetic coding sequence
atgggagagtgggccttcctgggcagcctgctggatgctgtgcagctgcagagccccctggtgggccgcctgtggctggtggtgatgctgatcttccgcatcctggtgctggccaccgtgggcggcgctgtgtttgaagatgagcaggaggagtttgtgtgcaacaccctgcagcccggctgccggcagacctgctatgaccgggccttccctgtgagccactaccgcttctggctgttccacatcctgctgctgagcgcccctcctgtgctgtttgtggtgtacagcatgcaccgggccggcaaggaggccggcggcgctgaggccgccgcccagtgtgcccctggcctgcctgaggcccagtgtgccccctgtgccctgcgggcccggcgggcccggcgctgctacctgctgtctgtggccctgcggctgctggccgagctgaccttcctgggcggccaggccctgctgtatggcttccgggtggccccccactttgcctgtgccggccccccctgcccccacacagtggactgctttgtgtcccggcccacagagaagacagtgtttgtgctcttctactttgctgtgggcctgctgagcgccctgctgtctgtggccgagctgggccacctgctgtggaagggccggccccgggccggggagcgggacaaccgctgcaacagagcccacgaggaggcccagaagctgctgcccccacctcctcctcctccacccatcgtggtgacctgggaggagaacagacacctgcagggcgagggcagccctggcagcccccaccccaagacagagctggatgccccccgcttccggcgggagagcaccagccctgctggctggcactgcagcctgcccttccacggcacctag

SEQ ID NO: 153565 - DNA, 1113 bp, Artificial Sequence
  Description of Artificial Sequence: Synthetic coding sequence
atggagggcgtggacctgctgggcttcctgatcatcaccctgaactgcaatgtgaccatggtgggcaagctgtggtttgtgctgaccatgctgctgaggatgctggtgattgtgctggccggccggcctgtgtaccaggatgagcaggagagatttgtgtgcaacaccctgcagcccggctgtgccaacgtgtgctatgatgtgttcagccctgtgagccacctgcgcttctggctgatccagggcgtgtgtgtgctgctgcccagcgctgtgttttctgtgtatgtgctgcacagaggagccaccctggccgccctgggcccccggcgctgcccagacccccgggagcccgccagcggccagaggcgctgcccccggccctttggagagcggggcggcctgcaggtgcctgacttctctgctggctacatcatccacctgctgctgcggaccctgctggaggccgcctttggagccctgcactacttcctgtttggcttcctggcccccaagaagttcccctgcacccggcccccctgcacaggagtggtggactgctacgtgtcccggcccacagagaagagcctgctgatgctgttcctgtgggccgtgtctgccctgtccttcctgctgggcctggccgacctggtgtgcagcctgcggcggaggatgagaagaagacctggcccccccaccagccccagcatcaggaagcagagcggggccagcggccacgccgagggcagaagaacagatgaggagggcggccgggaggaggagggcgccccagcccctcctggggcccgggccggcggggagggcgccggcagccccaggaggaccagccgggtgtctggccacaccaagatcccagatgaagatgagagcgaggtgaccagcagcgccagcgagaagctgggccggcagccccggggccggccccaccgggaggccgcccaggacccccggggcagcggcagcgaggagcagcccagcgctgcccccagccggctggccgccccacccagctgcagcagcctgcagcccccagaccccccagccagcagcagcggggccccccacctgcgggccaggaagtctgagtgggtgtag

SEQ ID NO: 153566 - DNA, 1191 bp, Artificial Sequence
  Description of Artificial Sequence: Synthetic coding sequence
atgtcctggagcttcctgacccggctgctggaggagatccacaaccacagcacctttgtgggcaagatctggctgactgtgctgattgtgttcagaattgtgctgacagctgtgggcggggagagcatctactatgatgagcagagcaagtttgtgtgcaacacagagcagcccggctgtgaaaatgtgtgctatgatgcctttgcccccctgagccacgtgcgcttctgggtgttccagatcatcctggtggccacccccagcgtgatgtacctgggctacgccatccacaagatcgccaagatggagcacggggaggccgacaagaaggccgcccggagcaagccctatgccatgcgctggaagcagcaccgggccctggaggagacagaggaggacaatgaggaggaccccatgatgtacccagagatggagctggagagtgacaaggagaacaaggagcagagccagcccaagcccaagcatgatggaagaagacgcatccgggaggatggcctgatgaagatctacgtgctgcagctgctggccaggacagtgtttgaggtgggcttcctgattggccagtacttcctgtatggcttccaggtgcaccccttctacgtgtgcagccggctgccctgcccccacaagattgactgcttcatcagccggcccacagagaagaccatcttcctgctgatcatgtatggagtgacaggcctgtgcctgctgctgaacatctgggagatgctgcacctgggcttcggcaccatccgggacagcctgaacagcaagaggcgggagctggaggaccccggggcctacaactaccccttcacctggaacaccccatctgcccctcctggctacaacattgctgtgaagccagaccagatccagtacacagagctgagcaatgccaagatcgcctacaagcagaacaaggccaacacagcccaggagcagcagtatggcagccatgaggagaacctgcctgctgacctggaggccctgcagcgggagatccgcatggcccaggagcggctggacctggccgtgcaggcctacagccaccagaacaacccccacggcccccgggagaagaaggccaaggtgggcagcaaggccggcagcaacaagagcacagccagcagcaagtctggagatggcaagacctctgtgtggatctag

SEQ ID NO: 153567 - DNA, 1191 bp, Artificial Sequence; identical to SEQ ID NO: 153566
  Description of Artificial Sequence: Synthetic coding sequence

SEQ ID NO: 153568 - DNA, 1320 bp, Artificial Sequence
  Description of Artificial Sequence: Synthetic coding sequence
atgaccaacatgtcctggagcttcctgacccggctgctggaggagatccacaaccacagcacctttgtgggcaaggtgtggctgactgtgctggtggtgttccgcatcgtgctgacagctgtgggcggggaggccatctacagtgatgagcaggccaagttcacctgcaacacccggcagcccggctgtgacaacgtgtgctatgatgcctttgcccccctgagccacgtgcgcttctgggtgttccagatcgtggtgatcagcaccccatctgtgatgtacctgggctatgctgtgcaccggctggcccgggccagcgagcaggagaggagaagagccctgcggcggcggcccggcccccggcgggccccccgggcccacctgcccccacctcatgctggctggccagagcctgctgacctgggggaggaggagcccatgctgggcctgggggaggaggaggaggaggaggagactggagctgctgagggcgctggggaggaggccgaggaggccggggctgaggaggcctgcaccaaggctgtgggcgcagatggcaaggctgctggcaccccaggccccaccggccagcatgatggaagaagacgcatccagcgggagggcctgatgagggtgtatgtggcccagctggtggcccgggccgcctttgaggtggccttcctggtgggccagtacctgctgtatggctttgaggtgcggcccttcttcccctgcagccggcagccctgcccccacgtggtggactgctttgtgtcccggcccacagagaagacagtgttcctgctggtgatgtatgtggtgtcctgcctgtgcctgctgctgaacctgtgtgagatggcccacctgggcctgggcagcgcccaggatgctgtgcggggcagaagaggccccccagccagcgccccagccccagccccccggcccccaccctgtgccttccctgctgctgctgctggcctggcctgccccccagactacagcctggtggtgcgggctgctgagcgggcccgggcccatgaccagaacctggccaacctggccctgcaggccctgagagatggagctgctgctggggaccgggaccgggacagcagcccctgtgtgggcctgcctgctgccagccggggcccccccagggctggggccccagccagcaggacaggcagcgccaccagcgctggcaccgtgggggagcagggccggcccggcacccatgagaggcctggggccaagcccagggctggcagcgagaagggcagcgccagcagcagagatggcaagaccaccgtgtggatctag

SEQ ID NO: 153569 - DNA, 840 bp, Artificial Sequence
  Description of Artificial Sequence: Synthetic coding sequence
atgtgtggccgcttcctgcggcggctgctggccgaggagagcagaagaagcacccctgtgggccgcctgctgctgcctgtgctgctgggcttccggctggtgctgctggccgccagcggccctggggtgtatggagatgagcagagcgagtttgtgtgccacacccagcagcccggctgcaaggccgcctgctttgatgccttccaccccctgagccccctgcgcttctgggtgttccaggtgatcctggtggccgtgcccagcgccctgtacatgggcttcaccctgtaccacgtgatctggcactgggagctgagcggcaagggcaaggaggaggagaccctcatccagggccgggagggcaacacagatgtgcctggggccggcagcctgcggctgctgtgggcctacgtggcccagctgggcgcccggctggtgctggagggcgccgccctgggcctgcagtaccacctgtatggcttccagatgcccagcagctttgcctgccggcgggagccctgcctgggcagcatcacctgcaacctgagccggcccagcgagaagaccatcttcctgaagaccatgtttggagtgtctggcttctgcctgctcttcaccttcctggagctggtgctgctgggcctgggccgctggtggaggacctggaagcacaagagcagcagcagcaagtacttcctgaccagcgagagcaccaggaggcacaagaaggccacagacagcctgcctgtggtggagaccaaggagcagttccaggaggccgtgcccggccgcagcctggcccaggagaagcagaggcctgtgggccccagagatgcctag

SEQ ID NO: 153570 - DNA, 1338 bp, Artificial Sequence
  Description of Artificial Sequence: Synthetic coding sequence
atgaccatgtttgaaaatgtgacccgggccctggcccggcagctgaaccccaggggggacctgacccccctggacagcctgattgacttcaagcgcttccaccccttctgcctggtgctgaggaagaggaagagcaccctcttctggggcgcccgctacgtgaggacagactacaccctgctggatgtgctggagcccggcagcagccccagcgaccccacagacaccggcaactttggcttcaagaacatgctggacaccagggtggagggagatgtggatgtgcccaagacagtgaaggtgaagggcacagctggcctgagccagaacagcaccctggaggtgcagaccctgtctgtggcccccaaggccctggagaccgtgcaggagaggaagctggccgctgaccaccccttcctgaaggagatgcaggaccagggcgagaacctgtatgtggtgatggaggtggtggagaccgtgcaggaggtgaccctggagcgggccggcaaggccgaggcctgcttcagcctgcccttctttgcccccctgggcctgcagggcagcatcaaccacaaggaggccgtgaccatccccaagggctgtgtgctggccttccgggtgcggcagctgatggtgaagggcaaggatgagtgggacatcccccacatctgcaatgacaacatgcagaccttccccccaggagagaagtctggagaggagaaggtgatcctgatccaggccagtgatgtgggagatgtgcatgagggcttccgcaccctgaaggaggaggtgcagcgggagacccagcaggtggagaagctgagccgggtgggccagagcagcctgctgagcagcctgagcaagctgctgggcaagaagaaggagctgcaggacctggagctggccctggagggcgccctggacaagggccacgaggtgaccctggaggccctgcccaaggatgtgctgctgagcaaggaggccgtgggcgccatcctgtactttgtgggcgccctgacagagctgtctgaggcccagcagaagctgctggtgaagtccatggagaagaagatcctgcctgtgcagctgaagctggtggagagcaccatggagcagaacttcctgctggacaaggagggcgtcttccccctgcagcctgagctgctgagcagcctgggagatgaggagctgaccctgacagaggccctggtgggcctgagcggcctggaggtgcagaggagcggcccccagtacatgtgggaccctgacaccctgccccggctgtgtgccctgtatgccggcctgagcctgctgcagcagctgaccaaggccagctag

SEQ ID NO: 153571 - DNA, 1212 bp, Artificial Sequence
  Description of Artificial Sequence: Synthetic coding sequence
atgttttctgtgtttgaggagatcaccagaattgtggtgaaggagatggatgctggaggagacatgattgctgtgcgcagcctggtggatgctgaccgcttccgctgcttccacctggtgggggagaagaggaccttcttcggctgccgccactacaccaccggcctgaccctgatggacatcctggacacagatggagacaagtggctggatgagctggacagcggcctgcagggccagaaggccgagttccagatcctggacaacgtggacagcactggagagctgattgtgcggctgcccaaggagatcaccatcagcggcagcttccagggcttccaccaccagaagatcaagatcagcgagaaccgcatcagccagcagtacctggccaccctggagaacaggaagctgaagcgggagctgcccttctccttccgcagcatcaacaccagagaaaatctctacctggtgacagagaccctggagaccgtgaaggaggagaccctgaagagtgaccggcagtacaagttctggagccagatcagccagggccacctgagctacaagcacaagggccagcgggaggtgaccatcccccccaacagagtgctgagctacagagtgaagcagctggtgttccccaacaaggagaccatgaagaaggatggagccagcagctgcctgggcaagagcctgggcagcgaggacagcaggaacatgaaggagaagctggaggacatggagagcgtgctgaaggacctgacagaggagaagaggaaggatgtgctgaacagcctggccaagtgcctgggcaaggaggacatccggcaggacctggagcagagggtgtctgaggtgctgatcagcggggagctgcacatggaggaccctgacaagcccctgctgagcagcctcttcaatgctgctggggtgctggtggaggcccgggccaaggccatcctggacttcctggatgccctgctggagctgtctgaggagcagcagtttgtggccgaggccctggagaagggcaccctgcccctgctgaaggaccaggtgaagtctgtgatggagcagaactgggatgagctggccagcagccccccagacatggactatgaccctgaggcccgcatcctgtgtgccctgtatgtggtggtgtccatcctgctggagctggccgagggccccacctctgtgagcagctag

SEQ ID NO: 153572 - DNA, 1236 bp, Artificial Sequence
  Description of Artificial Sequence: Synthetic coding sequence
atgttttctgtgtttgaggagatcaccagaattgtggtgaaggagatggatgctggaggagacatgattgctgtgcgcagcctggtggatgctgaccgcttccgctgcttccacctggtgggggagaagaggaccttcttcggctgccgccactacaccaccggcctgaccctgatggacatcctggacacagatggagacaagtggctggatgagctggacagcggcctgcagggccagaaggccgagttccagatcctggacaacgtggacagcactggagagctgattgtgcggctgcccaaggagatcaccatcagcggcagcttccagggcttccaccaccagaagatcaagatcagcgagaaccgcatcagccagcagtacctggccaccctggagaacaggaagctgaagcgggagctgcccttctccttccgcagcatcaacaccagagaaaatctctacctggtgacagagaccctggagaccgtgaaggaggagaccctgaagagtgaccggcagtacaagttctggagccagatcagccagggccacctgagctacaagcacaagggccagcgggaggtgaccatcccccccaacagagtgctgagctacagagtgaagcagctggtgttccccaacaaggagaccatgtctgctggcctggacatccacttccggggcaagaccaagagcttccctgagggcaagagcctgggcagcgaggacagcaggaacatgaaggagaagctggaggacatggagagcgtgctgaaggacctgacagaggagaagaggaaggatgtgctgaacagcctggccaagtgcctgggcaaggaggacatccggcaggacctggagcagagggtgtctgaggtgctgatcagcggggagctgcacatggaggaccctgacaagcccctgctgagcagcctcttcaatgctgctggggtgctggtggaggcccgggccaaggccatcctggacttcctggatgccctgctggagctgtctgaggagcagcagtttgtggccgaggccctggagaagggcaccctgcccctgctgaaggaccaggtgaagtctgtgatggagcagaactgggatgagctggccagcagccccccagacatggactatgaccctgaggcccgcatcctgtgtgccctgtatgtggtggtgtccatcctgctggagctggccgagggccccacctctgtgagcagctag

SEQ ID NO: 153573 - DNA, 1185 bp, Artificial Sequence
  Description of Artificial Sequence: Synthetic coding sequence
atgttttctgtgtttgaggagatcaccagaattgtggtgaaggagatggatgctggaggagacatgattgctgtgcgcagcctggtggatgctgaccgcttccgctgcttccacctggtgggggagaagaggaccttcttcggctgccgccactacaccaccggcctgaccctgatggacatcctggacacagatggagacaagtggctggatgagctggacagcggcctgcagggccagaaggccgagttccagatcctggacaacgtggacagcactggagagctgattgtgcggctgcccaaggagatcaccatcagcggcagcttccagggcttccaccaccagaagatcaagatcagcgagaaccgcatcagccagcagtacctggccaccctggagaacaggaagctgaagcgggagctgcccttctccttccgcagcatcaacaccagagaaaatctctacctggtgacagagaccctggagaccgtgaaggaggagaccctgaagagtgaccggcagtacaagttctggagccagatcagccagggccacctgagctacaagcacaagggccagcgggaggtgaccatcccccccaacagagtgctgagctacagagtgaagcagctggtgttccccaacaaggagaccatgaggaagagcctgggcagcgaggacagcaggaacatgaaggagaagctggaggacatggagagcgtgctgaaggacctgacagaggagaagaggaaggatgtgctgaacagcctggccaagtgcctgggcaaggaggacatccggcaggacctggagcagagggtgtctgaggtgctgatctctggagagctgcacatggaggaccctgacaagcccctgctgagcagcctcttcaatgctgctggggtgctggtggaggcccgggccaaggccatcctggacttcctggatgccctgctggagctgtctgaggagcagcagtttgtggccgaggccctggagaagggcaccctgcccctgctgaaggaccaggtgaagtctgtgatggagcagaactgggatgagctggccagcagccccccagacatggactatgaccctgaggcccgcatcctgtgtgccctgtatgtggtggtgtccatcctgctggagctggccgagggccccacctctgtgagcagctag

SEQ ID NO: 153574 - DNA, 1236 bp, Artificial Sequence; identical to SEQ ID NO: 153572
  Description of Artificial Sequence: Synthetic coding sequence

SEQ ID NO: 153575 - DNA, 1251 bp, Artificial Sequence
  Description of Artificial Sequence: Synthetic coding sequence
atgttttctgtgtttgaggagatcaccagaattgtggtgaaggagatggatgctggaggagacatgattgctgtgcgcagcctggtggatgctgaccgcttccgctgcttccacctggtgggggagaagaggaccttcttcggctgccgccactacaccaccggcctgaccctgatggacatcctggacacagatggagacaagtggctggatgagctggacagcggcctgcagggccagaaggccgagttccagatcctggacaacgtggacagcactggagagctgattgtgcggctgcccaaggagatcaccatcagcggcagcttccagggcttccaccaccagaagatcaagatcagcgagaaccgcatcagccagcagtacctggccaccctggagaacaggaagctgaagcgggagctgcccttctccttccgcagcatcaacaccagagaaaatctctacctggtgacagagaccctggagaccgtgaaggaggagaccctgaagagtgaccggcagtacaagttctggagccagatcagccagggccacctgagctacaagcacaagggccagcgggaggtgaccatcccccccaacagagtgctgagctacagagtgaagcagctggtgttccccaacaaggagaccatgaacatccacttccggggcaagaccaagagcttccctgaggagaaggatggagccagcagctgcctgggcaagagcctgggcagcgaggacagcaggaacatgaaggagaagctggaggacatggagagcgtgctgaaggacctgacagaggagaagaggaaggatgtgctgaacagcctggccaagtgcctgggcaaggaggacatccggcaggacctggagcagagggtgtctgaggtgctgatctctggagagctgcacatggaggaccctgacaagcccctgctgagcagcctcttcaatgctgctggggtgctggtggaggcccgggccaaggccatcctggacttcctggatgccctgctggagctgtctgaggagcagcagtttgtggccgaggccctggagaagggcaccctgcccctgctgaaggaccaggtgaagtctgtgatggagcagaactgggatgagctggccagcagccccccagacatggactatgaccctgaggcccgcatcctgtgtgccctgtatgtggtggtgtccatcctgctggagctggccgagggccccacctctgtgagcagctag

SEQ ID NO: 153576 - DNA, 1047 bp, Artificial Sequence
  Description of Artificial Sequence: Synthetic coding sequence
tgactggatgagctggacagcggcctgcagggccagaaggccgagttccagatcctggacaacgtggacagcactggagagctgattgtgcggctgcccaaggagatcaccatcagcggcagcttccagggcttccaccaccagaagatcaagatcagcgagaaccgcatcagccagcagtacctggccaccctggagaacaggaagctgaagcgggagctgcccttctccttccgcagcatcaacaccagagaaaatctctacctggtgacagagaccctggagaccgtgaaggaggagaccctgaagagtgaccggcagtacaagttctggagccagatcagccagggccacctgagctacaagcacaagggccagcgggaggtgaccatcccccccaacagagtgctgagctacagagtgaagcagctggtgttccccaacaaggagaccatgaacatccacttccggggcaagaccaagagcttccctgaggagaaggatggagccagcagctgcctgggcaagagcctgggcagcgaggacagcaggaacatgaaggagaagctggaggacatggagagcgtgctgaaggacctgacagaggagaagaggaaggatgtgctgaacagcctggccaagtgcctgggcaaggaggacatccggcaggacctggagcagagggtgtctgaggtgctgatctctggagagctgcacatggaggaccctgacaagcccctgctgagcagcctcttcaatgctgctggggtgctggtggaggcccgggccaaggccatcctggacttcctggatgccctgctggagctgtctgaggagcagcagtttgtggccgaggccctggagaagggcaccctgcccctgctgaaggaccaggtgaagtctgtgatggagcagaactgggatgagctggccagcagccccccagacatggactatgaccctgaggcccgcatcctgtgtgccctgtatgtggtggtgtccatcctgctggagctggccgagggccccacctctgtgagcagctag

SEQ ID NO: 153577 - DNA, 1224 bp, Artificial Sequence
  Description of Artificial Sequence: Synthetic coding sequence
atgttttctgtgtttgaggagatcaccagaattgtggtgaaggagatggatgctggaggagacatgattgctgtgcgcagcctggtggatgctgaccgcttccgctgcttccacctggtgggggagaagaggaccttcttcggctgccgccactacaccaccggcctgaccctgatggacatcctggacacagatggagacaagtggctggatgagctggacagcggcctgcagggccagaaggccgagttccagatcctggacaacgtggacagcactggagagctgattgtgcggctgcccaaggagatcaccatcagcggcagcttccagggcttccaccaccagaagatcaagatcagcgagaaccgcatcagccagcagtacctggccaccctggagaacaggaagctgaagcgggagctgcccttctccttccgcagcatcaacaccagagaaaatctctacctggtgacagagaccctggagaccgtgaaggaggagaccctgaagagtgaccggcagtacaagttctggagccagatcagccagggccacctgagctacaagcacaagggccagcgggaggtgaccatcccccccaacagagtgctgagctacagagtgaagcagctggtgttccccaacaaggagaccatgaacatccacttccggggcaagaccaagagcttccctgagggcaagagcctgggcagcgaggacagcaggaacatgaaggagaagctggaggacatggagagcgtgctgaaggacctgacagaggagaagaggaaggatgtgctgaacagcctggccaagtgcctgggcaaggaggacatccggcaggacctggagcagagggtgtctgaggtgctgatcagcggggagctgcacatggaggaccctgacaagcccctgctgagcagcctcttcaatgctgctggggtgctggtggaggcccgggccaaggccatcctggacttcctggatgccctgctggagctgtctgaggagcagcagtttgtggccgaggccctggagaagggcaccctgcccctgctgaaggaccaggtgaagtctgtgatggagcagaactgggatgagctggccagcagccccccagacatggactatgaccctgaggcccgcatcctgtgtgccctgtatgtggtggtgtccatcctgctggagctggccgagggccccacctctgtgagcagctag

SEQ ID NO: 153578 - DNA, 1527 bp, Artificial Sequence
  Description of Artificial Sequence: Synthetic coding sequence
atgcccagcatgctggagcgcatcagcaagaacctggtgaaggagatcggcagcaaggacctgacccctgtgaagtacctgctgagcgccaccaagctgcggcagtttgtgatcctgaggaagaagaaggacagccgcagcagcttctgggagcagagcgactatgtgcctgtggagttcagcctgaatgacatcctggagcccagcagctctgtgctggagaccgtggtgacaggccccttccacttcagtgacatcatgatccagaagcacaaggctgacatgggcgtgaatgtgggcatcgaggtgtctgtgtctggagaggcctctgtggaccacggctgcagcctggagttccagatcgtgaccatccccagccccaacctggaggacttccagaagaggaagctgctggaccctgagcccagcttcctgaaggaatgtagaagaagaggagacaacctgtatgtggtgacagaagctgtggagctgatcaacaacacagtgctgtatgacagcagctctgtgaacatcctgggcaagatcgccctgtggatcacctacggcaagggccagggccagggcgagagcctgcgggtgaagaagaaggccctgaccctgcagaagggcatggtgatggcctacaagaggaagcagctggtgatcaaggagaaggccatcctgatcagtgatgatgatgagcagaggaccttccaggatgaatatgagatcagcgagatggtgggctactgtgccgcccggtctgagggcctgctgcccagcttccacaccatcagccccaccctcttcaatgccagcagcaatgacatgaagctgaagccagagctgttcctgacccagcagttcctgagcggccacctgcccaagtatgagcaggtgcacatcctgcctgtgggccgcatcgaggagcccttctggcagaacttcaagcacctgcaggaggaggtgttccagaagatcaagaccctggcccagctgagcaaggatgtgcaggatgtgatgttctacagcatcctggccatgctgcgggacagaggagccctgcaggacctgatgaacatgctggagctggacagcagcggccacctggatggccctggaggagccatcctgaagaagctgcagcaggacagcaaccacgcctggttcaaccccaaggaccccatcctgtacctgctggaggccatcatggtgctgagtgacttccagcacgacctgctggcctgcagcatggagaagaggatcctgctgcagcagcaggagctggtgcgcagcatcctggagcccaacttccgctacccctggagcatccccttcaccctgaagccagagctgctggcccccctgcagagcgagggcctggccatcacctacggcctgctggaggagtgtggcctgaggatggagctggacaaccccaggagcacctgggatgtggaggccaagatgcccctgagcgccctgtatggcaccctgagcctgctgcagcagctggccgaggcctag

SEQ ID NO: 153579 - DNA, 462 bp, Artificial Sequence
  Description of Artificial Sequence: Synthetic coding sequence
atggtggccaccaagacctttgccctgctgctgctgagcctcttcctggccgtgggcctgggggagaagaaggagggccacttcagcgccctgcccagcctgcctgtgggcagccacgccaaggtgagcagcccccagccccggggccccaggtatgcagagggcaccttcatcagtgactacagcatcgccatggacaagatccaccagcaggactttgtgaactggctgctggcccagaagggcaagaagaatgactggaagcacaacatcacccagcgggaggcccgggccctggagctggccagccaggccaacaggaaggaggaggaggccgtggagccccagagcagccctgccaagaaccccagtgatgaggacctgctgcgggacctgctgatccaggagctgctggcctgcctgctggaccagaccaacctgtgccgcctgcggagcaggtag

SEQ ID NO: 153580 - DNA, 1401 bp, Artificial Sequence
  Description of Artificial Sequence: Synthetic coding sequence
atgaccaccagccccatcctgcagctgctgctgcggctgagcctgtgtggcctgctgctgcagagagctgagaccggcagcaagggccagacagctggggagctgtaccagcgctgggagcgctacagaagagagtgccaggagaccctggccgctgctgagcccccatctggcctggcctgcaatggcagctttgacatgtatgtgtgctgggactatgctgccccaaatgccacagcccgggccagctgcccctggtacctgccctggcaccaccacgtggccgccggctttgtgctgcggcagtgtggcagtgatggccagtggggcctgtggagggaccacacccagtgtgaaaatcctgagaagaatgaggccttcctggaccagaggctcatcctggagcggctgcaggtgatgtacacagtgggctacagcctgagcctggccaccctgctgctggccctgctgatcctgagcctcttccggcggctgcactgcaccaggaactacatccacatcaacctcttcaccagcttcatgctgcgggctgctgccatcctgagccgggaccggctgctgcccaggcctggcccctacctgggggaccaggccctggccctgtggaaccaggccctggccgcctgcaggacagcccagatcgtgacccagtactgtgtgggcgccaactacacctggctgctggtggagggcgtgtacctgcacagcctgctggtgctggtgggcggcagcgaggagggccacttccgctactacctgctgctgggctggggcgccccagccctcttcgtcatcccctgggtgattgtgcgctacctgtatgagaacacccagtgctgggagagaaatgaggtgaaggccatctggtggatcatccgcacccccatcctgatgaccatcctgatcaacttcctgatcttcatccgcatcctgggcatcctgctgagcaagctgcggacccggcagatgcgctgccgggactaccgcctgcggctggcccggagcaccctgaccctggtgcccctgctgggcgtgcatgaggtggtgtttgcccctgtgacagaggagcaggcccggggggccctgcgctttgccaagctgggctttgagatcttcctgagcagcttccagggcttcctggtgtctgtgctgtactgcttcatcaacaaggaggtgcagagcgagatccggcggggctggcaccactgccgcctgcggcgcagcctgggggaggagcagaggcagctgcctgagcgggccttccgggccctgcccagcggcagcggccctggagaggtgcccaccagccggggcctgagcagcggcaccctgcccggccctggaaatgaggccagccgggagctggagagctactgctag

SEQ ID NO: 153581 - DNA, 1293 bp, Artificial Sequence
  Description of Artificial Sequence: Synthetic coding sequence
atgaccaccagccccatcctgcagctgctgctgcggctgagcctgtgtggcctgctgctgcagagagctgagaccggcagcaagggccagacagctggggagctgtaccagcgctgggagcgctacagaagagagtgccaggagaccctggccgctgctgagcccccatctgtggccgccggctttgtgctgcggcagtgtggcagtgatggccagtggggcctgtggagggaccacacccagtgtgaaaatcctgagaagaatgaggccttcctggaccagaggctcatcctggagcggctgcaggtgatgtacacagtgggctacagcctgagcctggccaccctgctgctggccctgctgatcctgagcctcttccggcggctgcactgcaccaggaactacatccacatcaacctcttcaccagcttcatgctgcgggctgctgccatcctgagccgggaccggctgctgcccaggcctggcccctacctgggggaccaggccctggccctgtggaaccaggccctggccgcctgcaggacagcccagatcgtgacccagtactgtgtgggcgccaactacacctggctgctggtggagggcgtgtacctgcacagcctgctggtgctggtgggcggcagcgaggagggccacttccgctactacctgctgctgggctggggcgccccagccctcttcgtcatcccctgggtgattgtgcgctacctgtatgagaacacccagtgctgggagagaaatgaggtgaaggccatctggtggatcatccgcacccccatcctgatgaccatcctgatcaacttcctgatcttcatccgcatcctgggcatcctgctgagcaagctgcggacccggcagatgcgctgccgggactaccgcctgcggctggcccggagcaccctgaccctggtgcccctgctgggcgtgcatgaggtggtgtttgcccctgtgacagaggagcaggcccggggggccctgcgctttgccaagctgggctttgagatcttcctgagcagcttccagggcttcctggtgtctgtgctgtactgcttcatcaacaaggaggtgcagagcgagatccggcggggctggcaccactgccgcctgcggcgcagcctgggggaggagcagaggcagctgcctgagcgggccttccgggccctgcccagcggcagcggccctggagaggtgcccaccagccggggcctgagcagcggcaccctgcccggccctggaaatgaggccagccgggagctggagagctactgctag

SEQ ID NO: 153582 - DNA, 1401 bp, Artificial Sequence; identical to SEQ ID NO: 153580
  Description of Artificial Sequence: Synthetic coding sequence

SEQ ID NO: 153583 - DNA, 1254 bp, Artificial Sequence
  Description of Artificial Sequence: Synthetic coding sequence
atggcctggtttgccctgtacctgctgagcctgctgtgggccacagctggcaccagcacccagacccagagcagctgcagcgtgcccagcgcccaggagcccctggtgaatggcatccaggtgctgatggagaacagcgtgaccagcagcgcctaccccaaccccagcatcctgattgccatgaacctggccggggcctacaacctgaaggcccagaagctgctgacctaccagctgatgagcagtgacaacaatgacctgaccatcggccagctgggcctgaccatcatggccctgaccagcagctgccgggaccccggggacaaggtgtccatcctgcagaggcagatggagaactgggcccccagcagccccaatgctgaggccagcgccttctacggccccagcctggccatcctggccctgtgccagaagaacagcgaggccaccctgcccatcgctgtgcgctttgccaagaccctgctggccaacagcagccccttcaacgtggacaccggggccatggccaccctggccctgacctgcatgtacaacaagatccctgtgggcagcgaggagggctaccgcagcctgtttggccaggtgctgaaggacatcgtggagaagatctccatgaagatcaaggacaatggcatcatcggggacatctacagcacaggcctggccatgcaggccctgtctgtgaccccagagcccagcaagaaggagtggaactgcaagaagaccacagacatgatcctgaatgagatcaagcagggcaagttccacaaccccatgagcatcgcccagatcctgcccagcctgaagggcaagacctacctggatgtgccccaggtgacctgcagcccagaccacgaggtgcagcccaccctgcccagcaaccctggccctggccccaccagcgccagcaacatcaccgtcatctacaccatcaacaaccagctgcggggcgtggagctgctcttcaatgagaccatcaacgtgtctgtgaagagcggctctgtgctgctggtggtgctggaggaggcccagaggaagaaccccatgttcaagtttgagaccaccatgacctcctggggcctggtggtgagcagcatcaacaacattgctgaaaatgtgaaccacaagacctactggcagttcctgagcggcgtgacccccctgaatgaaggagtggccgactacatccccttcaaccacgagcacatcacagccaacttcacccagtactag

SEQ ID NO: 153584 - DNA, 1179 bp, Artificial Sequence
  Description of Artificial Sequence: Synthetic coding sequence
atggctgtgcccagcgcccaggagcccctggtgaatggcatccaggtgctgatggagaacagcgtgaccagcagcgcctaccccaaccccagcatcctgattgccatgaacctggccggggcctacaacctgaaggcccagaagctgctgacctaccagctgatgagcagtgacaacaatgacctgaccatcggccagctgggcctgaccatcatggccctgaccagcagctgccgggaccccggggacaaggtgtccatcctgcagaggcagatggagaactgggcccccagcagccccaatgctgaggccagcgccttctacggccccagcctggccatcctggccctgtgccagaagaacagcgaggccaccctgcccatcgctgtgcgctttgccaagaccctgctggccaacagcagccccttcaacgtggacacaggagccatggccaccctggccctgacctgcatgtacaacaagatccctgtgggcagcgaggagggctaccgcagcctgtttggccaggtgctgaaggacatcgtggagaagatctccatgaagatcaaggacaatggcatcattggagacatctacagcacaggcctggccatgcaggccctgtctgtgaccccagagcccagcaagaaggagtggaactgcaagaagaccacagacatgatcctgaatgagatcaagcagggcaagttccacaaccccatgagcatcgcccagatcctgcccagcctgaagggcaagacctacctggatgtgccccaggtgacctgcagcccagaccacgaggtgcagcccaccctgcccagcaaccctggccctggccccaccagcgccagcaacatcaccgtcatctacaccatcaacaaccagctgcggggcgtggagctgctcttcaatgagaccatcaacgtgtctgtgaagagcggctctgtgctgctggtggtgctggaggaggcccagaggaagaaccccatgttcaagtttgagaccaccatgacctcctggggcctggtggtgagcagcatcaacaacattgctgaaaatgtgaaccacaagacctactggcagttcctgtctggagtgacccccctgaatgaaggagtggccgactacatccccttcaaccacgagcacatcacagccaacttcacccagtactag

SEQ ID NO: 153585 - DNA, 306 bp, Artificial Sequence
  Description of Artificial Sequence: Synthetic coding sequence
atgcagaggctgtgtgtgtatgtgctgatctttgccctggccctggccgccttcagcgaggcctcctggaagcccaggagccagcagccagatgcccccctgggcaccggggccaacagagacctggagctgccctggctggagcagcagggccctgccagccaccaccggcggcagctgggcccccagggccccccccacctggtggccgaccccagcaagaagcagggcccctggctggaggaggaggaggaggcctacggctggatggactttggccgccgctctgcagaagatgagaactag

SEQ ID NO: 153586 - DNA, 447 bp, Artificial Sequence
  Description of Artificial Sequence: Synthetic coding sequence
atgaggggccgggagctgcccctggtgctgctggccctggtgctgtgcctggccccccggggccgggctgtgcccctgcctgctgggggcggcaccgtgctgaccaagatgtacccccggggcaaccactgggccgtgggccacctgatgggcaagaagagcactggagagagcagctctgtgtctgagcggggcagcctgaagcagcagctgcgggagtacatccgctgggaggaggccgccaggaacctgctgggcctcatcgaggccaaggagaacagaaaccaccagcccccccagcccaaggccctgggcaaccagcagcccagctgggacagcgaggacagcagcaacttcaaggatgtgggcagcaagggcaaggtgggccgcctgagcgcccctggcagccagcgggagggcaggaacccccagctgaaccagcagtag

SEQ ID NO: 153587 - DNA, 426 bp, Artificial Sequence
  Description of Artificial Sequence: Synthetic coding sequence
atgaggggccgggagctgcccctggtgctgctggccctggtgctgtgcctggccccccggggccgggctgtgcccctgcctgctgggggcggcaccgtgctgaccaagatgtacccccggggcaaccactgggccgtgggccacctgatgggcaagaagagcactggagagagcagctctgtgtctgagcggggcagcctgaagcagcagctgcgggagtacatccgctgggaggaggccgccaggaacctgctgggcctcatcgaggccaaggagaacagaaaccaccagcccccccagcccaaggccctgggcaaccagcagcccagctgggacagcgaggacagcagcaacttcaaggatgtgggcagcaagggcaagggcagccagcgggagggcaggaacccccagctgaaccagcagtag

SEQ ID NO: 153588 - DNA, 417 bp, Artificial Sequence
  Description of Artificial Sequence: Synthetic coding sequence
atgaggggccgggagctgcccctggtgctgctggccctggtgctgtgcctggccccccggggccgggctgtgcccctgcctgctgggggcggcaccgtgctgaccaagatgtacccccggggcaaccactgggccgtgggccacctgatgggcaagaagagcactggagagagcagctctgtgtctgagcggggcagcctgaagcagcagctgcgggagtacatccgctgggaggaggccgccaggaacctgctgggcctcatcgaggccaaggagaacagaaaccaccagcccccccagcccaaggccctgggcaaccagcagcccagctgggacagcgaggacagcagcaacttcaaggacctggtggacagcctgctgcaggtgctgaatgtgaaggagggcacccccagctag

SEQ ID NO: 153589 - DNA, 1155 bp, Artificial Sequence
  Description of Artificial Sequence: Synthetic coding sequence
atggccctgaatgactgcttcctgctgaacctggaggtggaccacttcatgcactgcaacatcagcagccacagcgctgacctgcctgtgaatgatgactggagccaccctggcatcctgtatgtgatcccagctgtgtatggagtcatcatcctgattggcctcatcggcaacatcaccctcatcaagatcttctgcaccgtgaagtccatgagaaatgtgcccaacctcttcatcagcagcctggccctgggggacctgctgctgctgatcacctgtgcccctgtggatgccagccgctacctggccgaccgctggctgtttggaagaattggctgcaagctgatccccttcatccagctgacctctgtgggcgtgtctgtgttcaccctgacagccctgtctgctgaccgctacaaggccatcgtgcggcccatggacatccaggccagccacgccctgatgaagatctgcctgaaggccgccttcatctggatcatctccatgctgctggccatccctgaggccgtgttcagtgacctgcaccccttccacgaggagagcaccaaccagaccttcatcagctgtgccccctacccccacagcaatgagctgcaccccaagatccacagcatggccagcttcctggtgttctacgtgatccccctgagcatcatctctgtgtactactacttcatcgccaagaacctgatccagagcgcctacaacctgcctgtggagggcaacatccacgtgaagaagcagatcgagagcaggaagaggctggccaagacagtgctggtgtttgtgggcctgtttgccttctgctggctgcccaaccacgtgatctacctgtaccgcagctaccactacagcgaggtggacacctccatgctgcactttgtgaccagcatctgtgcccggctgctggccttcaccaacagctgtgtgaacccctttgccctgtacctgctgagcaagagcttcaggaagcagttcaacacccagctgctgtgctgccagcccggcctcatcatccgcagccacagcacaggccgcagcaccacctgcatgaccagcctgaagagcaccaaccccagcgtggccaccttcagcctcatcaatggaaacatctgccacgagagatatgtgtag

SEQ ID NO: 153590 - DNA, 480 bp, Artificial Sequence
  Description of Artificial Sequence: Synthetic coding sequence
atggccagcttcctggtgttctacgtgatccccctgagcatcatctctgtgtactactacttcatcgccaagaacctgatccagagcgcctacaacctgcctgtggagggcaacatccacgtgaagaagcagatcgagagcaggaagaggctggccaagacagtgctggtgtttgtgggcctgtttgccttctgctggctgcccaaccacgtgatctacctgtaccgcagctaccactacagcgaggtggacacctccatgctgcactttgtgaccagcatctgtgcccggctgctggccttcaccaacagctgtgtgaacccctttgccctgtacctgctgtctgagttccaggagaccgtgcagcacagcgctgccctgctgcctgcctggccagaccaccctgtgtcccagcactggaaggagtacaacctgcatgacctgccccaggagtaccagcccctgcggggccacctgtag

SEQ ID NO: 153591 - DNA, 600 bp, Artificial Sequence
  Description of Artificial Sequence: Synthetic coding sequence
atgctggcctacagctctgtgcactgcttccgggaggacaagatgaagttcaccatcgtgtttgctggcctgctgggcgtcttcctggccccagccctggccaactacaacatcaacgtgaatgatgacaacaacaatgccggcagcggccagcagagcgtgtctgtgaacaatgagcacaacgtggccaacgtggacaacaacaacggctgggacagctggaacagcatctgggactatggaaatggatttgctgccaccaggctcttccagaagaagacctgcatcgtgcacaagatgaacaaggaggtgatgcccagcatccagagcctggatgccctggtgaaggagaagaagctgcagggcaaaggacctgggggccccccacccaagggcctgatgtacagcgtgaaccccaacaaggtggatgacctgagcaagtttgggaagaacatcgccaacatgtgccggggcatccccacctacatggccgaggagatgcaggaggccagcctcttcttctacagcggcacctgctacaccacctctgtgctgtggatcgtggacatctccttctgtggggacacagtggagaactag

SEQ ID NO: 153592 - DNA, 1092 bp, Artificial Sequence
  Description of Artificial Sequence: Synthetic coding sequence
atgcagagagctgggggcggcagcgcccctggaggaaatggaggcggcggcggcggcggccctggaacagccttcagcattgacagcctgattggccccccaccacccaggagcggccacctgctgtacacaggctaccccatgttcatgccctaccggcccctggtgctgccccaggccctggccccagcccccctgcctgctggcctgccccccctggcccccctggccagctttgctggccgcctgaccaacaccttctgtgccggcctgggccaggccgtgcccagcatggtggccctgaccacagccctgcccagctttgctgagcccccagatgccttctacggcccccaggagctggccgctgctgctgctgctgctgctgccacagctgccaggaacaaccctgagcccggcggccggcggcctgagggcggcctggaggctgatgagctgctgcctgcccgggagaaggtggccgagcccccacctcctcctccaccccacttcagcgagaccttccccagcctgcctgctgagggcaaggtgtacagcagtgatgaggagaagctggaggccagcgctggggaccctgctggcagcgagcaggaggaggagggcagcggcggggacagtgaagatgatggcttcctggacagcagcgctgggggccctggggccctgctgggccccaagcccaagctgaagggcagcctgggcaccggggctgaggagggcgcccctgtgacagctggggtgacagcccctgggggcaagagcagaagaagaagaacagccttcaccagcgagcagctgctggagctggagaaggagttccactgcaagaagtacctgagcctgacagagaggagccagatcgcccacgccctgaagctgtctgaggtgcaggtgaagatctggttccagaacagaagagccaagtggaagaggatcaaggctggaaatgtgagcagccgcagcggggagcctgtgaggaaccccaagatcgtggtgcccatccctgtgcacgtgaacagatttgctgtgcgcagccagcaccagcagatggagcagggcgcccggccctag

SEQ ID NO: 153593 - DNA, 1047 bp, Artificial Sequence
  Description of Artificial Sequence: Synthetic coding sequence
atgtctgctgccttcccccccagcctgatgatgatgcagaggcccctgggcagcagcacagccttcagcattgacagcctcatcggcagccccccccagcccagccctggccactttgtgtacacaggctaccccatgttcatgccctacagacctgtggtgctgcccccacctcctcctcctcctccagccctgccccaggccgccctgcagcctgccctgcccccagcccacccccaccaccagatccccagcctgcccaccggcttctgcagcagcctggcccagggcatggccctgaccagcaccctgatggccaccctgcccggcggcttcagcgccagcccccagcaccaggaggccgctgctgccaggaagtttgccccccagcccctgcccggcggcggcaactttgacaaggccgaggccctgcaggctgatgctgaagatggcaagggcttcctggccaaggagggcagcctgctggccttctctgctgctgagaccgtgcaggccagcctggtgggcgctgtgcggggccagggcaaggatgagagcaaggtggaggatgaccccaagggcaaggaggagagcttcagcctggagagtgatgtggactacagcagtgatgacaacctgaccggccaggccgcccacaaggaggaggaccccggccacgccctggaggagaccccacccagcagtggagctgctggcagcaccaccagcacaggcaagaacagaagaagaagaacagccttcaccagcgagcagctgctggagctggagaaggagttccactgcaagaagtacctgagcctgacagagaggagccagatcgcccacgccctgaagctgtctgaggtgcaggtgaagatctggttccagaacagaagagccaagtggaagagggtgaaggctggaaatgccaacagcaagacaggagagcccagcaggaaccccaagatcgtggtgcccatccctgtgcacgtgtccagatttgccatccgcagccagcaccagcagctggagcaggcccggccctag

SEQ ID NO: 153594 - DNA, 1443 bp, Artificial Sequence
  Description of Artificial Sequence: Synthetic coding sequence
atggaggtggcccctgagcagccccgctggatggcccaccctgctgtgctgaatgcccagcacccagacagccaccaccctggcctggcccacaactacatggagcccgcccagctgctgcccccagatgaggtggatgtgttcttcaaccacctggacagccagggcaacccctactatgccaacccagcccacgcccgggcccgggtgtcctacagccctgcccacgcccggctgaccggcggccagatgtgccggccccacctgctgcacagccctggcctgccctggctggatggcggcaaggccgccctgtctgctgctgctgcccaccaccacaacccctggacagtgagccccttcagcaagacccccctgcaccccagcgctgctgggggccctgggggccccctgtctgtgtacccaggggccggcggcggcagcggcggcggcagcggcagctctgtggccagcctgacccccacagctgcccacagcggcagccacctgtttggcttcccccccaccccacccaaggaggtgtccccagaccccagcaccaccggggccgccagccctgccagcagcagcgctgggggcagcgctgcccggggggaggacaaggatggagtgaagtaccaggtgtccctgacagagagcatgaagatggagagcggcagccccctgcggcccggcctggccaccatgggcacccagcctgccacccaccaccccatccccacctaccccagctatgtgcctgctgctgcccatgactacagcagcggcctcttccaccctgggggcttcctgggcggccctgccagcagcttcacccccaagcagaggagcaaggcccggagctgcagcgagggccgggagtgtgtgaactgtggggccacagccacccccctgtggaggagagatggcaccggccactacctgtgcaatgcctgtggcctgtaccacaagatgaatggccagaaccggcccctcatcaagcccaagaggcggctgtctgctgccaggagagctggcacctgctgtgccaactgccagaccaccaccaccaccctgtggaggagaaatgccaatggagaccctgtgtgcaatgcctgtggcctgtactacaagctgcacaacgtgaaccggcccctgaccatgaagaaggagggcatccagaccaggaacaggaagatgagcaacaagagcaagaagagcaagaagggagctgagtgctttgaggagctgagcaagtgcatgcaggagaagagcagccccttctctgctgctgccctggccggccacatggcccctgtgggccacctgccccccttcagccacagcggccacatcctgcccacccccacccccatccaccccagcagcagcctgagctttggccacccccaccccagctccatggtgacagccatgggctag

SEQ ID NO: 153595 - DNA, 1401 bp, Artificial Sequence
  Description of Artificial Sequence: Synthetic coding sequence
atggaggtggcccctgagcagccccgctggatggcccaccctgctgtgctgaatgcccagcacccagacagccaccaccctggcctggcccacaactacatggagcccgcccagctgctgcccccagatgaggtggatgtgttcttcaaccacctggacagccagggcaacccctactatgccaacccagcccacgcccgggcccgggtgtcctacagccctgcccacgcccggctgaccggcggccagatgtgccggccccacctgctgcacagccctggcctgccctggctggatggcggcaaggccgccctgtctgctgctgctgcccaccaccacaacccctggacagtgagccccttcagcaagacccccctgcaccccagcgctgctgggggccctgggggccccctgtctgtgtacccaggggccggcggcggcagcggcggcggcagcggcagctctgtggccagcctgacccccacagctgcccacagcggcagccacctgtttggcttcccccccaccccacccaaggaggtgtccccagaccccagcaccaccggggccgccagccctgccagcagcagcgctgggggcagcgctgcccggggggaggacaaggatggagtgaagtaccaggtgtccctgacagagagcatgaagatggagagcggcagccccctgcggcccggcctggccaccatgggcacccagcctgccacccaccaccccatccccacctaccccagctatgtgcctgctgctgcccatgactacagcagcggcctcttccaccctgggggcttcctgggcggccctgccagcagcttcacccccaagcagaggagcaaggcccggagctgcagcgagggccgggagtgtgtgaactgtggggccacagccacccccctgtggaggagagatggcaccggccactacctgtgcaatgcctgtggcctgtaccacaagatgaatggccagaaccggcccctcatcaagcccaagaggcggctgaccaccaccaccaccctgtggaggagaaatgccaatggagaccctgtgtgcaatgcctgtggcctgtactacaagctgcacaacgtgaaccggcccctgaccatgaagaaggagggcatccagaccaggaacaggaagatgagcaacaagagcaagaagagcaagaagggagctgagtgctttgaggagctgagcaagtgcatgcaggagaagagcagccccttctctgctgctgccctggccggccacatggcccctgtgggccacctgccccccttcagccacagcggccacatcctgcccacccccacccccatccaccccagcagcagcctgagctttggccacccccaccccagctccatggtgacagccatgggctag

SEQ ID NO: 153596 - DNA, 1443 bp, Artificial Sequence; identical to SEQ ID NO: 153594
  Description of Artificial Sequence: Synthetic coding sequence

SEQ ID NO: 153597 - DNA, 453 bp, Artificial Sequence
  Description of Artificial Sequence: Synthetic coding sequence
atggaggtggcccctgagcagccccgctggatggcccaccctgctgtgctgaatgcccagcacccagacagccaccaccctggcctggcccacaactacatggagcccgcccagctgctgcccccagatgaggtggatgtgttcttcaaccacctggacagccagggcaacccctactatgccaacccagcccacgcccgggcccgggtgtcctacagccctgcccacgcccggctgaccggcggccagatgtgccggccccacctgctgcacagccctggcctgccctggctggatggcggcaaggccgccctgtctgctgctgctgcccaccaccacaacccctggacagtgagccccttcagcaagacccccctgcaccccagcgctgctgggggccctgggggccccctgtctgtgtacccaggggccggcggcggcagcggcggctag

SEQ ID NO: 153598 - DNA, 27 bp, Artificial Sequence
  Description of Artificial Sequence: Synthetic coding sequence
atggaggtggcccctgagcagccctag

SEQ ID NO: 153599 - DNA, 1326 bp, Artificial Sequence
  Description of Artificial Sequence: Synthetic coding sequence
atgtaccagagcctgccctggccacccaccaccggccggccccctgtgcccaccaggagagctgccccagcccccagctgcacagcccgggccccccggccccggcagagcacctgcccccacagaggagccctgctgcgggccggccctgtgctgcccccaggaagaagaagaggcctgtgtgtgagaagagccagcggcggcagcagcggcggggccgccagcggggccggccctggcacccagcagggcagccctggctggagccaggccggggctgatggagctgcctacaccccacctcctgtgagcccccgcttctccttccctggcaccaccggcagcctggccgctgctgctgctgctgctgctgcccgggaggccgccgcctacagcagcggcggcggggccgccggggccggcctggccggccgggagcagtatggccgggccggctttgctggcagctacagcagcccctacccagcctacatggctgatgtgggcgcctcctgggccgctgctgctgctgccagcgctggcccctttgacagccctgtgctgcacagcctgcccggccgggccaacccagctgcccggcaccccaacctggacatgtttgatgacttcagcgagggcagagaatgtgtgaactgtggggccatgagcacccccctgtggaggagagatggcaccggccactacctgtgcaatgcctgtggcctgtaccacaagatgaatggcatcaaccggcccctcatcaagccccagaggcggctgagcgccagccggcgggtgggcctgagctgtgccaactgccagaccaccaccaccaccctgtggaggagaaatgctgagggggagcctgtgtgcaatgcctgtggcctgtacatgaagctgcatggagtgccccggcccctggccatgaggaaggagggcatccagaccaggaagaggaagcccaagaacctgaacaagagcaagaccccagctgcccccagcggcagcgagagcctgcccccagccagcggggccagcagcaacagcagcaatgccaccaccagcagcagcgaggagatgaggcccatcaagacagagcccggcctgagcagccactacggccacagcagctctgtgtcccagaccttctctgtgtctgccatgagcggccacggccccagcatccaccctgtgctgagcgccctgaagctgagcccccagggctacgccagccctgtgtcccagagcccccagaccagcagcaagcaggacagctggaacagcctggtgctggccgacagccatggagacatcatcacagcctag

SEQ ID NO: 153600 - DNA, 1329 bp, Artificial Sequence
  Description of Artificial Sequence: Synthetic coding sequence
atgtaccagagcctggccatggccgccaaccacggccccccacctggggcctatgaggccggcggccctggggccttcatgcacggggccggggccgccagcagccctgtgtatgtgcccaccccccgggtgcccagctctgtgctgggcctgagctacctgcagggcggcggggccggcagcgccagcggcggggccagcggcggcagcagtggaggagctgccagcggggccggccctggcacccagcagggcagccctggctggagccaggccggggctgatggagctgcctacaccccacctcctgtgagcccccgcttctccttccctggcaccaccggcagcctggccgctgctgctgctgctgctgctgcccgggaggccgccgcctacagcagcggcggcggcgctgctggagctggcctggccggccgggagcagtatggccgggccggctttgctggcagctacagcagcccctacccagcctacatggctgatgtgggcgcctcctgggccgctgctgctgctgccagcgctggcccctttgacagccctgtgctgcacagcctgcccggccgggccaacccagctgcccggcaccccaacctggacatgtttgatgacttcagcgagggccgggagtgtgtgaactgtggggccatgagcacccccctgtggaggagagatggcaccggccactacctgtgcaatgcctgtggcctgtaccacaagatgaatggcatcaaccggcccctcatcaagccccagaggcggctgagcgccagcagaagagtgggcctgagctgtgccaactgccagaccaccaccaccaccctgtggaggagaaatgctgagggggagcctgtgtgcaatgcctgtggcctgtacatgaagctgcacggcgtgccccggcccctggccatgaggaaggagggcatccagaccaggaagaggaagcccaagaacctgaacaagagcaagaccccagctgcccccagcggcagcgagagcctgcccccagccagcggggccagcagcaacagcagcaatgccaccaccagcagcagcgaggagatgaggcccatcaagacagagcccggcctgagcagccactacggccacagcagctctgtgtcccagaccttctctgtgtctgccatgagcggccacggccccagcatccaccctgtgctgagcgccctgaagctgagcccccagggctacgccagccctgtgtcccagagcccccagaccagcagcaagcaggacagctggaacagcctggtgctggccgacagccacggggacatcatcacagcctag

SEQ ID NO: 153601 - DNA, 528 bp, Artificial Sequence
  Description of Artificial Sequence: Synthetic coding sequence
atgtttgatgacttcagcgagggccgggagtgtgtgaactgtggggccatgagcacccccctgtggaggagagatggcaccggccactacctgtgcaatgcctgtggcctgtaccacaagatgaatggcatcaaccggcccctcatcaagccccagaggcggctgagcgccagcagaagagtgggcctgagctgtgccaactgccagaccaccaccaccaccctgtggaggagaaatgctgagggggagcctgtgtgcaatgcctgtggcctgtacatgaagctgcacggcgtgccccggcccctggccatgaggaaggagggcatccagaccaggaagaggaagcccaagaacctgaacaagagcaagaccccagctgcccccagcggcagcgagagcctgcccccagccagcggggccagcagcaacagcagcaatgccaccaccagcagcagcgaggagatgaggcccatcaagacagagcccggcctgagcagccactacggccacagcagctctgtgtcctag

SEQ ID NO: 153602 - DNA, 354 bp, Artificial Sequence
  Description of Artificial Sequence: Synthetic coding sequence
atgtaccagagcctggccatggccgccaaccacggccccccacctggggcctatgaggccggcggccctggggccttcatgcacggggccggggccgccagcagccctgtgtatgtgcccaccccccgggtgcccagctctgtgctgggcctgagctacctgcagggcggcggggccggcagcgccagcggcggggccagcggcggcagcagtggaggagctgccagcggggccggccctggcacccagcagggcagccctggctggagccaggccggggctgatggagctgcctacaccccacctcctgtgagcccccgcttctccttccctggcaccaccggcagcctgtag

SEQ ID NO: 153603 - DNA, 711 bp, Artificial Sequence
  Description of Artificial Sequence: Synthetic coding sequence
atgtttgatgacttcagcgagggccgggagtgtgtgaactgtggggccatgagcacccccctgtggaggagagatggcaccggccactacctgtgcaatgcctgtggcctgtaccacaagatgaatggcatcaaccggcccctcatcaagccccagaggcggctgagcgccagcagaagagtgggcctgagctgtgccaactgccagaccaccaccaccaccctgtggaggagaaatgctgagggggagcctgtgtgcaatgcctgtggcctgtacatgaagctgcacggcgtgccccggcccctggccatgaggaaggagggcatccagaccaggaagaggaagcccaagaacctgaacaagagcaagaccccagctgcccccagcggcagcgagagcctgcccccagccagcggggccagcagcaacagcagcaatgccaccaccagcagcagcgaggagatgaggcccatcaagacagagcccggcctgagcagccactacggccacagcagctctgtgtcccagaccttctctgtgtctgccatgagcggccacggccccagcatccaccctgtgctgagcgccctgaagctgagcccccagggctacgccagccctgtgtcccagagcccccagaccagcagcaagcaggacagctggaacagcctggtgctggccgacagccacggggacatcatcacagcctag

SEQ ID NO: 153604 - DNA, 1332 bp, Artificial Sequence
  Description of Artificial Sequence: Synthetic coding sequence
atgtaccagagcctggccatggccgccaaccacggccccccacctggggcctatgaggccggcggccctggggccttcatgcacggggccggggccgccagcagccctgtgtatgtgcccaccccccgggtgcccagctctgtgctgggcctgagctacctgcagggcggcggggccggcagcgccagcggcggggccagcggcggcagcagtggaggagctgccagcggggccggccctggcacccagcagggcagccctggctggagccaggccggggctgatggagctgcctacaccccacctcctgtgagcccccgcttctccttccctggcaccaccggcagcctggccgctgctgctgctgctgctgctgcccgggaggccgccgcctacagcagcggcggcggcgctgctggagctggcctggccggccgggagcagtatggccgggccggctttgctggcagctacagcagcccctacccagcctacatggctgatgtgggcgcctcctgggccgctgctgctgctgccagcgctggcccctttgacagccctgtgctgcacagcctgcccggccgggccaacccagctgcccggcaccccaacctggtggacatgtttgatgacttcagcgagggcagagaatgtgtgaactgtggggccatgagcacccccctgtggaggagagatggcaccggccactacctgtgcaatgcctgtggcctgtaccacaagatgaatggcatcaaccggcccctcatcaagccccagaggcggctgagcgccagccggcgggtgggcctgagctgtgccaactgccagaccaccaccaccaccctgtggaggagaaatgctgagggggagcctgtgtgcaatgcctgtggcctgtacatgaagctgcatggagtgccccggcccctggccatgaggaaggagggcatccagaccaggaagaggaagcccaagaacctgaacaagagcaagaccccagctgcccccagcggcagcgagagcctgcccccagccagcggggccagcagcaacagcagcaatgccaccaccagcagcagcgaggagatgaggcccatcaagacagagcccggcctgagcagccactacggccacagcagctctgtgtcccagaccttctctgtgtctgccatgagcggccacggccccagcatccaccctgtgctgagcgccctgaagctgagcccccagggctacgccagccctgtgtcccagagcccccagaccagcagcaagcaggacagctggaacagcctggtgctggccgacagccatggagacatcatcacagcctag

SEQ ID NO: 153605 - DNA, 1194 bp, Artificial Sequence
  Description of Artificial Sequence: Synthetic coding sequence
atgtaccagagcctggccctggccgccagcccccggcaggccgcctatgctgacagcggcagcttcctgcacgcccctggggccggcagccccatgtttgtgcccccagcccgggtgcccagcatgctgagctacctgagcggctgtgagcccagcccccagcccccagagctggccgcccggcccggctgggcccagacagccacagctgacagcagcgcctttggacctggcagcccccaccccccagctgcccaccccccaggggccacagccttcccctttgcccacagccccagcggccctggcagcggcggcagcgctgggggcagagatggcagcgcctaccagggcgccctgctgccccgggagcagtttgctgcccccctgggccggcctgtgggcaccagctacagcgccacctacccagcctacgtgtccccagatgtggcccagagctggacagctggcccctttgatggctctgtgctgcacggcctgcccggccggcggcccacctttgtgtctgacttcctggaggagttccctggagagggccgggagtgtgtgaactgtggggccctgagcacccccctgtggaggagagatggcaccggccactacctgtgcaatgcctgtggcctgtaccacaagatgaatggagtgaaccggcccctggtgcggccccagaagaggctgagcagcagcagaagagctggcctgtgctgcaccaactgccacaccaccaacaccaccctgtggaggaggaacagcgagggggagcctgtgtgcaatgcctgtggcctgtacatgaagctgcacggcgtgccccggcccctggccatgaagaaggagagcatccagaccaggaagaggaagcccaagaccatcgccaaggcccggggcagcagcggcagcaccagaaatgccagcgccagccccagcgctgtggccagcacagacagcagcgctgccaccagcaaggccaagcccagcctggccagccctgtgtgccccggccccagcatggccccccaggccagcggccaggaggatgacagcctggcccctggccacctggagttcaagtttgagccagaagattttgccttccccagcacagcccccagcccccaggccggcctgcggggggccctgcggcaggaggcctggtgtgccctggccctggcctag

SEQ ID NO: 153606 - DNA, 1194 bp, Artificial Sequence; identical to SEQ ID NO: 153605
  Description of Artificial Sequence: Synthetic coding sequence

SEQ ID NO: 153607 - DNA, 1254 bp, Artificial Sequence
  Description of Artificial Sequence: Synthetic coding sequence
acagccacagctgtgccctgcaggcctccctgccccctggtgaagaccaccccaggccgcatgtaccagagcctggccctggccgccagcccccggcaggccgcctatgctgacagcggcagcttcctgcacgcccctggggccggcagccccatgtttgtgcccccagcccgggtgcccagcatgctgagctacctgagcggctgtgagcccagcccccagcccccagagctggccgcccggcccggctgggcccagacagccacagctgacagcagcgcctttggacctggcagcccccaccccccagctgcccaccccccaggggccacagccttcccctttgcccacagccccagcggccctggcagcggcggcagcgctgggggcagagatggcagcgcctaccagggcgccctgctgccccgggagcagtttgctgcccccctgggccggcctgtgggcaccagctacagcgccacctacccagcctacgtgtccccagatgtggcccagagctggacagctggcccctttgatggctctgtgctgcacggcctgcccggccggcggcccacctttgtgtctgacttcctggaggagttccctggagagggccgggagtgtgtgaactgtggggccctgagcacccccctgtggaggagagatggcaccggccactacctgtgcaatgcctgtggcctgtaccacaagatgaatggagtgaaccggcccctggtgcggccccagaagaggctgagcagcagcagaagagctggcctgtgctgcaccaactgccacaccaccaacaccaccctgtggaggaggaacagcgagggggagcctgtgtgcaatgcctgtggcctgtacatgaagctgcacggcgtgccccggcccctggccatgaagaaggagagcatccagaccaggaagaggaagcccaagaccatcgccaaggcccggggcagcagcggcagcaccagaaatgccagcgccagccccagcgctgtggccagcacagacagcagcgctgccaccagcaaggccaagcccagcctggccagccctgtgtgccccggccccagcatggccccccaggccagcggccaggaggatgacagcctggcccctggccacctggagttcaagtttgagccagaagattttgccttccccagcacagcccccagcccccaggccggcctgcggggggccctgcggcaggaggcctggtgtgccctggccctggcctag

SEQ ID NO: 153608 - DNA, 1788 bp, Artificial Sequence
  Description of Artificial Sequence: Synthetic coding sequence
atggccctgacagatggcggctggtgcctgcccaagagatttggagctgctggagcagatgccagtgacagccgggccttccctgcccgggagcccagcaccccacccagccccatcagcagcagcagcagcagctgcagcagaggaggagagcggggccctgggggcgccagcaactgtggcaccccccagctggacacagaagctgctgctggccccccagcccggagcctgctgctgagcagctatgccagccacccctttggagccccccacggccccagcgcccctggggtggccggccctgggggcaacctgagctcctgggaggacctgctgctcttcacagacctggaccaggccgccacagccagcaagctgctgtggagcagcagaggagccaagctgagcccctttgcccctgagcagcctgaggagatgtaccagaccctggccgccctgagcagccagggccctgctgcctatgatggagcccctgggggctttgtgcacagcgctgctgctgctgctgctgctgctgctgctgccagcagccctgtgtatgtgcccaccaccagggtgggctccatgctgcccggcctgccctaccacctgcagggcagcggcagcggccctgccaaccacgccggcggggccggggcccaccctggctggccccaggccagcgctgacagccccccctacggcagcggcggcggggccgccggcggcggcgctgctggccctggaggagctggcagcgctgctgcccacgtgtctgcccgcttcccctacagccccagcccccccatggccaatggagctgcccgggagcccggcggctatgctgctgctggcagcggcggggccggcggcgtgtctgggggcggcagcagcctggccgccatgggcggccgggagccccagtacagcagcctgtctgctgcccggcccctgaatggcacctaccaccaccaccaccaccaccaccaccaccaccccagcccctacagcccctacgtgggcgcccccctgaccccagcctggccagctggcccctttgagacccctgtgctgcacagcctgcagagccgggccggggcccccctgcctgtgccccggggccccagcgctgacctgctggaggacctgtctgagagcagagaatgtgtgaactgtggcagcatccagacccccctgtggaggagagatggcaccggccactacctgtgcaatgcctgtggcctgtacagcaagatgaatggcctgagccggcccctcatcaagccccagaagagggtgcccagcagccggcggctgggcctgagctgtgccaactgccacaccaccaccaccaccctgtggaggagaaatgctgagggggagcctgtgtgcaatgcctgtggcctgtacatgaagctgcatggagtgccccggcccctggccatgaagaaggagggcatccagaccaggaagaggaagcccaagaacatcaacaagagcaagacctgcagcggcaacagcaacaacagcatccccatgacccccaccagcaccagcagcaacagtgatgactgcagcaagaacaccagccccaccacccagcccacagccagcggggccggggcccctgtgatgactggagctggggagagcaccaaccctgagaacagcgagctgaagtacagcggccaggacggcctgtacatcggcgtgtccctggccagccctgctgaggtgaccagctctgtgcggccagacagctggtgtgccctggccctggcctag

SEQ ID NO: 153609 - DNA, 8016 bp, Artificial Sequence
  Description of Artificial Sequence: Synthetic coding sequence
atggctgctgacacccaggtgtctgagaccctgaagagatttgctgggaaggtgaccacagcctctgtgaaggagcggcgggagatcctgtctgagctgggcaaatgtgtggccggcaaggacctgcctgagggcgctgtgaagggcctgtgcaagctgttctgcctgaccctgcaccgctacagagatgctgccagcagaagagccctgcaggccgccatccagcagctggccgaggcccagcctgaggccacagccaagaacctgctgcacagcctgcagagcagcggcatcggcagcaaggccggcgtgcccagcaagagcagcggcagcgctgccctgctggccctgacctggacctgcctgctggtgcgcatcgtgttccccagccgggccaagaggcagggcgacatctggaacaagctggtggaggtgcagtgcctgctgctgctggaggtgctgggcggcagccacaagcatgctgtggatggagctgtgaagaagctgaccaagctgtggaaggaaaatcctggcctggtggagcagtacctgagcgccatcctgagcctggagcccaaccagaactatgccggcatgctgggcctgctggtgcagttctgcaccagccacaaggagatggatgtggtgtcccagcacaagagcgccctgctggacttctacatgaagaacatcctgatgagcaaggtgaagccacccaagtacctgctggacagctgtgcccccctgctgcgctacctgagccacagcgagttcaaggacctgatcctgcccaccatccagaagagcctgctgcggagcccagaaaatgtcatcgagaccatcagcagcctgctggcctctgtgaccctggacctgagccagtatgccatggacatcgtgaagggcctggccggccacctgaagagcaacagcccccggctgatggatgaggccgtgctggccctgaggaacctggcccggcagtgcagcgacagcagcgccatggagagcctgaccaagcacctgtttgccatcctgggcggcagcgagggcaagctgactgtggtggcccagaagatgtctgtgctgagcggcatcggctctgtgagccaccacgtggtgtctggccccagcagccaggtgctgaatggaattgtggccgagctgttcatccccttcctgcagcaggaggtgcatgagggcaccctggtgcatgctgtgtctgtgctggccctgtggtgcaaccgcttcaccatggaggtgcccaagaagctgacagagtggttcaagaaggccttcagcctgaagaccagcaccagcgctgtgagacatgcctacctgcagtgcatgctggccagctacagaggagacaccctgctgcaggccctggacctgctgcccctgctgatccagacagtggagaaggccgccagccagagcacccaggtgcccaccatcacagaaggagtggccgccgccctgctgctgctgaagctgtctgtggccgacagccaggccgaggccaagctgagcagcttctggcagctgattgtggatgagaagaagcaggtgttcaccagcgagaagttcctggtgatggcctctgaagatgccctgtgcaccgtgctgcacctgacagagcggctcttcctggaccacccccaccggctgaccggcaacaaggtgcagcagtaccaccgggccctggtggccgtgctgctgagcaggacctggcacgtgcggcggcaggcccagcagacagtgaggaagctgctgagcagcctgggcggcttcaagctggcccacggcctgctggaggagctgaagacagtgctgagcagccacaaggtgctgcccctggaggccctggtgacagatgctggggaggtgacagaagctgggaaggcctacgtgcccccccgggtgctgcaggaggccctgtgtgtgatctctggagtgcccggcctgaagggagatgtgacagacacagagcagctggcccaggagatgctgatcatcagccaccaccccagcctggtggccgtgcagagcggcctgtggccagccctgctggccaggatgaagattgatcctgaggccttcatcaccaggcacctggaccagatcatccccaggatgaccacccagagccccctgaaccagagctccatgaatgccatgggcagcctgtctgtgctgagcccagacagagtgctgccccagctgatcagcaccatcacagcctctgtgcagaacccagccctgcggctggtgacccgggaggagtttgccatcatgcagaccccagctggggagctgtatgacaagagcatcatccagagcgcccagcaggacagcatcaagaaggccaacatgaagcgggagaacaaggcctacagcttcaaggagcagatcatcgagctggagctgaaggaggagatcaagaagaagaagggcatcaaggaggaggtgcagctgaccagcaagcagaaggagatgctgcaggcccagctggaccgggaggcccaggtgagaagaaggctgcaggagctggatggagagctggaggccgccctgggcctgctggacatcatcctggccaagaaccccagcggcctgacccagtacatccctgtgctggtggacagcttcctgcccctgctgaagagccccctggccgccccccgcatcaagaaccccttcctgagcctggccgcctgtgtgatgcccagccggctgaaggccctgggcaccctggtgagccacgtgaccctgcggctgctgaagccagaatgtgtgctggacaagtcctggtgccaggaggagctgtctgtggccgtgaagagagctgtgatgctgctgcacacccacaccatcaccagccgggtgggcaaaggagagcccggggccgcccccctgagcgccccagccttcagcctggtgttccccttcctgaagatggtgctgacagagatgccccaccacagcgaggaggaggaggagtggatggcccagatcctgcagatcctgactgtgcaggcccagctgcgggccagccccaacaccccacctggccgggtggatgaaaatggacctgagctgctgccccgggtggccatgctgcggctgctgacctgggtgattggcaccggcagcccccggctgcaggtgctggccagtgacaccctgaccaccctgtgtgccagcagcagtggagatgatggctgtgcctttgctgagcaggaggaggtggatgtgctgctgtgtgccctgcagagcccctgtgcctctgtgcgggagaccgtgctgcggggcctgatggagctgcacatggtgctgcctgccccagacacagatgagaagaatggcctgaacctgctgcggcggctgtgggtggtgaagtttgacaaggaggaggagatcaggaagctggccgagcggctgtggagcatgatgggcctggacctgcagcctgacctgtgcagcctgctgattgatgatgtgatctaccatgaagctgctgtgcggcaggccggggctgaggccctgagccaggccgtggcccgctaccagaggcaggccgctgaggtgatgggccgcctgatggagatctaccaggagaagctgtaccggcccccacctgtgctggatgccctgggccgggtcatcagcgagagccccccagaccagtgggaggcccgctgtggcctggccctggccctgaacaagctgagccagtacctggacagcagccaggtgaagcccctcttccagttctttgtgcctgatgccctgaatgacagacacccagatgtgaggaagtgcatgctggatgctgccctggccaccctgaacacccacggcaaggaaaatgtgaacagcctgctgcctgtgtttgaggagttcctgaagaatgccccaaatgatgccagctatgatgctgtgcggcagagcgtggtggtgctgatgggcagcctggccaagcacctggacaagagtgaccccaaggtgaagcccatcgtggccaagctgattgctgccctgagcacccccagccagcaggtgcaggagagcgtggccagctgcctgccccccctggtgcctgccatcaaggaggatgctgggggcatgatccagaggctgatgcagcagctgctggagagtgacaagtatgcagagaggaaaggagctgcctacggcctggccggcctggtgaagggcctgggcatcctgagcctgaagcagcaggagatgatggccgccctgacagatgccatccaggacaagaagaacttcagaagaagagaaggagccctgtttgcctttgagatgctgtgcaccatgctgggcaagctgtttgagccctacgtggtgcacgtgctgccccacctgctgctgtgctttggagatggcaaccagtatgtgcgggaggccgcagatgactgtgccaaggctgtgatgagcaacctgagcgcccatggagtgaagctggtgctgcccagcctgctggccgccctggaggaggagagctggaggaccaaggccggctctgtggagctgctgggcgccatggcctactgtgcccccaagcagctgagcagctgcctgcccaacatcgtgcccaagctgacagaggtgctgacagacagccacgtgaaggtgcagaaggccggccagcaggccctgcggcagatcggcagcgtcatccggaaccctgagatcctggccatcgcccctgtgctgctggatgccctgacagaccccagcaggaagacccagaagtgcctgcagaccctgctggacaccaagtttgtgcacttcattgatgcccccagcctggccctgatcatgcccatcgtgcagagggccttccaggacaggagcacagacaccaggaagatggccgcccagatcatcggcaacatgtacagcctgacagaccagaaggacctggccccctacctgcccagcgtgaccccaggcctgaaggccagcctgctggaccctgtgcctgaggtgaggacagtgtctgccaaggccctgggcgccatggtgaagggcatgggagagagctgctttgaggacctgctgccctggctgatggagaccctgacctatgagcagagctctgtggacagaagtggggccgcccagggcctggccgaggtgatggccggcctgggcgtggagaagctggagaagctgatgcctgagatcgtggccacagccagcaaggtggacatcgcccctcatgtgagagatggctacatcatgatgttcaactacctgcccatcacctttggagacaagttcaccccctacgtgggccccatcatcccctgcatcctgaaggccctggctgatgaaaatgaatttgtgcgggacacagccctgcgggccggccagagggtcatctccatgtatgcagagacagccatcgccctgctgctgccccagctggagcagggcctgtttgatgacctgtggaggatccgcttcagctctgtgcagctgctgggggacctgctcttccacatctctggagtgacaggcaagatgaccacagaaacagcctctgaagatgacaactttggaacagcccagagcaacaaggccatcatcacagccctgggcgtggagaggaggaacagagtgctggccggcctgtacatgggccgcagtgacacccagctggtggtgcggcaggccagcctgcacgtgtggaagatcgtggtgagcaacacccccaggaccctgcgggagatcctgcccaccctgtttggcctgctgctgggcttcctggccagcacctgtgccgacaagaggaccatcgccgcccggaccctgggggacctggtgaggaagctgggggagaagatcctgcctgagatcatccccatcctggaggagggcctgcggagccagaagagtgatgagcggcagggcgtgtgcatcggcctgtctgagatcatgaagagcaccagcagagatgctgtgctgtacttcagcgagagcctggtgcccacagccaggaaggccctgtgtgaccccctggaggaggtgcgggaggccgccgccaagacctttgagcagctgcacagcaccatcggccaccaggccctggaggacatcctgcccttcctgctgaagcagctggatgatgaggaggtgtctgaatttgccctggatggcctgaagcaggtgatggccatcaagagccgggtggtgctgccctacctggtgcccaagctgaccaccccacctgtgaacaccagggtgctggccttcctgagctctgtggccggagatgccctgaccaggcacctgggcgtcatcctgcctgctgtgatgctggccctgaaggagaagctgggcaccccagatgagcagctggagatggccaactgccaggccgtcatcctgtctgtggaggatgacaccggccaccgcatcatcatcgagtacctgctggaggccaccaggagccctgaggtgggcatgaggcaggccgccgccatcatcctgaacatctactgcagccgcagcaaggctgactacaccagccacctgcggagcctggtgtctggcctcatccgcctcttcaatgacagcagccctgtggtgctggaggagagctgggatgccctgaatgccatcaccaagaagctggatgctggcaaccagctggccctgattgaggagctgcacaaggagatccggctgattggaaatgaaagcaaaggagagcacgtgcccggcttctgcctgcccaagaagggcgtgaccagcatcctgcctgtgctgcgggagggcgtgctgaccggcagccctgagcagaaggaggaggccgccaaggccctgggcctggtgatccggctgaccagcgcagatgccctgcggcccagcgtggtgtccatcaccggccccctcatccgcatcctgggggaccgcttctcctggaatgtgaaggccgccctgctggagaccctgagcctgctgctggccaaggtgggcatcgccctgaagcccttcctgccccagctgcagaccaccttcaccaaggccctgcaggacagcaacagaggagtgcggctgaaggccgcagatgccctgggcaagctgatcagcatccacatcaaggtggaccccctcttcacagagctgctgaatggcatccgggccatggaggaccccggggtgcgggacaccatgctgcaggccctgcgcttcgtcatccagggcgctggggccaaggtggatgctgtgatcaggaagaacatcgtgtccctgctgctgtccatgctgggccatgatgaggacaacacccgcatcagcagcgctggctgcctgggggagctgtgtgccttcctgacagaggaggagctgtctgctgtgctgcagcagtgcctgctggctgatgtgtctggaattgactggatggtgagacatggccgcagcctggccctgtctgtggccgtgaatgtggcccctggccgcctgtgtgccggccgctacagcagtgatgtgcaggagatgatcctgagcagcgccacagctgaccgcatccccatcgctgtgtctggagtgcggggcatgggcttcctgatgaggcaccacatcgagaccggcggcggccagctgcctgccaagctgagcagcctgtttgtgaagtgcctgcagaaccccagcagtgacatccggctggtggccgagaagatgatctggtgggccaacaaggaccccctgccccccctggacccccaggccatcaagcccatcctgaaggccctgctggacaacaccaaggacaagaacacagtggtgcgggcctacagcgaccaggccatcgtgaacctgctgaagatgaggcagggcgaggaggtgttccagagcctgagcaagatcctggatgtggccagcctggaggtgctgaatgaggtgaacagaagaagcctgaagaagctggccagccaggccgacagcacagagcaggtggatgacaccatcctgacctag

SEQ ID NO: 153610 - DNA, 1443 bp, Artificial Sequence
  Description of Artificial Sequence: Synthetic coding sequence
atggcccagcacgactttgccccagcctggctgaacttccccaccccacccagcagcaccaaggtgctgaccagcagcctgaagagcagcctgaactttgagaagcacagcgagaactttgcctggacagagaacagatatgatgtgaacagaagaagacacaacagcagtgatggctttgacagcgccatcggccggcccaacggcggcaactttggaaggaaggagaagaatggctggaggacccatggaagaaatggaacagagaacatcaaccacagaggaggctaccacggcggcagcagccgcagccgcagcagcatcttccacgccggcaagagccagggcctgcacgagaacaacatcccagacaatgaaacaggcaggaaagaagacaagcgggagaggaagcagtttgaagctgaggacttccccagcctgaacccagaatatgagcgggagcccaaccacaacaagagcctggccgccggcgtgtgggagtacccacccaaccccaagagccgggcccccaggatgctggtgatcaagaagggcaacaccaaggacctgcagctgagcggcttccctgtggtgggcaacctgcccagccagcctgtgaagaatggcaccggccccagcgtgtacaagggcctggtgcccaagccagctgccccacccaccaagcccacccagtggaagagccagaccaaggagaacaaggtgggcaccagcttcccccatgagagcacctttggagtgggcaacttcaatgccttcaagagcacagccaagaacttcagccccagcaccaacagcgtgaaggagtgcaacagaagcaacagcagcagccctgtggacaagctgaaccagcagccccggctgaccaagctgaccaggatgaggacagacaagaagtctgagttcctgaaggccctgaagagggacagagtggaggaggagcatgaagatgagagcagagctggcagcgagaaggatgatgacagcttcaacctgcacaacagcaacagcacccaccaggagcgggacatcaacagaaactttgatgaaaatgagatcccccaggagaatggaaatgccagcgtcatcagccagcagatcatccgcagcagcaccttcccccagacagatgtgctgagcagcagcctggaggccgagcaccggctgctgaaggagatgggctggcaggaggacagtgaaaatgatgagacctgtgcccccctgacagaagatgagatgagggagttccaggtgatcagcgagcagctgcagaagaatggcctgaggaagaatggcatcctgaagaatggcctcatctgtgacttcaagtttggcccctggaagaacagcaccttcaagcccaccacagaaaatgatgacacagagaccagcagcagtgacaccagtgatgatgatgatgtgtag

SEQ ID NO: 153611 - DNA, 1482 bp, Artificial Sequence
  Description of Artificial Sequence: Synthetic coding sequence
atggcccagcacgactttgccccagcctggctgaacttccccaccccacccagcagcaccaagagcagcctgaactttgagaagcacagtgaaaattttgcctggacagaaaatagatatgatgtgaacagaagaagacacaacagcagtgatggctttgattctgccatcggccggcccaatggaggcaactttggaaggaaggagaagaatggctggaggacccacggcagaaatggaacagagaacatcaaccaccggggcggctaccatggaggcagcagccgcagccgcagcagcatcttccacgccggcaagagccagggcctgcacgagaacaacatcccagacaatgagaccggcaggaaggaggacaagcgggagaggaagcagtttgaagctgaggacttccccagcctgaacccagaatatgaaagagagcccaaccacaacaagagcctggccgccggcgtgtggggcctgcacgcccagacccacacctaccccaccaagaagatcagccaggcccccctgctggagtacccacccaaccccaagagccgggcccccaggatgctggtgatcaagaagggcaacaccaaggacctgcagctgagcggcttccctgtggtgggcaacctgcccagccagcctgtgaagaatggaacaggccccagcgtgtacaagggcctggtgcccaagccagctgccccacccaccaagcccacccagtggaagagccagaccaaggagaacaaggtgggcaccagcttcccccatgagagcaccttcggcgtgggcaacttcaatgccttcaagagcacagccaagaacttcagccccagcaccaacagcgtgaaggagtgcaacagaagcaacagcagcagccctgtggacaagctgaaccagcagccccggctgaccaagctgaccaggatgaggacagacaagaagtctgagttcctgaaggccctgaagagggacagagtggaggaggagcatgaagatgagagccgggccggcagcgagaaggatgatgacagcttcaacctgcacaacagcaacagcacccaccaggagcgggacatcaacagaaactttgatgaaaatgagatcccccaggagaatggaaatgccagcgtcatcagccagcagatcatccgcagcagcaccttcccccagacagatgtgctgagcagcagcctggaggccgagcaccggctgctgaaggagatgggctggcaggaggacagtgaaaatgatgagacctgtgcccccctgacagaagatgagatgagggagttccaggtgatcagcgagcagctgcagaagaatggcctgaggaagaatggcatcctgaagaatggcctcatctgtgacttcaagtttggcccctggaagaacagcaccttcaagcccaccacagaaaatgatgacacagagaccagcagcagtgacaccagtgatgatgatgatgtgtag

SEQ ID NO: 153612 - DNA, 1482 bp, Artificial Sequence; identical to SEQ ID NO: 153611
  Description of Artificial Sequence: Synthetic coding sequence

SEQ ID NO: 153613 - DNA, 1422 bp, Artificial Sequence
  Description of Artificial Sequence: Synthetic coding sequence
atggcccagcacgactttgccccagcctggctgaacttccccaccccacccagcagcaccaagagcagcctgaactttgagaagcacagtgaaaattttgcctggacagaaaatagatatgatgtgaacagaagaagacacaacagcagtgatggctttgattctgccatcggccggcccaatggaggcaactttggaaggaaggagaagaatggctggaggacccacggcagaaatggaacagagaacatcaaccaccggggcggctaccatggaggcagcagccgcagccgcagcagcatcttccacgccggcaagagccagggcctgcacgagaacaacatcccagacaatgagaccggcaggaaggaggacaagcgggagaggaagcagtttgaagctgaggacttccccagcctgaacccagaatatgaaagagagcccaaccacaacaagagcctggccgccggcgtgtgggagtacccacccaaccccaagagccgggcccccaggatgctggtgatcaagaagggcaacaccaaggacctgcagctgagcggcttccctgtggtgggcaacctgcccagccagcctgtgaagaatggaacaggccccagcgtgtacaagggcctggtgcccaagccagctgccccacccaccaagcccacccagtggaagagccagaccaaggagaacaaggtgggcaccagcttcccccatgagagcaccttcggcgtgggcaacttcaatgccttcaagagcacagccaagaacttcagccccagcaccaacagcgtgaaggagtgcaacagaagcaacagcagcagccctgtggacaagctgaaccagcagccccggctgaccaagctgaccaggatgaggacagacaagaagtctgagttcctgaaggccctgaagagggacagagtggaggaggagcatgaagatgagagccgggccggcagcgagaaggatgatgacagcttcaacctgcacaacagcaacagcacccaccaggagcgggacatcaacagaaactttgatgaaaatgagatcccccaggagaatggaaatgccagcgtcatcagccagcagatcatccgcagcagcaccttcccccagacagatgtgctgagcagcagcctggaggccgagcaccggctgctgaaggagatgggctggcaggaggacagtgaaaatgatgagacctgtgcccccctgacagaagatgagatgagggagttccaggtgatcagcgagcagctgcagaagaatggcctgaggaagaatggcatcctgaagaatggcctcatctgtgacttcaagtttggcccctggaagaacagcaccttcaagcccaccacagaaaatgatgacacagagaccagcagcagtgacaccagtgatgatgatgatgtgtag

SEQ ID NO: 153614 - DNA, 1398 bp, Artificial Sequence
  Description of Artificial Sequence: Synthetic coding sequence
atggcccagcacgactttgccccagcctggctgaacttccccaccccacccagcagcaccaaggtgctgaccagcagcctgaagagcagcctgaactttgagaagcacagcgagaactttgcctggacagagaacagatatgatgtgaacagaagaagacacaacagcagtgatggctttgacagcgccatcggccggcccaacggcggcaactttggaaggaaggagaagaatggctggaggacccatggaagaaatggaacagagaacatcaaccacagaggaggctaccacggcggcagcagccgcagccgcagcagcatcttccacgccggcaagagccagggcctgcacgagaacaacatcccagacaatgaaacaggcaggaaagaagacaagcgggagaggaagcagtttgaagctgaggacttccccagcctgaacccagaatatgagcgggagcccaaccacaacaagagcctggccgccggcgtgtgggagtacccacccaaccccaagagccgggcccccaggatgctggtgatcaagaagggcaacaccaaggacctgcagctgagcggcttccctgtggtgggcaacctgcccagccagcctgtgaagaatggcaccggccccagcgtgtacaagggcctggtgcccaagccagctgccccacccaccaagcccacccagtggaagagccagaccaaggagaacaaggtgggcaccagcttcccccatgagagcacctttggagtgggcaacttcaatgccttcaagagcacagccaagaacttcagccccagcaccaacagcgtgaaggagcagccccggctgaccaagctgaccaggatgaggacagacaagaagtctgagttcctgaaggccctgaagagggacagagtggaggaggagcatgaagatgagagccgggccggcagcgagaaggatgatgacagcttcaacctgcacaacagcaacagcacccaccaggagcgggacatcaacagaaactttgatgaaaatgagatcccccaggagaatggaaatgccagcgtcatcagccagcagatcatccgcagcagcaccttcccccagacagatgtgctgagcagcagcctggaggccgagcaccggctgctgaaggagatgggctggcaggaggacagtgaaaatgatgagacctgtgcccccctgacagaagatgagatgagggagttccaggtgatcagcgagcagctgcagaagaatggcctgaggaagaatggcatcctgaagaatggcctcatctgtgacttcaagtttggcccctggaagaacagcaccttcaagcccaccacagaaaatgatgacacagagaccagcagcagtgacaccagtgatgatgatgatgtgtag

SEQ ID NO: 153615 - DNA, 909 bp, Artificial Sequence
  Description of Artificial Sequence: Synthetic coding sequence
atgctggtgatcaagaagggcaacaccaaggacctgcagctgagcggcttccctgtggtgggcaacctgcccagccagcctgtgaagaatggcaccggccccagcgtgtacaagggcctggtgcccaagccagctgccccacccaccaagcccacccagtggaagagccagaccaaggagaacaaggtgggcaccagcttcccccatgagagcacctttggagtgggcaacttcaatgccttcaagagcacagccaagaacttcagccccagcaccaacagcgtgaaggagtgcaacagaagcaacagcagcagccctgtggacaagctgaaccagcagccccggctgaccaagctgaccaggatgaggacagacaagaagtctgagttcctgaaggccctgaagagggacagagtggaggaggagcatgaagatgagagcagagctggcagcgagaaggatgatgacagcttcaacctgcacaacagcaacagcacccaccaggagcgggacatcaacagaaactttgatgaaaatgagatcccccaggagaatggaaatgccagcgtcatcagccagcagatcatccgcagcagcaccttcccccagacagatgtgctgagcagcagcctggaggccgagcaccggctgctgaaggagatgggctggcaggaggacagtgaaaatgatgagacctgtgcccccctgacagaagatgagatgagggagttccaggtgatcagcgagcagctgcagaagaatggcctgaggaagaatggcatcctgaagaatggcctcatctgtgacttcaagtttggcccctggaagaacagcaccttcaagcccaccacagaaaatgatgacacagagaccagcagcagtgacaccagtgatgatgatgatgtgtag

SEQ ID NO: 153616 - DNA, 1443 bp, Artificial Sequence
  Description of Artificial Sequence: Synthetic coding sequence
atggcccagcacgactttgccccagcctggctgaacttccccaccccacccagcagcaccaaggtgctgagcaacaccctgaagagcagcctgaactttgagaagcacagcgagaactttgcctggacagagaacagatatgatgtgaacagaagaagacacaacagcagtgatggctttgacagcgccatcggccggcccaacggcggcaactttggaaggaaggagaagaatggctggaggacccatggaagaaatggaacagagaacatcaaccacagaggaggctaccacggcggcagcagccgcagccgcagcagcatcttccacgccggcaagagccagggcctgcacgagaacaacatcccagacaatgaaacaggcaggaaagaagacaagcgggagaggaagcagtttgaagctgaggacttccccagcctgaacccagaatatgagcgggagcccaaccacaacaagagcctggccgccggcgtgtgggagtacccacccaaccccaagagccgggcccccaggatgctggtgatcaagaagggcaacaccaaggacctgcagctgagcggcttccctgtggtgggcaacctgcccagccagcctgtgaagaatggcaccggccccagcgtgtacaagggcctggtgcccaagccagctgccccacccaccaagcccacccagtggaagagccagaccaaggagaacaaggtgggcaccagcttcccccatgagagcacctttggagtgggcaacttcaatgccttcaagagcacagccaagaacttcagccccagcaccaacagcgtgaaggagtgcaacagaagcaacagcagcagccctgtggacaagctgaaccagcagccccggctgaccaagctgaccaggatgaggacagacaagaagtctgagttcctgaaggccctgaagagggacagagtggaggaggagcatgaagatgagagcagagctggcagcgagaaggatgatgacagcttcaacctgcacaacagcaacagcacccaccaggagcgggacatcaacagaaactttgatgaaaatgagatcccccaggagaatggaaatgccagcgtcatcagccagcagatcatccgcagcagcaccttcccccagacagatgtgctgagcagcagcctggaggccgagcaccggctgctgaaggagatgggctggcaggaggacagtgaaaatgatgagacctgtgcccccctgacagaagatgagatgagggagttccaggtgatcagcgagcagctgcagaagaatggcctgaggaagaatggcatcctgaagaatggcctcatctgtgacttcaagtttggcccctggaagaacagcaccttcaagcccaccacagaaaatgatgacacagagaccagcagcagtgacaccagtgatgatgatgatgtgtag

SEQ ID NO: 153617 - DNA, 1383 bp, Artificial Sequence
  Description of Artificial Sequence: Synthetic coding sequence
atgttcctggccaccctgtactttgccctgcccctgctggacctgctgctgtctgctgaggtgtctggaggagaccggctggactgtgtgaaggccagtgaccagtgcctgaaggagcagagctgcagcaccaagtaccgcaccctgcggcagtgtgtggccggcaaggagaccaacttcagcctggccagcggcctggaggccaaggatgaatgtcgcagcgccatggaggccctgaagcagaagagcctgtacaactgccgctgcaagaggggcatgaagaaggagaagaactgcctgcgcatctactggagcatgtaccagagcctgcagggcaatgacctgctggaggacagcccctatgagcctgtgaacagccggctgagtgacatcttccgggtggtgcccttcatctctgtggagcacatccccaagggcaacaactgcctggatgctgccaaggcctgcaacctggatgacatctgcaagaagtacagaagtgcctacatcaccccctgcaccacctctgtgtccaatgatgtgtgcaacagaaggaagtgccacaaggccctgcggcagttctttgacaaggtgcctgccaagcacagctatggcatgctgttctgcagctgccgggacatcgcctgcacagaaagaagacggcagaccatcgtgcctgtgtgcagctatgaggagcgggagaagcccaactgcctgaacctgcaggacagctgcaagaccaactacatctgccgcagccggctggccgacttcttcaccaactgccagcctgagagccgctctgtgagcagctgcctgaaggaaaattatgctgactgcctgctggcctacagcggcctcatcggcaccgtgatgacccccaactacatcgacagcagcagcctgtctgtggccccctggtgtgactgcagcaacagcggaaatgacctggaggagtgcctgaagttcctgaacttcttcaaggacaacacctgcctgaagaatgccatccaggcctttggaaatggaagtgatgtgacagtgtggcagcctgccttccctgtgcagaccaccacagccaccaccaccacagccctgcgggtgaagaacaagcccctgggccctgctggctctgaaaatgagatccccacccacgtgctgcccccctgtgccaacctgcaggcccagaagctgaagagcaatgtgtctggcaacacccacctgtgcatcagcaatggaaattatgagaaggagggcctgggcgccagcagccacatcaccaccaagtccatggccgccccacccagctgtggcctgagccccctgctggtgctggtggtgacagccctgagcaccctgctgagcctgacagagaccagctag

SEQ ID NO: 153618 - DNA, 1383 bp, Artificial Sequence; identical to SEQ ID NO: 153617
  Description of Artificial Sequence: Synthetic coding sequence

SEQ ID NO: 153619 - DNA, 1383 bp, Artificial Sequence; identical to SEQ ID NO: 153617
  Description of Artificial Sequence: Synthetic coding sequence

SEQ ID NO: 153620 - DNA, 1398 bp, Artificial Sequence
  Description of Artificial Sequence: Synthetic coding sequence
atgttcctggccaccctgtactttgccctgcccctgctggacctgctgctgtctgctgaggtgtctggaggagaccggctggactgtgtgaaggccagtgaccagtgcctgaaggagcagagctgcagcaccaagtaccgcaccctgcggcagtgtgtggccggcaaggagaccaacttcagcctggccagcggcctggaggccaaggatgaatgtcgcagcgccatggaggccctgaagcagaagagcctgtacaactgccgctgcaagaggggcatgaagaaggagaagaactgcctgcgcatctactggagcatgtaccagagcctgcagggcaatgacctgctggaggacagcccctatgagcctgtgaacagccggctgagtgacatcttccgggtggtgcccttcatcagtgatgtgttccagcaggtggagcacatccccaagggcaacaactgcctggatgctgccaaggcctgcaacctggatgacatctgcaagaagtaccgcagcgcctacatcaccccctgcaccacctctgtgtccaatgatgtgtgcaacagaaggaagtgccacaaggccctgcggcagttctttgacaaggtgcctgccaagcacagctatggcatgctgttctgcagctgccgggacatcgcctgcacagagcggcggcggcagaccatcgtgcctgtgtgcagctatgaggagcgggagaagcccaactgcctgaacctgcaggacagctgcaagaccaactacatctgccgcagccggctggccgacttcttcaccaactgccagcctgagagccgctctgtgagcagctgcctgaaggagaactatgctgactgcctgctggcctacagcggcctgattggaacagtgatgacccccaactacatcgacagcagcagcctgtctgtggccccctggtgtgactgcagcaacagcggaaatgacctggaggagtgcctgaagttcctgaacttcttcaaggacaacacctgcctgaagaatgccatccaggcctttggaaatggaagtgatgtgacagtgtggcagcctgccttccctgtgcagaccaccacagccaccaccaccacagccctgcgggtgaagaacaagcccctgggccctgctggctctgaaaatgagatccccacccacgtgctgcccccctgtgccaacctgcaggcccagaagctgaagagcaatgtgtctggcaacacccacctgtgcatcagcaatggaaattatgagaaggagggcctgggcgccagcagccacatcaccaccaagtccatggccgccccacccagctgtggcctgagccccctgctggtgctggtggtgacagccctgagcaccctgctgagcctgacagagaccagctag

SEQ ID NO: 153621 - DNA, 1035 bp, Artificial Sequence
  Description of Artificial Sequence: Synthetic coding sequence
atgcaggagggcaagttctggaagggcatggccgagaccggcatgtggggctgtggggagtggatccctgtggagcacatccccaagggcaacaactgcctggatgctgccaaggcctgcaacctggatgacatctgcaagaagtacagaagtgcctacatcaccccctgcaccacctctgtgtccaatgatgtgtgcaacagaaggaagtgccacaaggccctgcggcagttctttgacaaggtgcctgccaagcacagctatggcatgctgttctgcagctgccgggacatcgcctgcacagaaagaagacggcagaccatcgtgcctgtgtgcagctatgaggagcgggagaagcccaactgcctgaacctgcaggacagctgcaagaccaactacatctgccgcagccggctggccgacttcttcaccaactgccagcctgagagccgctctgtgagcagctgcctgaaggaaaattatgctgactgcctgctggcctacagcggcctcatcggcaccgtgatgacccccaactacatcgacagcagcagcctgtctgtggccccctggtgtgactgcagcaacagcggaaatgacctggaggagtgcctgaagttcctgaacttcttcaaggacaacacctgcctgaagaatgccatccaggcctttggaaatggaagtgatgtgacagtgtggcagcctgccttccctgtgcagaccaccacagccaccaccaccacagccctgcgggtgaagaacaagcccctgggccctgctggctctgaaaatgagatccccacccacgtgctgcccccctgtgccaacctgcaggcccagaagctgaagagcaatgtgtctggcaacacccacctgtgcatcagcaatggaaattatgagaaggagggcctgggcgccagcagccacatcaccaccaagtccatggccgccccacccagctgtggcctgagccccctgctggtgctggtggtgacagccctgagcaccctgctgagcctgacagagaccagctag

SEQ ID NO: 153622 - DNA, 1080 bp, Artificial Sequence
  Description of Artificial Sequence: Synthetic coding sequence
atgatcctggccaacgtgttctgcctcttcttcttcctgggggaggagttctatgaggccagcccctatgagcctgtgaccagccggctgagtgacatcttccggctggccagcatcttctctggaactggagctgaccctgtggtgtctgccaagagcaaccactgcctggatgctgccaaggcctgcaacctgaatgacaactgcaagaagctgcggagcagctacatcagcatctgcaaccgggagatcagccccacagagcgctgcaacagaaggaagtgccacaaggccctgcggcagttctttgacagagtgcccagcgagtacacctacaggatgctgttctgcagctgccaggaccaggcctgtgccgagcggcggcggcagaccatcctgcccagctgcagctatgaggacaaggagaagcccaactgcctggacctgcggggcgtgtgcaggacagaccacctgtgccgcagccggctggccgacttccacgccaactgccgggccagctaccagacagtgaccagctgcccagctgacaactaccaggcctgcctgggcagctatgccggcatgattggatttgacatgacccccaactacgtggacagcagccccaccggcatcgtggtgagcccctggtgcagctgccggggcagcggcaacatggaggaggagtgtgagaagttcctgcgggacttcacagagaacccctgcctgagaaatgccatccaggcctttggaaatggaacagatgtgaatgtgagccccaagggccccagcttccaggccacccaggccccccgggtggagaagacccccagcctgcctgatgacctgagtgacagcaccagcctgggcaccagcgtcatcaccacctgcacctctgtgcaggagcagggcctgaaggccaacaacagcaaggagctgtccatgtgcttcacagagctgaccaccaacatcatccctggcagcaacaaggtgatcaagcccaacagcggccccagccgggcccggcccagcgctgccctgactgtgctgtctgtgctgatgctgaagctggccctgtag

SEQ ID NO: 153623 - DNA, 1395 bp, Artificial Sequence
  Description of Artificial Sequence: Synthetic coding sequence
atgatcctggccaacgtgttctgcctcttcttcttcctggatgagaccctgcggagcctggccagccccagcagcctgcagggccctgagctgcacggctggaggcctcctgtggactgtgtgcgggccaatgagctgtgtgccgctgagagcaactgcagcagccgctaccgcaccctgcggcagtgcctggccggccgggacaggaacaccatgctggccaacaaggagtgccaggccgccctggaggtgctgcaggagagccccctgtatgactgccgctgcaagaggggcatgaagaaggagctgcagtgcctgcagatctactggagcatccacctgggcctgacagaaggagaggagttctatgaggccagcccctatgagcctgtgaccagccggctgagtgacatcttccggctggccagcatcttcagcggcaccggggctgaccctgtggtgtctgccaagagcaaccactgcctggatgctgccaaggcctgcaacctgaatgacaactgcaagaagctgcggagcagctacatcagcatctgcaaccgggagatcagccccacagagcgctgcaacagaaggaagtgccacaaggccctgcggcagttctttgacagagtgcccagcgagtacacctacaggatgctgttctgcagctgccaggaccaggcctgtgccgagcggcggcggcagaccatcctgcccagctgcagctatgaggacaaggagaagcccaactgcctggacctgcggggcgtgtgcaggacagaccacctgtgccgcagccggctggccgacttccacgccaactgccgggccagctaccagacagtgaccagctgcccagctgacaactaccaggcctgcctgggcagctatgccggcatgattggatttgacatgacccccaactacgtggacagcagccccactggaattgtggtgagcccctggtgcagctgccggggcagcggcaacatggaggaggagtgtgagaagttcctgcgggacttcacagagaacccctgcctgagaaatgccatccaggcctttggaaatggaacagatgtgaatgtgagccccaagggccccagcttccaggccacccaggccccccgggtggagaagacccccagcctgcctgatgacctgagtgacagcaccagcctgggcaccagcgtcatcaccacctgcacctctgtgcaggagcagggcctgaaggccaacaacagcaaggagctgtccatgtgcttcacagagctgaccaccaacatcatccctggcagcaacaaggtgatcaagcccaacagcggccccagccgggcccggcccagcgctgccctgactgtgctgtctgtgctgatgctgaagctggccctgtag

SEQ ID NO: 153624 - DNA, 996 bp, Artificial Sequence
  Description of Artificial Sequence: Synthetic coding sequence
atgatcctggccaacgtgttctgcctcttcttcttcctgggcactggagctgaccctgtggtgtctgccaagagcaaccactgcctggatgctgccaaggcctgcaacctgaatgacaactgcaagaagctgcggagcagctacatcagcatctgcaaccgggagatcagccccacagagcgctgcaacagaaggaagtgccacaaggccctgcggcagttctttgacagagtgcccagcgagtacacctacaggatgctgttctgcagctgccaggaccaggcctgtgccgagcggcggcggcagaccatcctgcccagctgcagctatgaggacaaggagaagcccaactgcctggacctgcggggcgtgtgcaggacagaccacctgtgccgcagccggctggccgacttccacgccaactgccgggccagctaccagacagtgaccagctgcccagctgacaactaccaggcctgcctgggcagctatgccggcatgattggatttgacatgacccccaactacgtggacagcagccccaccggcatcgtggtgagcccctggtgcagctgccggggcagcggcaacatggaggaggagtgtgagaagttcctgcgggacttcacagagaacccctgcctgagaaatgccatccaggcctttggaaatggaacagatgtgaatgtgagccccaagggccccagcttccaggccacccaggccccccgggtggagaagacccccagcctgcctgatgacctgagtgacagcaccagcctgggcaccagcgtcatcaccacctgcacctctgtgcaggagcagggcctgaaggccaacaacagcaaggagctgtccatgtgcttcacagagctgaccaccaacatcatccctggcagcaacaaggtgatcaagcccaacagcggccccagccgggcccggcccagcgctgccctgactgtgctgtctgtgctgatgctgaagctggccctgtag

SEQ ID NO: 153625 - DNA, 798 bp, Artificial Sequence
  Description of Artificial Sequence: Synthetic coding sequence
atgatcctggccaacgtgttctgcctcttcttcttcctggatgagaccctgcggagcctggccagccccagcagcctgcagggccctgagctgcacggctggaggcctcctgtggactgtgtgcgggccaatgagctgtgtgccgctgagagcaactgcagcagccgctaccgcaccctgcggcagtgcctggccggccgggacaggaacaccatgctggccaacaaggagtgccaggccgccctggaggtgctgcaggagagccccctgtatgactgccgctgcaagaggggcatgaagaaggagctgcagtgcctgcagatctactggagcatccacctgggcctgacagaaggagaggagttctatgaggccagcccctatgagcctgtgaccagccggctgagtgacatcttccggctggccagcatcttcagcggcaccggggctgaccctgtggtgtctgccaagagcaaccactgcctggatgctgccaaggcctgcaacctgaatgacaactgcaagaagctgcggagcagctacatcagcatctgcaaccgggagatcagccccacagagcgctgcaacagaaggaagtgccacaaggccctgcggcagttctttgacagagtgcccagcgagtacacctacaggatgctgttctgcagctgccaggaccaggcctgtgccgagcggcggcggcagaccatcctgcccagctgcagctatgaggacaaggagaagcccaactgcctggacctgcggggcgtgtgcaggacagaccacctgtgcaggtag

SEQ ID NO: 153626 - DNA, 1395 bp, Artificial Sequence; identical to SEQ ID NO: 153623
  Description of Artificial Sequence: Synthetic coding sequence

SEQ ID NO: 153627 - DNA, 1203 bp, Artificial Sequence
  Description of Artificial Sequence: Synthetic coding sequence
atggtgcggcccctgaacccccggcccctgccccctgtggtgctgatgctgctgctgctgctgccccccagccccctgcccctggccgccggggaccccctgcccacagagagccggctgatgaacagctgcctgcaggcccggaggaagtgccaggccgaccccacctgcagcgctgcctaccaccacctggacagctgcaccagcagcatcagcacccccctgcccagcgaggagcccagcgtgcctgctgactgcctggaggccgcccagcagctgaggaacagcagcctgattggctgcatgtgccacaggaggatgaagaaccaggtggcctgcctggacatctactggacagtgcaccgggcccggagcctgggcaactatgagctggatgtgagcccctatgaagatactgtgaccagcaagccctggaagatgaacctgagcaagctgaacatgctgaagccagacagcgacctgtgcctgaagtttgccatgctgtgcaccctgaatgacaagtgtgaccggctgaggaaggcctacggggaggcctgcagcggcccccactgccagagacatgtgtgcctgcggcagctgctgaccttctttgagaaggctgctgagccccacgcccagggcctgctgctgtgcccctgtgccccaaatgaccggggctgtggggagaggagaagaaacaccatcgcccccaactgtgccctgccccctgtggcccccaactgcctggagctgcggcggctgtgcttcagtgaccccctgtgccgcagccggctggtggacttccagacccactgccaccccatggacatcctgggcacctgtgccacagagcagagccgctgcctgcgggcctacctgggcctcatcggcacagccatgacccccaactttgtgtccaatgtgaacacctctgtggccctgagctgcacctgccggggcagcggcaacctgcaggaggagtgtgagatgctggagggcttcttcagccacaacccctgcctgacagaggccatcgccgccaagatgaggttccacagccagctgttcagccaggactggccccaccccacctttgctgtgatggcccaccagaatgaaaatcctgctgtgcggccccagccctgggtgcccagcctcttcagctgcaccctgcccctcatcctgctgctgagcctgtggtag

SEQ ID NO: 153628 - DNA, 1110 bp, Artificial Sequence
  Description of Artificial Sequence: Synthetic coding sequence
atggtgcggcccctgaacccccggcccctgccccctgtggtgctgatgctgctgctgctgctgccccccagccccctgcccctggccgccggggaccccctgcccacagagagccggctgatgaacagctgcctgcaggcccggaggaagtgccaggccgaccccacctgcagcgctgcctaccaccacctggacagctgcaccagcagcatcagcacccccctgcccagcgaggagcccagcgtgcctgctgactgcctggaggccgcccagcagctgaggaacagcagcctgattggctgcatgtgccacaggaggatgaagaaccaggtggcctgcctggacatctactggacagtgcaccgggcccggagcctggacagcgacctgtgcctgaagtttgccatgctgtgcaccctgaatgacaagtgtgaccggctgaggaaggcctatggagaggcctgcagcggcccccactgccagagacatgtgtgcctgcggcagctgctgaccttctttgagaaggctgctgagccccacgcccagggcctgctgctgtgcccctgtgccccaaatgaccggggctgtggggagaggagaagaaacaccatcgcccccaactgtgccctgccccctgtggcccccaactgcctggagctgcggcggctgtgcttcagtgaccccctgtgccgcagccggctggtggacttccagacccactgccaccccatggacatcctgggcacctgtgccacagagcagagccgctgcctgcgggcctacctgggcctgattggaacagccatgacccccaactttgtgtccaatgtgaacacctctgtggccctgagctgcacctgccggggcagcggcaacctgcaggaggagtgtgagatgctggagggcttcttcagccacaacccctgcctgacagaggccatcgccgccaagatgaggttccacagccagctgttcagccaggactggccccaccccacctttgctgtgatggcccaccagaatgaaaatcctgctgtgcggccccagccctgggtgcccagcctcttcagctgcaccctgcccctcatcctgctgctgagcctgtggtag

SEQ ID NO: 153629 - DNA, 2136 bp, Artificial Sequence
  Description of Artificial Sequence: Synthetic coding sequence
atggagagcggggctgtgctgctggagagcaagagcagccccttcaacctgctgcacgagatgcatgagctgcggctgctgggccacctgtgtgatgtgacagtgtctgtggagtaccagggcgtgaggaaggacttcatggcccacaaggctgtgctggccgccaccagcaagttcttcaaggaggtgttcctgaatgagaagtctgtggatggcaccaggaccaacgtgtacctgaatgaggtgcaggtggccgactttgccagcttcctggagtttgtgtacacagccaaggtgcaggtggaggaggacagagtgcagaggatgctggaggtggccgagaagctgaagtgcctggacctgtctgagacctgcttccagctgaagaagcagatgctggagagcgtgctgctggagctgcagaacttcagcgagagccaggaggtggaggtgagcagcggcagccaggtgtctgctgccccagccccccgggcctctgtggccacagatggcccccaccccagcggcctgacagacagcctggactacccaggagagcgggccagcaatggcatgagcagtgacctgccccccaagaagagcaaggacaagctggacaagaagaaggaggtggtgaagccaccctaccccaagatccggcgggccagcggccgcctggccggcaggaaggtgtttgtggagatccccaagaagaagtacacccggcggctgcgggagcagcagaagacagcagaaggagatgtgggggactaccgctgcccccaggaccagagcccagacagagtgggcacagagatggagcaggtgtccaagaatgaaggctgccaggccggggctgagctggaggagctgagcaagaaggccggccctgaggaggaggaggaggaggaggaggaggatgaggagggggagaagaagaagagcaacttcaagtgcagcatctgtgagaaggccttcctgtatgagaagagcttcctgaagcacagcaagcacagacatggagtggccacagaggtggtgtaccgctgtgacacctgtggccagacctttgccaaccgctgcaacctgaagagccaccagagacatgtgcacagcagcgagcggcacttcccctgtgagctgtgtgggaagaagttcaagaggaagaaggatgtgaagagacatgtgctgcaggtgcatgagggcggcggggagcggcaccgctgtggccagtgtgggaagggcctgagcagcaagacagccctgcggctgcacgagaggacccacactggagaccggccctacggctgcacagaatgtggggcccgcttcagccagcccagcgccctgaagacccacatgaggatccacactggagagaagccctttgtgtgtgatgaatgtggggcccgcttcacccagaaccacatgctgatctaccacaagcgctgccacactggagagcggcccttcatgtgtgagacctgtgggaagagctttgccagcaaggagtacctgaagcaccacaaccgcatccacacaggcagcaagcccttcaagtgtgaggtgtgcttccgcacctttgcccagaggaacagcctgtaccagcacatcaaggtgcacactggagagcggccctactgctgtgaccagtgtgggaagcagttcacccagctgaatgccctgcagaggcaccggcgcatccacactggagagcggcccttcatgtgcaatgcctgtggccgcaccttcacagacaagagcaccctgcggcggcacaccagcatccatgacaagaacaccccctggaagagcttcctggtgattgtggatggcagccccaagaatgatgatggccacaagacagagcagccagatgaggagtatgtgagcagcaagctgagtgacaagctgctgagctttgctgaaaatggccacttccacaacctggccgctgtgcaggacacagtgcccaccatgcaggagaacagcagcgctgacacagcctgcaaggcagatgattctgtggtgtcccaggacaccctgctggccaccaccatcagcgagctgtctgagctgaccccccagacagacagcatgcccacccagctgcacagcctgagcaacatggagtag

SEQ ID NO: 153630 - DNA, 2136 bp, Artificial Sequence; identical to SEQ ID NO: 153629
  Description of Artificial Sequence: Synthetic coding sequence

SEQ ID NO: 153631 - DNA, 147 bp, Artificial Sequence
  Description of Artificial Sequence: Synthetic coding sequence
atggagagcggggctgtgctgctggagagcaagagcagccccttcaacctgctgcacgagatgcatgagctgcggctgctgggccacctgtgtgatgtgacagtgtctgtggagtaccagggcgtgaggaaggacttcatggcctag

SEQ ID NO: 153632 - DNA, 663 bp, Artificial Sequence
  Description of Artificial Sequence: Synthetic coding sequence
atgtgtgagacctgtgggaagagctttgccagcaaggagtacctgaagcaccacaaccgcatccacacaggcagcaagcccttcaagtgtgaggtgtgcttccgcacctttgcccagaggaacagcctgtaccagcacatcaaggtgcacactggagagcggccctactgctgtgaccagtgtgggaagcagttcacccagctgaatgccctgcagaggcaccggcgcatccacactggagagcggcccttcatgtgcaatgcctgtggccgcaccttcacagacaagagcaccctgcggcggcacaccagcatccatgacaagaacaccccctggaagagcttcctggtgattgtggatggcagccccaagaatgatgatggccacaagacagagcagccagatgaggagtatgtgagcagcaagctgagtgacaagctgctgagctttgctgaaaatggccacttccacaacctggccgctgtgcaggacacagtgcccaccatgcaggagaacagcagcgctgacacagcctgcaaggcagatgacagcgtggtgtcccaggacaccctgctggccaccaccatcagcgagctgtctgagctgaccccccagacagacagcatgcccacccagctgcacagcctgagcaacatggagtag

SEQ ID NO: 153633 - DNA, 708 bp, Artificial Sequence
  Description of Artificial Sequence: Synthetic coding sequence
atgctgatctaccacaagcgctgccacactggagagcggcccttcatgtgtgagacctgtgggaagagctttgccagcaaggagtacctgaagcaccacaaccgcatccacacaggcagcaagcccttcaagtgtgaggtgtgcttccgcacctttgcccagaggaacagcctgtaccagcacatcaaggtgcacactggagagcggccctactgctgtgaccagtgtgggaagcagttcacccagctgaatgccctgcagaggcaccggcgcatccacactggagagcggcccttcatgtgcaatgcctgtggccgcaccttcacagacaagagcaccctgcggcggcacaccagcatccatgacaagaacaccccctggaagagcttcctggtgattgtggatggcagccccaagaatgatgatggccacaagacagagcagccagatgaggagtatgtgagcagcaagctgagtgacaagctgctgagctttgctgaaaatggccacttccacaacctggccgctgtgcaggacacagtgcccaccatgcaggagaacagcagcgctgacacagcctgcaaggcagatgattctgtggtgtcccaggacaccctgctggccaccaccatcagcgagctgtctgagctgaccccccagacagacagcatgcccacccagctgcacagcctgagcaacatggagtag

SEQ ID NO: 153634 - DNA, 1254 bp, Artificial Sequence
  Description of Artificial Sequence: Synthetic coding sequence
atggatgaggagtatgatgtgattgtgctgggcaccggcctgacagagtgcatcctgagcggcatcatgtctgtgaatggcaagaaggtgctgcacatggacaggaacccctactatggaggagagagcagcagcatcacccccctggaggagctgtacaagcgcttccagctgctggagggccccccagagagcatgggccggggccgggactggaatgtggacctgatccccaagttcctgatggccaacggccagctggtgaagatgctgctgtacacagaggtgacccgctacctggacttcaaggtggtggagggcagctttgtgtacaagggcggcaagatctacaaggtgcccagcacagaaacagaggccctggccagcaacctgatgggcatgtttgaaaatgaccccaagacctttgagggcgtggacccccagaccacctccatgagagatgtgtacaggaagtttgacctgggccaggacgtcatcgacttcaccggccacgccctggccctgtacagaacagatgactacctggaccagccctgcctggagaccgtgaaccgcatcaagctgtacagcgagagcctggcccgctatggcaagagcccctacctgtaccccctgtatggcctgggggagctgccccagggctttgcccggctgagcgccatctatggaggcacctacatgctgaacaagcctgtggatgacatcatcatggagaatggcaaggtggtgggcgtgaagtctgagggggaggtggcccgctgcaagcagctgatctgtgaccccagctacatcccagacagagtgaggaaggccggccaggtgatccgcatcatctgcatcctgagccaccccatcaagaacaccaatgatgccaacagctgccagatcatcatcccccagaaccaggtgaacaggaagagtgacatctacgtgtgcatgatctcctatgcccacaacgtggccgcccagggcaagtacatcgccatcgccagcaccaccgtggagaccacagatcctgagaaggaggtggagcccgccctggagctgctggagcccattgatgatggctgtgagagccaggtgttctgcagctgcagctatgatgccaccacccactttgagaccacctgcaatgacatcaaggacatctacaagaggatggccggcacagcctttgattttgagaacatgaagaggaagcagaatgatgtgtttggagaggccgagcagtag

SEQ ID NO: 153635 - DNA, 1344 bp, Artificial Sequence
  Description of Artificial Sequence: Synthetic coding sequence
atggatgaggagtatgatgtgattgtgctgggcaccggcctgacagagtgcatcctgagcggcatcatgtctgtgaatggcaagaaggtgctgcacatggacaggaacccctactatggaggagagagcagcagcatcacccccctggaggagctgtacaagcgcttccagctgctggagggccccccagagagcatgggccggggccgggactggaatgtggacctgatccccaagttcctgatggccaacggccagctggtgaagatgctgctgtacacagaggtgacccgctacctggacttcaaggtggtggagggcagctttgtgtacaagggcggcaagatctacaaggtgcccagcacagaaacagaggccctggccagcaacctgatgggcatgtttgagaagaggcgcttcaggaagttcctggtgtttgtggccaactttgatgaaaatgaccccaagacctttgagggcgtggacccccagaccacctccatgagagatgtgtacaggaagtttgacctgggccaggacgtcatcgacttcaccggccacgccctggccctgtacagaacagatgactacctggaccagccctgcctggagaccgtgaaccgcatcaagctgtacagcgagagcctggcccgctatggcaagagcccctacctgtaccccctgtatggcctgggggagctgccccagggctttgcccggctgagcgccatctatggaggcacctacatgctgaacaagcctgtggatgacatcatcatggagaatggcaaggtggtgggcgtgaagtctgagggggaggtggcccgctgcaagcagctgatctgtgaccccagctacatcccagacagagtgaggaaggccggccaggtgatccgcatcatctgcatcctgagccaccccatcaagaacaccaatgatgccaacagctgccagatcatcatcccccagaaccaggtgaacaggaagagtgacatctacgtgtgcatgatctcctatgcccacaacgtggccgcccagggcaagtacatcgccatcgccagcaccaccgtggagaccacagatcctgagaaggaggtggagcccgccctggagctgctggagcccatcgaccagaagtttgtggccatcagtgacctgtatgagcccattgatgatggctgtgagagccaggtgttctgcagctgcagctatgatgccaccacccactttgagaccacctgcaatgacatcaaggacatctacaagaggatggccggcacagcctttgattttgagaacatgaagaggaagcagaatgatgtgtttggagaggccgagcagtag

SEQ ID NO: 153636 - DNA, 447 bp, Artificial Sequence
  Description of Artificial Sequence: Synthetic coding sequence
atgagcctgggcaagaggaagcccagcaacttctacctggccaacttcctgggcaaggagtgcatcctgagcggcatcatgtctgtgaatggcaagaaggtgctgcacatggacaggaacccctactatggaggagagagcgccagcatcacccccctggaggacctgtacaagcgcttcaagatccctggcagccccccagagagcatgggccggggccgggactggaatgtggacctgatccccaagttcctgatggccaacggccagctggtgaagatgctgctgtacacagaggtgacccgctacctggacttcaaggtgacagagggcagctttgtgtacaagggcggcaagatctacaaggtgcccagcacagaggccgaggccctggccagcagcctgatgggcctgtttgagaagaggcgcttcaggaagttcctgtag

SEQ ID NO: 153637 - DNA, 1350 bp, Artificial Sequence
  Description of Artificial Sequence: Synthetic coding sequence
atgagcctgggcaagaggaagcccagcaacttctacctggccaacttcctgggcaaggagtgcatcctgagcggcatcatgtctgtgaatggcaagaaggtgctgcacatggacaggaacccctactatggaggagagagcgccagcatcacccccctggaggacctgtacaagcgcttcaagatccctggcagccccccagagagcatgggccggggccgggactggaatgtggacctgatccccaagttcctgatggccaacggccagctggtgaagatgctgctgtacacagaggtgacccgctacctggacttcaaggtgacagagggcagctttgtgtacaagggcggcaagatctacaaggtgcccagcacagaggccgaggccctggccagcagcctgatgggcctgtttgagaagaggcgcttcaggaagttcctggtgtatgtggccaactttgatgagaaggaccccaggacctttgagggcatcgaccccaagaagaccaccatgagagatgtgtacaagaagtttgacctgggccaggacgtcatcgacttcaccggccacgccctggccctgtacagaacagatgactacctggaccagccctgctatgagaccatcaaccgcatcaagctgtacagcgagagcctggcccgctatggcaagagcccctacctgtaccccctgtatggcctgggggagctgccccagggctttgcccggctgagcgccatctatggaggcacctacatgctgaacaagcccatcgaggagatcatcgtgcagaatggcaaggtgattggagtgaagtctgagggggagatcgcccgctgcaagcagctgatctgtgaccccagctatgtgaaggacagagtggagaaggtgggccaggtgatccgggtcatctgcatcctgagccaccccatcaagaacaccaatgatgccaacagctgccagatcatcatcccccagaaccaggtgaacaggaagagtgacatctacgtgtgcatgatcagctttgcccacaacgtggccgcccagggcaagtacatcgccatcgtgtccaccaccgtggagaccaaggagcctgagaaggagatccggcctgccctggagctgctggagcccatcgagcagaagtttgtgtccatcagtgacctgctggtgcccaaggacctgggcacagagagccagatcttcatcagcaggacctatgatgccaccacccactttgagaccacctgtgatgacatcaagaacatctacaagaggatgactggaagtgaatttgattttgaggagatgaagaggaagaagaatgacatctacggggaggactag

SEQ ID NO: 153638 - DNA, 627 bp, Artificial Sequence
  Description of Artificial Sequence: Synthetic coding sequence
atgagagatgtgtacaagaagtttgacctgggccaggatgtgattgacttcaccggccacgccctggccctgtacagaacagatgactacctggaccagccctgctatgagaccatcaaccgcatcaagctgtacagcgagagcctggcccgctatggcaagagcccctacctgtaccccctgtatggcctgggggagctgccccagggctttgcccggctgagcgccatctacggcggcacctacatgctgaacaagcccatcgaggagatcatcgtgcagaatggcaaggtgattggagtgaagtctgagggggagatcgcccgctgcaagcagctgatctgtgaccccagctatgtgaaggacagagtggagaaggtgggccaggtgatccgggtcatctgcatcctgagccaccccatcaagaacaccaatgatgccaacagctgccagatcatcatcccccagaaccaggtgaacaggaagagtgacctgctggcctctgtgacctcctggtaccagaagacctgggagcagaaggcccggagcctcttccctgcccacatgatgcctcctctcatcctgcggcagagggtgatgaccctgaagaccagcatccggggctag

SEQ ID NO: 153639 - DNA, 1203 bp, Artificial Sequence
  Description of Artificial Sequence: Synthetic coding sequence
atgaatgaggagtatgatgtgattgtgctgggcaccggcctgacagagtgcatcctgagcggcatcatgtctgtgaatggcaagaaggtgctgcacatggacaggaacccctactatggaggagagagcgccagcatcacccccctggaggacctgtacaagcgcttcaagatccctggcagccccccagagagcatgggccggggccgggactggaatgtggacctgatccccaagttcctgatggccaacggcctgatgggcctgtttgagaagaggcgcttcaggaagttcctggtgtatgtggccaactttgatgagaaggaccccaggacctttgagggcatcgaccccaagaagaccaccatgagagatgtgtacaagaagtttgacctgggccaggatgtgattgacttcaccggccacgccctggccctgtacagaacagatgactacctggaccagccctgctatgagaccatcaaccgcatcaagctgtacagcgagagcctggcccgctatggcaagagcccctacctgtaccccctgtatggcctgggggagctgccccagggctttgcccggctgagcgccatctacggcggcacctacatgctgaacaagcccatcgaggagatcatcgtgcagaatggcaaggtgattggagtgaagtctgagggggagatcgcccgctgcaagcagctgatctgtgaccccagctatgtgaaggacagagtggagaaggtgggccaggtgatccgggtcatctgcatcctgagccaccccatcaagaacaccaatgatgccaacagctgccagatcatcatcccccagaaccaggtgaacaggaagagtgacatctacgtgtgcatgatcagctttgcccacaacgtggccgcccagggcaagtacatcgccatcgtgtccaccaccgtggagaccaaggagcctgagaaggagatccggcctgccctggagctgctggagcccatcgagcagaagtttgtgtccatcagtgacctgctggtgcccaaggacctgggcacagagagccagatcttcatcagcaggacctatgatgccaccacccactttgagaccacctgtgatgacatcaagaacatctacaagaggatgacaggcagcgagtttgattttgaggagatgaagaggaagaagaatgacatctatggagaagattag

SEQ ID NO: 153640 - DNA, 1338 bp, Artificial Sequence
  Description of Artificial Sequence: Synthetic coding sequence
atgaatgaggagtatgatgtgattgtgctgggcaccggcctgacagagtgcatcctgagcggcatcatgtctgtgaatggcaagaaggtgctgcacatggacaggaacccctactatggaggagagagcgccagcatcacccccctggaggacctgtacaagcgcttcaagatccctggcagccccccagagagcatgggccggggccgggactggaatgtggacctgatccccaagttcctgatggccaacggccagctggtgaagatgctgctgtacacagaggtgacccgctacctggacttcaaggtgacagagggcagctttgtgtacaagggcggcaagatctacaaggtgcccagcacagaggccgaggccctggccagcagcctgatgggcctgtttgagaagaggcgcttcaggaagttcctggtgtatgtggccaactttgatgagaaggaccccaggacctttgagggcatcgaccccaagaagaccaccatgagagatgtgtacaagaagtttgacctgggccaggacgtcatcgacttcaccggccacgccctggccctgtacagaacagatgactacctggaccagccctgctatgagaccatcaaccgcatcaagctgtacagcgagagcctggcccgctatggcaagagcccctacctgtaccccctgtatggcctgggggagctgccccagggctttgcccggctgagcgccatctatggaggcacctacatgctgaacaagcccatcgaggagatcatcgtgcagaatggcaaggtgattggagtgaagtctgagggggagatcgcccgctgcaagcagctgatctgtgaccccagctatgtgaaggacagagtggagaaggtgggccaggtgatccgggtcatctgcatcctgagccaccccatcaagaacaccaatgatgccaacagctgccagatcatcatcccccagaaccaggtgaacaggaagagtgacatctacgtgtgcatgatcagctttgcccacaacgtggccgcccagggcaagtacatcgccatcgtgtccaccaccgtggagaccaaggagcctgagaaggagatccggcctgccctggagctgctggagcccatcgagcagaagtttgtgtccatcagtgacctgctggtgcccaaggacctgggcacagagagccagatcttcatcagcaggacctatgatgccaccacccactttgagaccacctgtgatgacatcaagaacatctacaagaggatgactggaagtgaatttgattttgaggagatgaagaggaagaagaatgacatctacggggaggactag

SEQ ID NO: 153641 - DNA, 468 bp, Artificial Sequence
  Description of Artificial Sequence: Synthetic coding sequence
atgaatgaggagtatgatgtgattgtgctgggcaccggcctgaccctgtacaagcgcttcaagatccctggcagccccccagagagcatgggccggggccgggactggaatgtggacctgatccccaagttcctgatggccaacggccagctggtgaagatgctgctgtacacagaggtgacccgctacctggacttcaaggtgacagagggcagctttgtgtacaagggcggcaagatctacaaggtgcccagcacagaggccgaggccctggccagcagcctgatgggcctgtttgagaagaggcgcttcaggaagttcctggtgtatgtggccaactttgatgagaaggaccccaggacctttgagggcatcgaccccaagaagaccaccatgagagatgtgtacaagaagtttgacctgggccaggacgtcatcgacttcaccggccacgccctggccctgtag

SEQ ID NO: 153642 - DNA, 612 bp, Artificial Sequence
  Description of Artificial Sequence: Synthetic coding sequence
aagaagtttgacctgggccaggacgtcatcgacttcaccggccacgccctggccctgtacagaacagatgactacctggaccagccctgctatgagaccatcaaccgcatcaagctgtacagcgagagcctggcccgctatggcaagagcccctacctgtaccccctgtatggcctgggggagctgccccagggctttgcccggctgagcgccatctatggaggcacctacatgctgaacaagcccatcgaggagatcatcgtgcagaatggcaaggtgattggagtgaagtctgagggggagatcgcccgctgcaagcagctgatctgtgaccccagctatgtgaaggacagagtggagaaggtgggccaggtgatccgggtcatctgcatcctgagccaccccatcaagaacaccaatgatgccaacagctgccagatcatcatcccccagaaccaggtgaacaggaagagtgacctgctggcctctgtgacctcctggtaccagaagacctgggagcagaaggcccggagcctcttccctgcccacatgatgccacccctcatcctgcggcagagggtgatgaccctgaagaccagcatccggggctag

SEQ ID NO: 153643 - DNA, 792 bp, Artificial Sequence
  Description of Artificial Sequence: Synthetic coding sequence
atgaatgaggagtatgatgtgattgtgctgggcaccggcctgacagagtgcatcctgagcggcatcatgtctgtgaatggcaagaaggtgctgcacatggacaggaacccctactatggaggagagagcgccagcatcacccccctggaggacctgtacaagcgcttcaagatccctggcagccccccagagagcatgggccggggccgggactggaatgtggacctgatccccaagttcctgatggccaatgaggtgacccgctacctggacttcaaggtgacagagggcagctttgtgtacaagggcggcaagatctacaaggtgcccagcacagaggccgaggccctggccagcagcctgatgggcctgtttgagaagaggcgcttcaggaagttcctggtgtatgtggccaactttgatgagaaggaccccaggacctttgagggcatcgaccccaagaagaccaccatgagagatgtgtacaagaagtttgacctgggccaggacgtcatcgacttcaccggccacgccctggccctgtacagaacagatgactacctggaccagccctgctatgagaccatcaaccgcatcaagctgtacagcgagagcctggcccgctatggcaagagcccctacctgtaccccctgtatggcctgggggagctgccccagggctttgcccggctgagcgccatctatggaggcacctacatgctgaacaagcccatcgaggagatcatcgtgcagaatggcaaggtgattggagtgaagtctgagggggagtag

SEQ ID NO: 153644 - DNA, 1119 bp, Artificial Sequence
  Description of Artificial Sequence: Synthetic coding sequence
atggcccacgccccagcccgctgccccagcgcccggggcagcggagatggagagatgggcaagcccagaaatgtggccctgatcaccggcatcaccggccaggacggcagctacctggccgagttcctgctggagaagggctatgaggtgcatggaattgtgagaagaagcagcagcttcaacacaggaagaattgagcacctgtacaagaacccccaggcccacatcgagggcaacatgaagctgcactacggggacctgacagacagcacctgcctggtgaagatcatcaatgaggtgaagcccacagagatctacaacctgggcgcccagagccacgtgaagatcagctttgacctggccgagtacacagcagatgtggatggagtgggcaccctgcggctgctggatgctgtgaagacctgtggcctcatcaacagcgtgaagttctaccaggccagcaccagcgagctgtatggcaaggtgcaggagatcccccagaaggagaccacccccttctaccccaggagcccctatggagctgccaagctgtatgcctactggatcgtggtgaacttccgggaggcctacaacctgtttgctgtgaatggcatcctcttcaaccacgagagccccaggagaggagccaactttgtgaccaggaagatcagccgctctgtggccaagatctacctgggccagctggagtgcttcagcctgggcaacctggatgccaagagggactggggccacgccaaggactatgtggaggccatgtggctgatgctgcagaatgatgagccagaagattttgtgattgccactggagaggtgcacagcgtgcgggagtttgtggagaagagcttcctgcacatcggcaagaccatcgtgtgggagggcaagaatgaaaatgaggtgggccgctgcaaggagaccgggaaggtgcacgtgacagtggacctgaagtactaccggcccacagaggtggacttcctgcagggcgactgcaccaaggccaagcagaagctgaactggaagccccgggtggcctttgatgagctggtgcgggagatggtgcatgctgatgtggagctgatgaggaccaaccccaatgcctag

SEQ ID NO: 153645 - DNA, 1029 bp, Artificial Sequence
  Description of Artificial Sequence: Synthetic coding sequence
atgtgcaagatggatggcagctacctggccgagttcctgctggagaagggctatgaggtgcatggaattgtgagaagaagcagcagcttcaacacaggaagaattgagcacctgtacaagaacccccaggcccacatcgagggcaacatgaagctgcactacggggacctgacagacagcacctgcctggtgaagatcatcaatgaggtgaagcccacagagatctacaacctgggcgcccagagccacgtgaagatcagctttgacctggccgagtacacagcagatgtggatggagtgggcaccctgcggctgctggatgctgtgaagacctgtggcctcatcaacagcgtgaagttctaccaggccagcaccagcgagctgtatggcaaggtgcaggagatcccccagaaggagaccacccccttctaccccaggagcccctatggagctgccaagctgtatgcctactggatcgtggtgaacttccgggaggcctacaacctgtttgctgtgaatggcatcctcttcaaccacgagagccccaggagaggagccaactttgtgaccaggaagatcagccgctctgtggccaagatctacctgggccagctggagtgcttcagcctgggcaacctggatgccaagagggactggggccacgccaaggactatgtggaggccatgtggctgatgctgcagaatgatgagccagaagattttgtgattgccactggagaggtgcacagcgtgcgggagtttgtggagaagagcttcctgcacatcggcaagaccatcgtgtgggagggcaagaatgaaaatgaggtgggccgctgcaaggagaccgggaaggtgcacgtgacagtggacctgaagtactaccggcccacagaggtggacttcctgcagggcgactgcaccaaggccaagcagaagctgaactggaagccccgggtggcctttgatgagctggtgcgggagatggtgcatgctgatgtggagctgatgaggaccaaccccaatgcctag

SEQ ID NO: 153646 - DNA, 2196 bp, Artificial Sequence
  Description of Artificial Sequence: Synthetic coding sequence
atggtggtggagcaccctgagttcctgaaggccggcaaggagcccggcctgcagatctggagggtggagaagtttgacctggtgcctgtgcccaccaacctgtatggagacttcttcaccggagatgcctacgtgatcctgaagacagtgcagctgagaaatggaaacctgcagtatgacctgcactactggctgggcaatgaatgttcccaggatgagagcggggctgctgccatcttcaccgtgcagctggatgactacctgaatggccgggctgtgcagcaccgggaggtgcagggctttgaaagtgccaccttcctgggctacttcaagagcggcctgaagtacaagaagggcggcgtggccagcggcttcaagcacgtggtgcccaatgaggtggtggtgcagaggctcttccaggtgaagggccggcgggtggtgcgggccacagaggtgcctgtgtcctgggagagcttcaacaatggagactgcttcatcctggacctgggcaacaacatccaccagtggtgtggcagcaacagcaacagatatgaaaggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtctgtgtccctggtggctgatgagaacccctttgcccagggcgccctgaagtctgaggactgcttcatcctggaccacggcaaggatggcaagatctttgtgtggaagggcaagcaggccaacacagaggagaggaaggccgccctgaagacagccagtgacttcatcaccaagatggactaccccaagcagacccaggtgtctgtgctgcctgagggcggggagacccccctcttcaagcagttcttcaagaactggagggaccctgaccagacagatggcctgggcctgagctacctgagcagccacatcgccaacgtggagcgggtgccctttgatgctgccaccctgcacaccagcacagccatggccgcccagcacggcatggatgatgatggcaccggccagaagcagatctggagaattgagggcagcaacaaggtgcctgtggaccctgccacctacggccagttctacggcggggacagctacatcatcctgtacaactacagacatggaggccggcagggccagatcatctacaactggcagggcgcccagagcacccaggatgaggtggccgccagcgccatcctgacagcccagctggatgaggagctgggcggcacccctgtgcagagccgggtggtgcagggcaaggagcccgcccacctgatgagcctgtttggaggcaagcccatgatcatctacaagggcggcaccagccgggagggcggccagacagccccagccagcaccaggctcttccaggtgcgggccaacagcgctggggccaccagggctgtggaggtgctgcccaaggccggggccctgaacagcaatgatgcctttgtgctgaagaccccatctgctgcctacctgtgggtgggcactggagccagcgaggccgagaagacaggagcccaggagctgctgcgggtgctgcgggcccagcctgtgcaggtggccgagggcagcgagccagatggcttctgggaggccctgggcggcaaggccgcctaccgcaccagcccccggctgaaggacaagaagatggatgcccaccccccccggctgtttgcctgcagcaacaagattggccgcttcgtcatcgaggaggtgcctggagagctgatgcaggaggacctggccacagatgatgtgatgctgctggacacctgggaccaggtgtttgtgtgggtgggcaaggacagccaggaggaggagaagacagaggccctgaccagcgccaagcgctacatcgagacagatcctgccaacagagacaggaggacccccatcaccgtggtgaagcagggctttgagccccccagctttgtgggctggttcctgggctgggatgatgactactggagcgtggaccccctggaccgggccatggccgagctggccgcctag

SEQ ID NO: 153647 - DNA, 2196 bp, Artificial Sequence; identical to SEQ ID NO: 153646
  Description of Artificial Sequence: Synthetic coding sequence

SEQ ID NO: 153648 - DNA, 2349 bp, Artificial Sequence
  Description of Artificial Sequence: Synthetic coding sequence
atggccccccacaggcctgccccagccctgctgtgtgccctgagcctggccctgtgtgccctgagcctgcctgtgcgggccgccacagccagcagaggagccagccaggccggggccccccagggccgggtgcctgaggcccggcccaacagcatggtggtggagcaccctgagttcctgaaggccggcaaggagcccggcctgcagatctggagggtggagaagtttgacctggtgcctgtgcccaccaacctgtatggagacttcttcaccggagatgcctacgtgatcctgaagacagtgcagctgagaaatggaaacctgcagtatgacctgcactactggctgggcaatgaatgttcccaggatgaaagtggagctgctgccatcttcaccgtgcagctggatgactacctgaatggccgggctgtgcagcaccgggaggtgcagggctttgagagcgccaccttcctgggctacttcaagagcggcctgaagtacaagaagggcggcgtggccagcggcttcaagcacgtggtgcccaatgaggtggtggtgcagaggctcttccaggtgaagggcagaagagtggtgcgggccacagaggtgcctgtgtcctgggagagcttcaacaacggggactgcttcatcctggacctgggcaacaacatccaccagtggtgtggcagcaacagcaacagatatgagcggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtctgtgtccctggtggctgatgagaacccctttgcccagggcgccctgaagtctgaggactgcttcatcctggaccacggcaaggatggcaagatctttgtgtggaagggcaagcaggccaacacagaggagaggaaggccgccctgaagacagccagtgacttcatcaccaagatggactaccccaagcagacccaggtgtctgtgctgcctgagggcggggagacccccctcttcaagcagttcttcaagaactggagggaccctgaccagacagatggcctgggcctgagctacctgagcagccacatcgccaacgtggagcgggtgccctttgatgctgccaccctgcacaccagcacagccatggccgcccagcacggcatggatgatgatggcaccggccagaagcagatctggagaattgagggcagcaacaaggtgcctgtggaccctgccacctacggccagttctatggaggagacagctacatcatcctgtacaactaccgccacggcggccggcagggccagatcatctacaactggcagggcgcccagagcacccaggatgaggtggccgccagcgccatcctgacagcccagctggatgaggagctgggcggcacccctgtgcagagccgggtggtgcagggcaaggagcccgcccacctgatgagcctgtttggaggcaagcccatgatcatctacaagggcggcaccagccgggagggcggccagacagccccagccagcaccaggctcttccaggtgcgggccaacagcgctggggccaccagggctgtggaggtgctgcccaaggccggggccctgaacagcaatgatgcctttgtgctgaagacccccagcgctgcctacctgtgggtgggcaccggggccagcgaggccgagaagacaggagcccaggagctgctgcgggtgctgcgggcccagcctgtgcaggtggccgagggcagcgagccagatggcttctgggaggccctgggcggcaaggccgcctaccgcaccagcccccggctgaaggacaagaagatggatgcccaccccccccggctgtttgcctgcagcaacaagattggccgctttgtgattgaggaggtgcctggagagctgatgcaggaggacctggccacagatgatgtgatgctgctggacacctgggaccaggtgtttgtgtgggtgggcaaggacagccaggaggaggagaagacagaggccctgaccagcgccaagcgctacattgaaacagatcctgccaacagagacaggaggacccccatcaccgtggtgaagcagggctttgagcccccatcctttgtgggctggttcctgggctgggatgatgactactggagcgtggaccccctggaccgggccatggccgagctggccgcctag

SEQ ID NO: 153649 - DNA, 2196 bp, Artificial Sequence; identical to SEQ ID NO: 153646
  Description of Artificial Sequence: Synthetic coding sequence

SEQ ID NO: 153650 - DNA, 2148 bp, Artificial Sequence
  Description of Artificial Sequence: Synthetic coding sequence
atggtggtggagcaccctgagttcctgaaggccggcaaggagcccggcctgcagatctggagggtggagaagtttgatgcctacgtgatcctgaagacagtgcagctgagaaatggaaacctgcagtatgacctgcactactggctgggcaatgaatgttcccaggatgagagcggggctgctgccatcttcaccgtgcagctggatgactacctgaatggccgggctgtgcagcaccgggaggtgcagggctttgaaagtgccaccttcctgggctacttcaagagcggcctgaagtacaagaagggcggcgtggccagcggcttcaagcacgtggtgcccaatgaggtggtggtgcagaggctcttccaggtgaagggccggcgggtggtgcgggccacagaggtgcctgtgtcctgggagagcttcaacaatggagactgcttcatcctggacctgggcaacaacatccaccagtggtgtggcagcaacagcaacagatatgaaaggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtctgtgtccctggtggctgatgagaacccctttgcccagggcgccctgaagtctgaggactgcttcatcctggaccacggcaaggatggcaagatctttgtgtggaagggcaagcaggccaacacagaggagaggaaggccgccctgaagacagccagtgacttcatcaccaagatggactaccccaagcagacccaggtgtctgtgctgcctgagggcggggagacccccctcttcaagcagttcttcaagaactggagggaccctgaccagacagatggcctgggcctgagctacctgagcagccacatcgccaacgtggagcgggtgccctttgatgctgccaccctgcacaccagcacagccatggccgcccagcacggcatggatgatgatggcaccggccagaagcagatctggagaattgagggcagcaacaaggtgcctgtggaccctgccacctacggccagttctacggcggggacagctacatcatcctgtacaactacagacatggaggccggcagggccagatcatctacaactggcagggcgcccagagcacccaggatgaggtggccgccagcgccatcctgacagcccagctggatgaggagctgggcggcacccctgtgcagagccgggtggtgcagggcaaggagcccgcccacctgatgagcctgtttggaggcaagcccatgatcatctacaagggcggcaccagccgggagggcggccagacagccccagccagcaccaggctcttccaggtgcgggccaacagcgctggggccaccagggctgtggaggtgctgcccaaggccggggccctgaacagcaatgatgcctttgtgctgaagaccccatctgctgcctacctgtgggtgggcactggagccagcgaggccgagaagacaggagcccaggagctgctgcgggtgctgcgggcccagcctgtgcaggtggccgagggcagcgagccagatggcttctgggaggccctgggcggcaaggccgcctaccgcaccagcccccggctgaaggacaagaagatggatgcccaccccccccggctgtttgcctgcagcaacaagattggccgcttcgtcatcgaggaggtgcctggagagctgatgcaggaggacctggccacagatgatgtgatgctgctggacacctgggaccaggtgtttgtgtgggtgggcaaggacagccaggaggaggagaagacagaggccctgaccagcgccaagcgctacatcgagacagatcctgccaacagagacaggaggacccccatcaccgtggtgaagcagggctttgagccccccagctttgtgggctggttcctgggctgggatgatgactactggagcgtggaccccctggaccgggccatggccgagctggccgcctag

SEQ ID NO: 153651 - DNA, 2229 bp, Artificial Sequence
  Description of Artificial Sequence: Synthetic coding sequence
atggagaagctgttctgctgcttccccaacagcatggtggtggagcaccctgagttcctgaaggccggcaaggagcccggcctgcagatctggagggtggagaagtttgacctggtgcctgtgcccaccaacctgtatggagacttcttcaccggagatgcctacgtgatcctgaagacagtgcagctgagaaatggaaacctgcagtatgacctgcactactggctgggcaatgaatgttcccaggatgaaagtggagctgctgccatcttcaccgtgcagctggatgactacctgaatggccgggctgtgcagcaccgggaggtgcagggctttgagagcgccaccttcctgggctacttcaagagcggcctgaagtacaagaagggcggcgtggccagcggcttcaagcacgtggtgcccaatgaggtggtggtgcagaggctcttccaggtgaagggcagaagagtggtgcgggccacagaggtgcctgtgtcctgggagagcttcaacaacggggactgcttcatcctggacctgggcaacaacatccaccagtggtgtggcagcaacagcaacagatatgagcggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtctgtgtccctggtggctgatgagaacccctttgcccagggcgccctgaagtctgaggactgcttcatcctggaccacggcaaggatggcaagatctttgtgtggaagggcaagcaggccaacacagaggagaggaaggccgccctgaagacagccagtgacttcatcaccaagatggactaccccaagcagacccaggtgtctgtgctgcctgagggcggggagacccccctcttcaagcagttcttcaagaactggagggaccctgaccagacagatggcctgggcctgagctacctgagcagccacatcgccaacgtggagcgggtgccctttgatgctgccaccctgcacaccagcacagccatggccgcccagcacggcatggatgatgatggcaccggccagaagcagatctggagaattgagggcagcaacaaggtgcctgtggaccctgccacctacggccagttctatggaggagacagctacatcatcctgtacaactaccgccacggcggccggcagggccagatcatctacaactggcagggcgcccagagcacccaggatgaggtggccgccagcgccatcctgacagcccagctggatgaggagctgggcggcacccctgtgcagagccgggtggtgcagggcaaggagcccgcccacctgatgagcctgtttggaggcaagcccatgatcatctacaagggcggcaccagccgggagggcggccagacagccccagccagcaccaggctcttccaggtgcgggccaacagcgctggggccaccagggctgtggaggtgctgcccaaggccggggccctgaacagcaatgatgcctttgtgctgaagacccccagcgctgcctacctgtgggtgggcaccggggccagcgaggccgagaagacaggagcccaggagctgctgcgggtgctgcgggcccagcctgtgcaggtggccgagggcagcgagccagatggcttctgggaggccctgggcggcaaggccgcctaccgcaccagcccccggctgaaggacaagaagatggatgcccaccccccccggctgtttgcctgcagcaacaagattggccgctttgtgattgaggaggtgcctggagagctgatgcaggaggacctggccacagatgatgtgatgctgctggacacctgggaccaggtgtttgtgtgggtgggcaaggacagccaggaggaggagaagacagaggccctgaccagcgccaagcgctacattgaaacagatcctgccaacagagacaggaggacccccatcaccgtggtgaagcagggctttgagcccccatcctttgtgggctggttcctgggctgggatgatgactactggagcgtggaccccctggaccgggccatggccgagctggccgcctag

SEQ ID NO: 153652 - DNA, 2196 bp, Artificial Sequence; identical to SEQ ID NO: 153646
  Description of Artificial Sequence: Synthetic coding sequence

SEQ ID NO: 153653 - DNA, 783 bp, Artificial Sequence
  Description of Artificial Sequence: Synthetic coding sequence
atggtggtggagcaccctgagttcctgaaggccggcaaggagcccggcctgcagatctggagggtggagaagtttgacctggtgcctgtgcccaccaacctgtatggagacttcttcaccggagatgcctacgtgatcctgaagacagtgcagctgagaaatggaaacctgcagtatgacctgcactactggctgggcaatgaatgttcccaggatgagagcggggctgctgccatcttcaccgtgcagctggatgactacctgaatggccgggctgtgcagcaccgggaggtgcagggctttgaaagtgccaccttcctgggctacttcaagagcggcctgaagtacaagaagggcggcgtggccagcggcttcaagcacgtggtgcccaatgaggtggtggtgcagaggctcttccaggtgaagggccggcgggtggtgcgggccacagaggtgcctgtgtcctgggagagcttcaacaatggagactgcttcatcctggacctgggcaacaacatccaccagtggtgtggcagcaacagcaacagatatgaaaggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtcctag

SEQ ID NO: 153654 - DNA, 2229 bp, Artificial Sequence; identical to SEQ ID NO: 153651
  Description of Artificial Sequence: Synthetic coding sequence

SEQ ID NO: 153655 - DNA, 2196 bp, Artificial Sequence; identical to SEQ ID NO: 153646
  Description of Artificial Sequence: Synthetic coding sequence

SEQ ID NO: 153656 - DNA, 2118 bp, Artificial Sequence
  Description of Artificial Sequence: Synthetic coding sequence
atggtggtggagcaccctgagttcctgaaggccggcaaggagcccggcctgcagatctggagggtggagaagtttgacctggtgcctgtgcccaccaacctgtatggagacttcttcaccggagatgcctacgtgatcctgaagacagtgcagctgagaaatggaaacctgcagtatgacctgcactactggctgggcaatgaatgttcccaggatgagagcggggctgctgccatcttcaccgtgcagctggatgactacctgaagtacaagaagggcggcgtggccagcggcttcaagcacgtggtgcccaatgaggtggtggtgcagaggctcttccaggtgaagggccggcgggtggtgcgggccacagaggtgcctgtgtcctgggagagcttcaacaatggagactgcttcatcctggacctgggcaacaacatccaccagtggtgtggcagcaacagcaacagatatgaaaggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtctgtgtccctggtggctgatgagaacccctttgcccagggcgccctgaagtctgaggactgcttcatcctggaccacggcaaggatggcaagatctttgtgtggaagggcaagcaggccaacacagaggagaggaaggccgccctgaagacagccagtgacttcatcaccaagatggactaccccaagcagacccaggtgtctgtgctgcctgagggcggggagacccccctcttcaagcagttcttcaagaactggagggaccctgaccagacagatggcctgggcctgagctacctgagcagccacatcgccaacgtggagcgggtgccctttgatgctgccaccctgcacaccagcacagccatggccgcccagcacggcatggatgatgatggcaccggccagaagcagatctggagaattgagggcagcaacaaggtgcctgtggaccctgccacctacggccagttctacggcggggacagctacatcatcctgtacaactacagacatggaggccggcagggccagatcatctacaactggcagggcgcccagagcacccaggatgaggtggccgccagcgccatcctgacagcccagctggatgaggagctgggcggcacccctgtgcagagccgggtggtgcagggcaaggagcccgcccacctgatgagcctgtttggaggcaagcccatgatcatctacaagggcggcaccagccgggagggcggccagacagccccagccagcaccaggctcttccaggtgcgggccaacagcgctggggccaccagggctgtggaggtgctgcccaaggccggggccctgaacagcaatgatgcctttgtgctgaagaccccatctgctgcctacctgtgggtgggcactggagccagcgaggccgagaagacaggagcccaggagctgctgcgggtgctgcgggcccagcctgtgcaggtggccgagggcagcgagccagatggcttctgggaggccctgggcggcaaggccgcctaccgcaccagcccccggctgaaggacaagaagatggatgcccaccccccccggctgtttgcctgcagcaacaagattggccgcttcgtcatcgaggaggtgcctggagagctgatgcaggaggacctggccacagatgatgtgatgctgctggacacctgggaccaggtgtttgtgtgggtgggcaaggacagccaggaggaggagaagacagaggccctgaccagcgccaagcgctacatcgagacagatcctgccaacagagacaggaggacccccatcaccgtggtgaagcagggctttgagccccccagctttgtgggctggttcctgggctgggatgatgactactggagcgtggaccccctggaccgggccatggccgagctggccgcctag

SEQ ID NO: 153657 - DNA, 2220 bp, Artificial Sequence
  Description of Artificial Sequence: Synthetic coding sequence
atgcccctgtgcacccccaacagcatggtggtggagcaccctgagttcctgaaggccggcaaggagcccggcctgcagatctggagggtggagaagtttgacctggtgcctgtgcccaccaacctgtatggagacttcttcaccggagatgcctacgtgatcctgaagacagtgcagctgagaaatggaaacctgcagtatgacctgcactactggctgggcaatgaatgttcccaggatgagagcggggctgctgccatcttcaccgtgcagctggatgactacctgaatggccgggctgtgcagcaccgggaggtgcagggctttgaaagtgccaccttcctgggctacttcaagagcggcctgaagtacaagaagggcggcgtggccagcggcttcaagcacgtggtgcccaatgaggtggtggtgcagaggctcttccaggtgaagggccggcgggtggtgcgggccacagaggtgcctgtgtcctgggagagcttcaacaatggagactgcttcatcctggacctgggcaacaacatccaccagtggtgtggcagcaacagcaacagatatgaaaggctgaaggccacccaggtgtccaagggcatccgggacaatgaaagaagtggccgggcccgggtgcacgtgtctgaggagggcacagagcctgaggccatgctgcaggtgctgggccccaagccagccctgcctgctggaacagaggacacagccaaggaggatgctgccaacaggaagctggccaagctgtacaaggtgtccaatggagctggcaccatgtctgtgtccctggtggctgatgagaacccctttgcccagggcgccctgaagtctgaggactgcttcatcctggaccacggcaaggatggcaagatctttgtgtggaagggcaagcaggccaacacagaggagaggaaggccgccctgaagacagccagtgacttcatcaccaagatggactaccccaagcagacccaggtgtctgtgctgcctgagggcggggagacccccctcttcaagcagttcttcaagaactggagggaccctgaccagacagatggcctgggcctgagctacctgagcagccacatcgccaacgtggagcgggtgccctttgatgctgccaccctgcacaccagcacagccatggccgcccagcacggcatggatgatgatggcaccggccagaagcagatctggagaattgagggcagcaacaaggtgcctgtggaccctgccacctacggccagttctacggcggggacagctacatcatcctgtacaactacagacatggaggccggcagggccagatcatctacaactggcagggcgcccagagcacccaggatgaggtggccgccagcgccatcctgacagcccagctggatgaggagctgggcggcacccctgtgcagagccgggtggtgcagggcaaggagcccgcccacctgatgagcctgtttggaggcaagcccatgatcatctacaagggcggcaccagccgggagggcggccagacagccccagccagcaccaggctcttccaggtgcgggccaacagcgctggggccaccagggctgtggaggtgctgcccaaggccggggccctgaacagcaatgatgcctttgtgctgaagaccccatctgctgcctacctgtgggtgggcactggagccagcgaggccgagaagacaggagcccaggagctgctgcgggtgctgcgggcccagcctgtgcaggtggccgagggcagcgagccagatggcttctgggaggccctgggcggcaaggccgcctaccgcaccagcccccggctgaaggacaagaagatggatgcccaccccccccggctgtttgcctgcagcaacaagattggccgcttcgtcatcgaggaggtgcctggagagctgatgcaggaggacctggccacagatgatgtgatgctgctggacacctgggaccaggtgtttgtgtgggtgggcaaggacagccaggaggaggagaagacagaggccctgaccagcgccaagcgctacatcgagacagatcctgccaacagagacaggaggacccccatcaccgtggtgaagcagggctttgagccccccagctttgtgggctggttcctgggctgggatgatgactactggagcgtggaccccctggaccgggccatggccgagctggccgcctag

SEQ ID NO: 153658 - DNA, 4527 bp, Artificial Sequence
  Description of Artificial Sequence: Synthetic coding sequence
atgggccaggagcccaggaccctgccccccagccccaactggtactgtgcccgctgcagtgatgctgtgcctgggggcctgtttggatttgctgcccggacctctgtgttcctggtgcgggtgggccctggagctggggagagccctggcaccccacccttccgggtgattggagagctggtgggccacacagagcgggtgtctggcttcaccttcagccaccaccctggccagtacaacctgtgtgccaccagcagtgatgatggcaccgtgaagatctgggatgtggagaccaagacagtggtgacagaacatgccctgcaccagcacaccatcagcaccctgcactggagcccccgggtgaaggacctgattgtgtctggagatgagaagggcgtggtgttctgctactggttcaacagaaatgacagccagcacctgttcatcgagcccaggaccatcttctgcctgacctgcagcccccaccacgaggacctggtggccatcggctacaaggatggcatcgtggtgatcatcgacatcagcaagaagggggaggtgatccaccggctgcggggccatgatgatgagatccacagcatcgcctggtgccccctgcctggagaggactgcctgagcatcaaccaggaggagaccagcgaggaggccgagatcaccaatggaaatgctgtggcccaggcccctgtgaccaagggctgctacctggccaccggcagcaaggaccagaccatccgcatctggagctgcagccggggccggggcgtgatgatcctgaagctgcccttcctgaagaggcggggcggcggcatcgaccccaccgtgaaggagcggctgtggctgaccctgcactggcccagcaaccagcccacccagctggtgagcagctgcttcggcggggagctgctgcagtgggacctgacccagagctggaggaggaagtacaccctcttcagcgccagcagcgagggccagaaccacagccgcatcgtgttcaacctgtgccccctgcagacagaagatgacaagcagctgctgctgagcacctccatggacagagatgtgaagtgctgggacatcgccaccctggagtgctcctggaccctgcccagcctgggcggctttgcctacagcctggccttcagctctgtggacatcggcagcctggccatcggcgtgggagatggcatgatccgggtgtggaacaccctgagcatcaagaacaactatgatgtgaagaacttctggcagggcgtgaagagcaaggtgacagccctgtgctggcaccccaccaaggagggctgcctggccttcggcacagatgatggcaaggtgggcctgtatgacacctacagcaacaagccaccccagatcagcagcacctaccacaagaagacagtgtacaccctggcctggggcccccctgtgccccccatgagcctgggcggggagggggaccggcccagcctggccctgtacagctgtggcggggagggcatcgtgctgcagcacaacccctggaagctgagcggggaggcctttgacatcaacaagctgatccgggacaccaacagcatcaagtacaagctgcctgtgcacacagagatctcctggaaggcagatggcaagatcatggccctgggcaatgaagatggcagcattgagatcttccagatccccaacctgaagctgatctgcaccatccagcagcaccacaagctggtgaacaccatctcctggcaccacgagcacggcagccagcctgagctgagctacctgatggccagcggcagcaacaatgctgtgatctacgtgcacaacctgaagacagtcatcgagagcagccctgagagccctgtgaccatcacagagccctaccgcaccctgagcggccacacagccaagatcacctctgtggcctggagcccccaccatgatggccgcctggtgtctgccagctatgatggaacagcccaggtgtgggatgccctgcgggaggagcccctgtgcaacttccggggccaccggggccgcctgctgtgtgtggcctggagccccctggaccctgactgcatctacagcggggctgatgacttctgtgtgcacaagtggctgacctccatgcaggaccacagccggcccccccagggcaagaagagcattgagctggagaagaagaggctgagccagcccaaggccaagcccaagaagaagaagaagcccaccctgcggacccctgtgaagctggagagcattgatggaaatgaggaggagagcatgaaggagaacagcggccctgtggagaatggagtgtctgaccaggagggggaggagcaggcccgggagcctgagctgccctgtggcctggccccagctgtgtcccgggagcctgtgatctgcacccctgtgagcagcggctttgagaagagcaaggtgaccatcaacaacaaggtgatcctgctgaagaaggagccccccaaggagaagccagagaccctcatcaagaagaggaaggcccggagcctgctgcccctgagcaccagcctggaccacaggagcaaggaggagctgcaccaggactgcctggtgctggccacagccaagcacagccgggagctgaatgaagatgtgtctgcagatgtggaggagcgcttccacctgggcctcttcacagaccgggccaccctgtacaggatgattgacatcgagggcaagggccacctggagaatggccaccctgagctgttccaccagctgatgctgtggaagggggacctgaagggcgtgctgcagacagctgctgagcggggggagctgacagacaacctggtggccatggccccagctgctggctaccacgtgtggctgtgggccgtggaggcctttgccaagcagctgtgcttccaggaccagtatgtgaaggccgccagccacctgctgagcatccacaaggtgtatgaggccgtggagctgctgaagagcaaccacttctaccgggaggccatcgccatcgccaaggcccggctgcggcctgaggaccctgtgctgaaggacctgtacctgtcctggggcaccgtgctggagagagatggccactatgctgtggccgccaagtgctacctgggcgccacctgtgcctatgatgctgccaaggtgctggccaagaagggagatgctgccagcctgaggacagctgctgagctggccgccatcgtgggggaggatgagctgagcgccagcctggccctgcgctgtgcccaggagctgctgctggccaacaactgggtgggcgcccaggaggccctgcagctgcacgagagcctgcagggccagaggctggtgttctgcctgctggagctgctgagccgccacctggaggagaagcagctgtctgagggcaagagcagcagcagctaccacacctggaacacaggaacagagggcccctttgtggagcgggtgacagctgtgtggaagagcatcttcagcctggacaccccagagcagtaccaggaggccttccagaagctgcagaacatcaagtaccccagcgccaccaacaacaccccagccaagcagctgctgctgcacatctgccacgacctgaccctggccgtgctgagccagcagatggcctcctgggatgaagctgtgcaggccctgctgcgggctgtggtgcgctcctatgattctggcagcttcaccatcatgcaggaggtgtacagcgccttcctgcctgatggctgtgaccacctgcgggacaagctgggggaccaccagagccctgccaccccagccttcaagagcctggaggccttcttcctgtatggccgcctgtatgagttctggtggagcctgagccggccctgccccaacagctctgtgtgggtgcgggccggccacaggaccctgtctgtggagcccagccagcagctggacacagccagcacagaggagacagatcctgagaccagccagcctgagcccaaccggcccagcgagctggacctgcggctgacagaggagggggagaggatgctgagcaccttcaaggagctgttcagcgagaagcacgccagcctgcagaacagccagaggacagtggccgaggtgcaggagaccctggccgagatgatccggcagcaccagaagagccagctgtgcaagagcacagccaatggaccagacaagaatgaacctgaggtggaggccgagcagcccctgtgcagcagccagagccagtgcaaggaggagaagaatgagcccctgagcctgcctgagctgaccaagaggctgacagaggccaaccagaggatggccaagtttcctgagagcatcaaggcctggcccttcccagatgtgctggagtgctgcctggtgctgctgctgatccgcagccacttccctggctgcctggcccaggagatgcagcagcaggcccaggagctgctgcagaagtatggcaacaccaagacctaccgccgccactgccagaccttctgcatgtag

SEQ ID NO: 153659 - DNA, 396 bp, Artificial Sequence
  Description of Artificial Sequence: Synthetic coding sequence
atgcagacccctgtgaacatccctgtgcctgtgctgcggctgccccggggcccagatggcttcagccggggctttgccccagatggccggcgggcccccctgcggcctgaggtgcctgagatccaggagtgccccatcgcccaggagagcctggagagccaggagcagagggcccgggccgccctgcgggagcgctacctgcggagcctgctggccatggtgggccaccaggtgtccttcaccctgcatgaaggagtgcgggtggccgcccactttggagccacagacctggatgtggccaacttctacgtgtcccagctgcagacccccatcggcgtgcaggccgaggccctgctgcgctgcagcgacatcatctcctacaccttcaagccctag

SEQ ID NO: 153660 - DNA, 396 bp, Artificial Sequence; identical to SEQ ID NO: 153659
  Description of Artificial Sequence: Synthetic coding sequence

SEQ ID NO: 153661 - DNA, 2913 bp, Artificial Sequence
  Description of Artificial Sequence: Synthetic coding sequence
atggatgctgctgagcccggcctgcccccaggccctgagggcaggaagcgctacagcgacatcttccgcagcctggacaacctggagatcagcctgggcaatgtgaccctggagatgctggccggggaccccctgctgtctgaggaccctgagccagacaagacccccacagccaccgtgaccaatgaggccagctgctggagcggccccagccctgagggccctgtgcccctgactggagaggagctggacctgcggctcatccgcaccaagggcggcgtggatgctgccctggagtatgccaagacctggagccgctatgccaaggagctgctggcctggacagagaagagggccagctatgagctggagtttgccaagagcaccatgaagattgctgaggccggcaaggtgtccatccagcagcagagccacatgcccctgcagtacatctacaccctcttcctggagcatgacctgagcctgggcaccctggccatggagaccgtggcccagcagaagagggactactaccagcccctggccgccaagaggacagaaattgagaagtggaggaaggagttcaaggagcagtggatgaaggagcagaagaggatgaatgaagctgtgcaggccctgcggcgggcccagctgcagtatgtgcagaggtctgaggacctgcgggcccggagccagggcagccctgaggacagcgccccccaggccagccctggccccagcaagcagcaggagaggagaagaagaagccgggaggaggcccaggccaaggcccaggaggccgaggccctgtaccaggcctgtgtgcgggaggccaatgcccggcagcaggacctggagatcgccaagcagagaattgtgagccacgtgaggaagctggtgttccagggagatgaggtgctgcggcgggtgaccctgagcctgtttggcctgcggggggcccaggccgagcggggcccccgggcctttgctgccctggccgagtgctgtgccccctttgagcccggccagcgctaccaggagtttgtgcgggccctgcggcctgaggcccctcctcctcctcctccagccttctccttccaggagttcctgcccagcctgaacagcagccccctggacatcaggaagaagctgagcggccccctgcccccccggctggatgagaacagcgctgagcccggcccctgggaggaccccggcaccggctggcgctggcagggcaccccaggccccaccccaggcagtgatgtggacagcgtgggcggcggcagcgagagccgcagcctggacagccccaccagcagccctggggccggcacccggcagctggtgaaggccagcagcactggaacagagagcagtgatgactttgaggagcgggaccctgacctgggagatggcctggagaatggcctgggcagcccctttgggaagtggaccctgagcagcgctgcccagacccaccagctgcggcggctgcggggccctgccaagtgcagagaatgtgaggccttcatggtgtctggaacagaatgtgaggagtgcttcctgacctgccacaagcgctgcctggagaccctgctgatcctgtgtggccaccggcggctgcctgcccggacccccctgtttggagtggacttcctgcagctgccccgggacttccctgaggaggtgccctttgtggtgaccaagtgcacagctgagattgagcaccgggccctggatgtgcagggcatctacagagtgtctggcagccgggtgcgggtggagcggctgtgccaggcctttgaaaatggccgggccctggtggagctgagcggcaacagcccccatgatgtgtcctctgtgctgaagcgcttcctgcaggagctgacagagcctgtgatccccttccacctgtatgatgccttcatcagcctggccaagaccctgcacgccgaccctggagatgaccccggcacccccagccccagccctgaggtgatccgcagcctgaagaccctgctggtgcagctgcctgacagcaactacaacaccctgcggcacctggtggcccacctgttccgggtggccgcccgcttcatggagaacaagatgtctgccaacaacctgggcatcgtgtttggccccaccctgctgcggcccccagatggccccagggctgccagcgccatccctgtgacctgcctgctggacagcggccaccaggcccagctggtggagttcctgattgtgcactatgagcagatcttcggcatggatgagctgccccaggccacagagcccccaccccaggacagcagccctgcccctggccccctgaccaccagcagccagcccccaccaccccacctggaccctgacagccagccccctgtgctggccagtgaccccggccctgacccccagcaccacagcaccctggagcagcaccccacagccacccccacagagatccccaccccccagagcgaccagcgggaggatgtggccgaggacaccaaggatggcggcggggaggtgagcagccagggccctgaggacagcctgctgggcacccagagccggggccacttcagccggcagcctgtgaagtacccccggggcggcgtgcggcctgtgacccaccagctgagcagcctggccctggtggccagcaagctgtgtgaggagacccccatcacctctgtgccccggggcagcctgcggggccggggccccagccctgctgctgccagccctgagggcagccccctgcggaggacccccctgcccaagcactttgagatcacccaggagacagcccggctgctgagcaagctggacagcgaggccgtgccccgggccacctgctgcccagatgtgcagcctgaggaggccgaggaccacctgtag

SEQ ID NO: 153662 - DNA, 2826 bp, Artificial Sequence
  Description of Artificial Sequence: Synthetic coding sequence
atggatgctgctgagcccggcctgcccccaggccctgagggcaggaagcgctacagcgacatcttccgcagcctggacaacctggagatcagcctgggcaatgtgaccctggagatgctggccggggaccccctgctgtctgaggaccctgagccagacaagacccccacagccaccgtgaccaatgaggccagctgctggagcggccccagccctgagggccctgtgcccctgactggagaggagctggacctgcggctcatccgcaccaagggcggcgtggatgctgccctggagtatgccaagacctggagccgctatgccaaggagctgctggcctggacagagaagagggccagctatgagctggagtttgccaagagcaccatgaagattgctgaggccggcaaggtgtccatccagcagcagagccacatgcccctgcagtacatctacaccctcttcctggagcatgacctgagcctgggcaccctggccatggagaccgtggcccagcagaagagggactactaccagcccctggccgccaagaggacagaaattgagaagtggaggaaggagttcaaggagcagtggatgaaggagcagaagaggatgaatgaagctgtgcaggccctgcggcgggcccagctgcagtatgtgcagaggtctgaggacctgcgggcccggagccagggcagccctgaggacagcgccccccaggccagccctggccccagcaagcagcaggagaggagaagaagaagccgggaggaggcccaggccaaggcccaggaggccgaggccctgtaccaggcctgtgtgcgggaggccaatgcccggcagcaggacctggagatcgccaagcagagaattgtgagccacgtgaggaagctggtgttccagggagatgaggtgctgcggcgggtgaccctgagcctgtttggcctgcggggggcccaggccgagcggggcccccgggcctttgctgccctggccgagtgctgtgccccctttgagcccggccagcgctaccaggagtttgtgcgggccctgcggcctgaggcccctcctcctcctcctccagccttctccttccaggagttcctgcccagcctgaacagcagccccctggacatcaggaagaagctgagcggccccctgcccccccggctggatgagaacagcgctgagcccggcccctgggaggaccccggcaccggctggcgctggcagggccccaccccaggcagtgatgtggacagcgtgggcggcggcagcgagagccgcagcctggacagccccaccagcagcccagacctgggagatggcctggagaatggcctgggcagcccctttgggaagtggaccctgagcagcgctgcccagacccaccagctgcggcggctgcggggccctgccaagtgccgggagtgtgaggccttcatggtgtctggaacagaatgtgaggagtgcttcctgacctgccacaagcgctgcctggagaccctgctgatcctgtgtggccaccggcggctgcctgcccggacccccctgtttggagtggacttcctgcagctgccccgggacttccctgaggaggtgccctttgtggtgaccaagtgcacagctgagattgagcaccgggccctggatgtgcagggcatctacagagtgtctggcagccgggtgcgggtggagcggctgtgccaggcctttgaaaatggccgggccctggtggagctgagcggcaacagcccccatgatgtgtcctctgtgctgaagcgcttcctgcaggagctgacagagcccgtcatccccttccacctgtatgatgccttcatcagcctggccaagaccctgcatgctgaccctggagatgatcctggcacccccagccccagccctgaggtgatccgcagcctgaagaccctgctggtgcagctgcctgacagcaactacaacaccctgcggcacctggtggcccacctgttccgggtggccgcccgcttcatggagaacaagatgtctgccaacaacctgggcatcgtgtttggccccaccctgctgcggcccccagatggcccccgggccgccagcgccatccctgtgacctgcctgctggacagcggccaccaggcccagctggtggagttcctgattgtgcactatgagcagatcttcggcatggatgagctgccccaggccacagagcccccaccccaggacagcagccctgcccctggccccctgaccaccagcagccagcccccaccaccccacctggaccctgacagccagccccctgtgctggccagtgaccccggccctgacccccagcaccacagcaccctggagcagcaccccacagccacccccacagagatccccaccccccagagcgaccagagagaagatgtggccgaggacaccaaggatggcggcggggaggtgagcagccagggccctgaggacagcctgctgggcacccagagccggggccacttcagccggcagcctgtgaagtacccccggggcggcgtgcggcctgtgacccaccagctgagcagcctggccctggtggccagcaagctgtgtgaggagacccccatcacctctgtgccccggggcagcctgcggggccggggccccagccctgctgctgccagccctgagggcagccccctgcggaggacccccctgcccaagcactttgagatcacccaggagacagcccggctgctgagcaagctggacagcgaggccgtgccccgggccacctgctgcccagatgtgcagcctgaggaggccgaggaccacctgtag

SEQ ID NO: 153663 - DNA, 1005 bp, Artificial Sequence
  Description of Artificial Sequence: Synthetic coding sequence
atgaacaccatcctgccctgccaggaccagtactttgtgggcggccagagctacaactgcccctacagcaccaccaccagcgagagctctgtggatgtgtccacagagacctgggtgtccttctgggccgccggcctgctggacaaccgggagctgcagcaggccccccaggcccaggagagcttcagtgacagcaacttccccctgcctgacctgtgctcctgggaggaggcccagctgagcagccagctgtacagaaacaagcagctgcaggacaccctggtgcagaaggaggaggagctggcccggctgcacgaggagaacaaccacctgcggcagtacctgaacagcgccctggtgaagtgcctggaggagaaggccaagaagctgctgagcagtgatgagttcagcaaggcctacggcaagttcaggaagggcaagaggaagagcaaggagcagcgctacagccctgctgagatcccccaccccaagaatgccaagaggaacctgagcagcgagtttgccaactgtgaggagcaggccggcccccctgtggacccctgggtgctgcagaccctgggcctgaaggacctggacaccattgatgacaccagcagcgccaactacagcgccctggccagccaccccaggagagtggccagcaccttcagccagttcccagatgatgctgtggactacaagaacatcccccgggaggacatgcccatcgactacagaggagacaggaccacccccctgcacagcacagccacccatggagaggacttccacatcctgagccagctgagcaacccccctgtgggcctgaagaccctgccctactacacagcccacgtgagccccaacaagacagagatggccttcagcaccagcctgagcccccactgcaatgtgaagacccacagcttccaccagggccaggcctttgtgagaagagatgaggagggcggctggaagttcacctgggtgcccaagcagagctag

SEQ ID NO: 153664 - DNA, 2727 bp, Artificial Sequence
  Description of Artificial Sequence: Synthetic coding sequence
atgggcgtgaatgacctgtggcagatcctggagcctgtgaagcagcacatccccctgaggaacctgggcggcaagaccatcgctgtggacctgagcctgtgggtgtgtgaggcccagacagtgaagaagatgatgggctctgtgatgaagccccacctgaggaacctcttcttccgcatctcctacctgacccagatggatgtgaagctggtgtttgtgatggagggggagccccccaagctgaaggcagatgtgatcagcaagaggaaccagagccgctatggcagcagcggcaagtcctggagccagaagacaggccgcagccacttcaagtctgtgctgcgggagtgcctgcacatgctggagtgcctgggcatcccctgggtgcaggccgccggggaggccgaggccatgtgtgcctacctgaatgctgggggccacgtggatggctgcctgaccaatgatggagacaccttcctgtatggagcccagacagtgtacagaaacttcaccatgaacaccaaggacccccacgtggactgctacaccatgagcagcatcaagagcaagctgggcctggacagagatgccctggtgggcctggccatcctgctgggctgtgactacctgcccaagggcgtgcctggggtgggcaaggagcaggccctgaagctgatccagatcctgaagggccagagcctgctgcagcgcttcaaccgctggaatgagaccagctgcaacagcagcccccagctgctggtgaccaagaagctggcccactgcagcgtgtgcagccaccctggcagccccaaggaccatgaaagaaatggctgccgcctgtgcaagagtgacaagtactgtgagccccatgactatgagtactgctgcccctgtgagtggcacaggacagaacatgaccggcagctgtctgaggtggagaacaacatcaagaagaaggcctgctgctgtgagggcttccccttccatgaagtcatccaggagttcctgctgaacaaggacaagctggtgaaggtgatccgctaccagaggccagacctgctgctcttccagcgcttcaccctggagaagatggagtggcccaaccactacgcctgtgagaagctgctggtgctgctgacccactatgacatgattgaaaggaagctgggcagcaggaacagcaaccagctgcagcccatccgcatcgtgaagacccgcatcagaaatggagtgcactgctttgaaattgagtgggagaagccagagcactacgccatggaggacaagcagcacggggagtttgccctgctgaccatcgaggaggagagcctgtttgaagctgcctacccagagatcgtggccgtgtaccagaagcagaagctggagatcaagggcaagaagcagaagaggatcaagcccaaggagaacaacctgcctgagccagatgaggtgatgtccttccagagccacatgaccctgaagcccacctgtgagatcttccacaagcagaacagcaagctgaacagcggcatcagcccagaccccaccctgccccaggagagcatcagcgccagcctgaacagcctgctgctgcccaagaacaccccctgcctgaatgcccaggagcagttcatgagcagcctgcggcccctggccatccagcagatcaaggctgtgtccaagagcctcatcagcgagagcagccagcccaacaccagcagccacaacatctctgtgattgctgacctgcacctgagcaccatcgactgggagggcaccagcttcagcaacagccctgccatccagaggaacaccttcagccatgacctgaagtctgaggtggagagcgagctgagcgccatcccagatggctttgagaacatccctgagcagctgagctgtgagagcgagcgctacacagccaacatcaagaaggtgctggatgaagattctgatggcatcagccctgaggagcacctgctgagcggcatcacagacctgtgcctgcaggacctgcccctgaaggagcgcatcttcaccaagctgagctacccccaggacaacctgcagccagatgtgaacctgaagaccctgagcatcctgtctgtgaaggagagctgcatcgccaacagcggcagtgactgcaccagccacctgagcaaggacctgcccggcatccccctgcagaatgaaagccgggacagcaagatcctgaagggggaccagctgctgcaggaggactacaaggtgaacacctctgtgccctacagcgtgagcaacacagtggtgaagacctgcaatgtgcggccccccaacacagccctggaccacagcaggaaggtggacatgcagaccaccaggaagatcctgatgaagaagtctgtgtgcctggacagacacagcagtgatgagcagagcgcccctgtgtttgggaaggccaagtacaccacccagaggatgaagcacagcagccagaagcacaacagcagccacttcaaggagagcggccacaacaagctgagcagccccaagatccacatcaaggagacagagcagtgtgtgcgctcctatgaaacagcagaaaatgaggagagctgcttcccagacagcaccaagagcagcctgagcagcctgcagtgccacaagaaggagaacaacagcggcacctgcctggacagccccctgcccctgcggcagaggctgaagctgcgcttccagagcacctag

SEQ ID NO: 153665 - DNA, 2727 bp, Artificial Sequence; identical to SEQ ID NO: 153664
  Description of Artificial Sequence: Synthetic coding sequence

SEQ ID NO: 153666 - DNA, 381 bp, Artificial Sequence
  Description of Artificial Sequence: Synthetic coding sequence
atgggcgtgaatgacctgtggcagatcctggagcctgtgaagcagcacatccccctgaggaacctgggcggcaagaccatcgctgtggacctgagcctgtgggtgtgtgaggcccagacagtgaagaagatgatgggctctgtgatgaagccccacctgaggaacctcttcttccgcatctcctacctgacccagatggatgtgaagctggtgtttgtgatggagggggagccccccaagctgaaggcagatgtgatcagcaagaggaaccagagccgctatggcagcagcggcaagtcctggagccagaagacaggccgcagccacttcaagtctgtgctgcgggagtgcctgcacatgctggagtgcctgggcatctag

SEQ ID NO: 153667 - DNA, 282 bp, Artificial Sequence
  Description of Artificial Sequence: Synthetic coding sequence
atgggcgtgaatgacctgtggcagatcctggagcctgtgaagcagcacatccccctgaggaacctgggcggcaagaccatcgctgtggacctgagcctgtgggtgtgtgaggcccagacagtgaagaagatgatgggctctgtgatgaagccccacctgaggaacctcttcttccgcatctcctacctgacccagatggatgtgaagctggtgtttgtgatggagggggagccccccaagctgaaggcagatgtgatcagcaagaggaaccagagcaggtag

SEQ ID NO: 153668 - DNA, 1431 bp, Artificial Sequence
  Description of Artificial Sequence: Synthetic coding sequence
atggagtggcccaaccactacgcctgtgagaagctgctggtgctgctgacccactatgacatgattgaaaggaagctgggcagcaggaacagcaaccagctgcagcccatcagaattgtgaagacccgcatcagaaatggagtgcactgctttgaaattgagtgggagaagccagagcactacgccatggaggacaagcagcacggggagtttgccctgctgaccatcgaggaggagagcctgtttgaggccgcctacccagaaattgtggccgtgtaccagaagcagaagctggagatcaagggcaagaagcagaagaggatcaagcccaaggagaacaacctgcctgagccagatgaggtgatgtccttccagagccacatgaccctgaagcccacctgtgagatcttccacaagcagaacagcaagctgaacagcggcatcagcccagaccccaccctgccccaggagagcatcagcgccagcctgaacagcctgctgctgcccaagaacaccccctgcctgaatgcccaggagcagttcatgagcagcctgcggcccctggccatccagcagatcaaggctgtgtccaagagcctcatcagcgagagcagccagcccaacaccagcagccacaacatctctgtgattgctgacctgcacctgagcaccatcgactgggagggcaccagcttcagcaacagccctgccatccagaggaacaccttcagccatgacctgaagtctgaggtggagagcgagctgagcgccatcccagatggctttgagaacatccctgagcagctgagctgtgagagcgagcgctacacagccaacatcaagaaggtgctggatgaggacagtgatggcatcagccctgaggagcacctgctgagcggcatcacagacctgtgcctgcaggacctgcccctgaaggagcgcatcttcaccaagctgagctacccccaggacaacctgcagccagatgtgaacctgaagaccctgagcatcctgtctgtgaaggagagctgcatcgccaacagcggcagtgactgcaccagccacctgagcaaggacctgcccggcatccccctgcagaatgaaagccgggacagcaagatcctgaagggggaccagctgctgcaggaggactacaaggtgaacacctctgtgccctacagcgtgagcaacacagtggtgaagacctgcaatgtgcggccccccaacacagccctggaccacagcaggaaggtggacatgcagaccaccaggaagatcctgatgaagaagtctgtgtgcctggacagacacagcagtgatgagcagagcgcccctgtgtttgggaaggccaagtacaccacccagaggatgaagcacagcagccagaagcacaacagcagccacttcaaggagagcggccacaatgaatag

SEQ ID NO: 153669 - DNA, 1437 bp, Artificial Sequence
  Description of Artificial Sequence: Synthetic coding sequence
atggcctgcctgaaccctgtgcccaagctgtacagatctgtgattgaagatgtgattgaaggagtgaggaacctgtttgctgaggagggcatcgaggagcaggtgctgaaggacctgaagcagctgtgggagaccaaggtgctgcagagcaaggccacagaggacttcttcaggaacagcatccagagccccctcttcaccctgcagctgccccacagcctgcaccagaccctgcagagcagcacagccagcctggtgatcccagctggccgcaccctgcccagcttcaccacagctgagctgggcaccagcaacagcagcgccaacttcaccttccctggctaccccatccacgtgcctgctggggtgaccctgcagacagtgtctggccacctgtacaaggtgaatgtgcccatcatggtgacagagaccagcggccgggccggcatcctgcagcaccccatccagcaggtgttccagcagctgggccagcccagcgtcatccagacctctgtgccccagctgaacccctggagcctgcaggccaccacagagaagagccagagaattgagaccgtgctgcagcagcctgccatcctgcccagcggccctgtggacaggaagcacctggagaatgccaccagtgacatcctggtgtccccaggaaatgagcacaagatcgtgcctgaggccctgctgtgccaccaggagagcagccactacatcagcctgcccggggtggtgttcagcccccaggtgtcccagaccaacagcaatgtggagagcgtgctgagcggcagcgcctccatggcccagaacctgcatgatgagagcctgagcaccagcccccacggggccctgcaccagcacgtgacagacatccagctgcacatcctgaagaacaggatgtatggctgtgacagcgtgaagcagcccagaaatattgaggagcccagcaacatccctgtgtctgagaaggacagcaacagccaggtggacctgagcatccgggtgacagatgatgacattggagagatcatccaggtggatggcagcggggacaccagcagcaatgaggagatcggcagcaccagagatgctgatgaaaatgagttcctgggcaacattgatggaggagacctgaaggtgcctgaggaggaggccgacagcatcagcaatgaagacagcgccaccaacagcagtgacaatgaagacccccaggtgaacatcgtggaggaggaccccctgaacagcggagatgatgtgtctgagcaggatgtgcctgacctgtttgacacagacaacgtgattgtgtgccagtatgacaagatccacaggagcaagaacaagtggaagttctacctgaaggatggagtgatgtgcttcggcggccgggactatgtgtttgccaaggccatcggagatgctgagtggtag

SEQ ID NO: 153670 - DNA, 1335 bp, Artificial Sequence
  Description of Artificial Sequence: Synthetic coding sequence
atggcctgcctgaaccctgtgctgtgggagaccaaggtgctgcagagcaaggccacagaggacttcttcaggaacagcatccagagccccctcttcaccctgcagctgccccacagcctgcaccagaccctgcagagcagcacagccagcctggtgatcccagctggccgcaccctgcccagcttcaccacagctgagctgggcaccagcaacagcagcgccaacttcaccttccctggctaccccatccacgtgcctgctggggtgaccctgcagacagtgtctggccacctgtacaaggtgaatgtgcccatcatggtgacagagaccagcggccgggccggcatcctgcagcaccccatccagcaggtgttccagcagctgggccagcccagcgtcatccagacctctgtgccccagctgaacccctggagcctgcaggccaccacagagaagagccagagaattgagaccgtgctgcagcagcctgccatcctgcccagcggccctgtggacaggaagcacctggagaatgccaccagtgacatcctggtgtccccaggaaatgagcacaagatcgtgcctgaggccctgctgtgccaccaggagagcagccactacatcagcctgcccggggtggtgttcagcccccaggtgtcccagaccaacagcaatgtggagagcgtgctgagcggcagcgcctccatggcccagaacctgcatgatgagagcctgagcaccagcccccacggggccctgcaccagcacgtgacagacatccagctgcacatcctgaagaacaggatgtatggctgtgacagcgtgaagcagcccagaaatattgaggagcccagcaacatccctgtgtctgagaaggacagcaacagccaggtggacctgagcatccgggtgacagatgatgacattggagagatcatccaggtggatggcagcggggacaccagcagcaatgaggagatcggcagcaccagagatgctgatgaaaatgagttcctgggcaacattgatggaggagacctgaaggtgcctgaggaggaggccgacagcatcagcaatgaagacagcgccaccaacagcagtgacaatgaagacccccaggtgaacatcgtggaggaggaccccctgaacagcggagatgatgtgtctgagcaggatgtgcctgacctgtttgacacagacaacgtgattgtgtgccagtatgacaagatccacaggagcaagaacaagtggaagttctacctgaaggatggagtgatgtgcttcggcggccgggactatgtgtttgccaaggccatcggagatgctgagtggtag

SEQ ID NO: 153671 - DNA, 951 bp, Artificial Sequence
  Description of Artificial Sequence: Synthetic coding sequence
atggccagcaccagccggctggatgccctgccccgggtgacctgccccaaccacccagatgccatcctggtggaggactacagagctggggacatgatctgcccagaatgtggcctggtggtgggggacagagtgattgatgtgggcagcgagtggaggaccttcagcaatgacaaggccaccaaggaccccagccgggtgggggacagccagaaccccctgctgagtgatggagacctgagcaccatgattggcaagggcaccggggccgccagctttgatgaatttggaaacagcaagtaccagaacagaaggaccatgagcagcagtgaccgggccatgatgaatgccttcaaggagatcaccaccatggctgaccgcatcaacctgcccaggaacatcgtggacaggaccaacaacctcttcaagcaggtgtatgagcagaagagcctgaagggccgggccaatgatgccatcgccagcgcctgcctgtacatcgcctgccggcaggagggcgtgcccaggaccttcaaggagatctgtgctgtgagccgcatcagcaagaaggagatcggccgctgcttcaagctgatcctgaaggccctggagacctctgtggacctgatcaccactggagacttcatgagccgcttctgcagcaacctgtgcctgcccaagcaggtgcagatggccgccacccacatcgccaggaaggctgtggagctggacctggtgcccggccgcagccccatctctgtggccgccgccgccatctacatggccagccaggccagcgctgagaagaggacccagaaggagatcggggacattgctggggtggctgatgtgaccatccggcagagctaccgcctcatctacccccgggccccagacctcttccccacagacttcaagtttgacacccctgtggacaagctgccccagctgtag

SEQ ID NO: 153672 - DNA, 696 bp, Artificial Sequence
  Description of Artificial Sequence: Synthetic coding sequence
atggccagcaccagccggctggatgccctgccccgggtgacctgccccaaccacccagatgccatcctggtggaggactacagagctggggacatgatctgcccagaatgtgacagagtgattgatgtgggcagcgagtggaggaccttcagcaatgacaaggccaccaaggaccccagccgggtgggggacagccagaaccccctgctgagtgatggagacctgagcaccatgattggaaaaggaactggagctgccagctttgatgaatttggaaacagcaagtaccagaacagaaggaccatgagcagcagtgaccgggccatgatgaatgccttcaaggagatcaccaccatggctgaccgcatcaacctgcccagaaatattgtggacaggaccaacaacctcttcaagcaggtgtatgagcagaagagcctgaagggccgggccaatgatgccatcgccagcgcctgcctgtacatcgcctgccggcaggagggcgtgcccaggaccttcaaggagatctgtgctgtgagccgcatcagcaagaaggagatcggccgctgcttcaagctgatcctgaaggccctggagacctctgtggacctgatcaccaccggggacttcatgagccgcttctgcagcaacctgtgcctgcccaagcaggtgcagatggccgccacccacatcgcctag

SEQ ID NO: 153673 - DNA, 675 bp, Artificial Sequence
  Description of Artificial Sequence: Synthetic coding sequence
gccagcaccagccggctggatgccctgccccgggtgacctgccccaaccacccagatgccatcctggtggaggactaccgggccggggacatgatctgcccagaatgtggcctggtggtgggggacagagtgattgatgtgggcagcgagtggaggaccttcagcaatgacaaggccaccaaggaccccagccgggtgggggacagccagaaccccctgctgagtgatggagacctgagcaccatgattggaaaaggaactggagctgccagctttgatgaatttggaaacagcaagtaccagaacagaaggaccatgagcagcagtgaccgggccatgatgaatgccttcaaggagatcaccaccatggctgaccgcatcaacctgcccagaaatattgtggacaggaccaacaacctcttcaagcaggtgtatgagcagaagagcctgaagggccgggccaatgatgccatcgccagcgcctgcctgtacatcgcctgccggcaggagggcgtgcccaggaccttcaaggagatctgtgctgtgagccgcatcagcaagaaggagatcggccgctgcttcaagctgatcctgaaggccctggagacctctgtggacctgatcaccaccggggacttcatgagcaggaactggagatactgctggtgctgctag

SEQ ID NO: 153674 - DNA, 876 bp, Artificial Sequence
  Description of Artificial Sequence: Synthetic coding sequence
atggaccccagcctgctgcgggagcgggagctgttcaagaagagggccctgagcacccctgtggtggagaagaggtctgccagcagcgagagcagcagcagcagcagcaagaagaagaagaccaaggtggagcacggcggcagcagcggcagcaagcagaacagcgaccacagcaatggcagcttcaacctgaaggccctgagcggcagcagcggctacaagtttggagtgctggccaagatcgtgaactacatgaagaccaggcaccagagaggagacacccaccccctgaccctggatgagatcctggatgagacccagcacctggacatcggcctgaagcagaagcagtggctgatgacagaggccctggtgaacaaccccaagattgaggtgattgatggcaagtatgccttcaagcccaagtacaacgtgcgggacaagaaggccctgctgcggctgctggaccagcacgaccagaggggcctgggcggcatcctgctggaggacatcgaggaggccctgcccaacagccagaaggctgtgaaggccctgggggaccagatcctgtttgtgaacagaccagacaagaagaagatcctcttcttcaatgacaagagctgccagttctctgtggatgaggagttccagaagctgtggaggtctgtgacagtggacagcatggatgaggagaagattgaggagtacctgaagaggcagggcatcagctccatgcaggagagcggccccaagaaggtggcccccatccagaggaggaagaagccagccagccagaagaagaggcgcttcaagacccacaatgagcacctggccggcgtgctgaaggactacagcgacatcaccagcagcaagtag

SEQ ID NO: 153675 - DNA, 381 bp, Artificial Sequence
  Description of Artificial Sequence: Synthetic coding sequence
atggaccccagcctgctgcgggagcgggagctgttcaagaagagggccctgagcacccctgtggtggagaagaggtctgccagcagcgagagcagcagcagcagcagcaagaagaagaagaccaaggtggagcacggcggcagcagcggcagcaagcagaacagcgaccacagcaatggcagcttcaacctgaaggccctgagcggcagcagcggctacaagtttggagtgctggccaagatcgtgaactacatgaagaccaggcaccagagaggagacacccaccccctgaccctggatgagatcctggatgagacccagcacctggacatcggcctgaagcagaagcagtggctgatgacagaggccctggtgaactag

SEQ ID NO: 153676 - DNA, 597 bp, Artificial Sequence
  Description of Artificial Sequence: Synthetic coding sequence
atggaccccagcctgctgcgggagcgggagctgttcaagaagagggccctgagcacccctgtggtggagaagaggtctgccagcagcgagagcagcagcagcagcagcaagaagaagaagaccaaggtggagcacggcggcagcagcggcagcaagcagaacagcgaccacagcaatggcagcttcaacctgaaggccctgagcggcagcagcggctacaagtttggagtgctggccaagatcgtgaactacatgaagaccaggcaccagagaggagacacccaccccctgaccctggatgagatcctggatgagacccagcacctggacatcggcctgaagcagaagcagtggctgatgacagaggccctggtgaacaaccccaagattgaggtgattgatggcaagtatgccttcaagcccaagtacaacgtgcgggacaagaaggccctgctgcggctgctggaccagcacgaccagaggggcctgggcggcatcctgctggaggacatcgaggaggccctgcccaacagccagaaggctgtgaaggccctgggggaccagatcctgtttgtgaacagaccagacaagaagtag

SEQ ID NO: 153677 - DNA, 1554 bp, Artificial Sequence
  Description of Artificial Sequence: Synthetic coding sequence
atggccgccctgggccccagcagccagaatgtgacagaatatgtggtgcgggtgcccaagaacaccaccaagaagtacaacatcatggccttcaatgctgctgacaaggtgaactttgccacctggaaccaggcccggctggagcgggacctgagcaacaagaagatctaccaggaggaggagatgcctgagagcggggccggcagcgagttcaacaggaagctgcgggaggaggcccggaggaagaagtatggcatcgtgctgaaggagttccggcctgaggaccagccctggctgctgcgggtgaatggcaagagcggcaggaagttcaagggcatcaagaagggcggcgtgacagagaacaccagctactacatcttcacccagtgcccagatggagcctttgaggccttccctgtgcacaactggtacaacttcacccccctggcccggcacaggaccctgacagctgaggaggccgaggaggagtgggagaggaggaacaaggtgctgaaccacttcagcatcatgcagcagaggcggctgaaggaccaggaccaggatgaagatgaggaggagaaggagaagagaggaagaaggaaggccagcgagctgcgcatccatgacctggaggatgacctggagatgagcagtgatgccagtgatgccagcggggaggagggcggccgggtgcccaaggccaagaagaaggcccccctggccaagggcggcaggaagaagaagaagaagaagggcagtgatgatgaggcctttgaagattctgatgatggagactttgagggccaggaggtggactacatgtctgatggcagcagcagcagccaggaggagcctgagagcaaggccaaggccccccagcaggaggagggccccaagggcgtggatgagcagagcgacagcagcgaggagagcgaggaggagaagcccccagaggaggacaaggaggaggaggaggagaagaaggcccccaccccccaggagaagaagaggaggaaggacagcagcgaggagagtgacagcagcgaggagagtgacattgattctgaggccagcagcgccctcttcatggccaagaagaagaccccacccaagcgggagaggaagcccagcggcggcagcagccggggcaacagcaggcctggcaccccatctgctgagggcggcagcaccagcagcaccctgcgggccgccgccagcaagctggagcagggcaagagggtgtctgagatgcctgctgccaagaggctgcggctggacaccggcccccagagcctgagcggcaagagcaccccccagccccccagcggcaagaccacccccaacagcggagatgtgcaggtgacagaagatgctgtgcggcgctacctgaccaggaagcccatgaccaccaaggacctgctgaagaagttccagaccaagaagacaggcctgagcagcgagcagacagtgaatgtgctggcccagatcctgaagaggctgaaccctgagaggaagatgatcaatgacaagatgcacttcagcctgaaggagtag

SEQ ID NO: 153678 - DNA, 1299 bp, Artificial Sequence
  Description of Artificial Sequence: Synthetic coding sequence
atggccttcaatgctgctgacaaggtgaactttgccacctggaaccaggcccggctggagcgggacctgagcaacaagaagatctaccaggaggaggagatgcctgagagcggggccggcagcgagttcaacaggaagctgcgggaggaggcccggaggaagaagtatggcatcgtgctgaaggagttccggcctgaggaccagccctggctgctgcgggtgaatggcaagagcggcaggaagaggaacaaggtgctgaaccacttcagcatcatgcagcagaggcggctgaaggaccaggaccaggatgaagatgaggaggagaaggagaagaggggccgcaggaaggccagcgagctgcgcatccatgacctggaggatgacctggagatgagcagtgatgccagtgatgccagcggggaggagggcggccgggtgcccaaggccaagaagaaggcccccctggccaagggcggcaggaagaagaagaagaagaagggcagtgatgatgaggcctttgaggacagtgatgatggagactttgagggccaggaggtggactacatgtctgatggcagcagcagcagccaggaggagcctgagagcaaggccaaggccccccagcaggaggagggccccaagggcgtggatgagcagagcgacagcagcgaggagagcgaggaggagaagcccccagaggaggacaaggaggaggaggaggagaagaaggcccccaccccccaggagaagaagaggaggaaggacagcagcgaggagagtgacagcagcgaggagagtgacatcgacagcgaggccagcagcgccctcttcatggccaagaagaagaccccacccaagcgggagaggaagcccagcggcggcagcagccggggcaacagccggcccggcacccccagcgctgagggcggcagcaccagcagcaccctgcgggctgctgccagcaagctggagcagggcaagagggtgtctgagatgcctgctgccaagaggctgcggctggacaccggcccccagagcctgagcggcaagagcaccccccagcccccatctgggaagaccacccccaacagcggagatgtgcaggtgacagaagatgctgtgcggcgctacctgaccaggaagcccatgaccaccaaggacctgctgaagaagttccagaccaagaagacaggcctgagcagcgagcagacagtgaatgtgctggcccagatcctgaagaggctgaaccctgagaggaagatgatcaatgacaagatgcacttcagcctgaaggagtag

SEQ ID NO: 153679 - DNA, 384 bp, Artificial Sequence
  Description of Artificial Sequence: Synthetic coding sequence
atggccgccctgggccccagcagccagaatgtgacagaatatgtggtgcgggtgcccaagaacaccaccaagaagtacaacatcatggccttcaatgctgctgacaaggtgaactttgccacctggaaccaggcccggctggagcgggacctgagcaacaagaagatctaccaggaggaggagatgcctgagagcggggccggcagcgagttcaacaggaagctgcgggaggaggcccggaggaagaagtatggcatcgtgctgaaggagttccggcctgaggaccagccctggctgctgcgggtgaatggcaagagcggcaggaagttcaagggcatcaagaagggcggcgtgacagagaacaccagctactacatcttctag

SEQ ID NO: 153680 - DNA, 1647 bp, Artificial Sequence
  Description of Artificial Sequence: Synthetic coding sequence
atggccaccagcagcgaggaggtgctgctgattgtgaagaaggtgcggcagaagaagcaggatggagccctgtacctgatggccgagagaattgcctgggcccctgagggcaaggaccgcttcaccatcagccacatgtatgctgacatcaagtgccagaagatcagccctgagggcaaggccaagatccagctgcagctggtgctgcatgctggggacaccaccaacttccacttcagcaatgaaagcacagctgtgaaggagagagatgctgtgaaggacctgctgcagcagctgctgcccaagttcaagaggaaggccaacaaggagctggaggagaagaacaggatgctgcaggaggaccctgtgctcttccagctgtacaaggacctggtggtgtcccaggtgatctctgctgaggagttctgggccaaccggctgaatgtgaatgccacagacagcagcagcaccagcaaccacaagcaggatgtgggcatctctgctgccttcctggctgatgtgcggccccagacagatggctgcaatggcctgcgctacaacctgaccagtgacatcatcgagagcatcttccgcacctacccagctgtgaagatgaagtatgcagaaaatgtgccccacaacatgacagagaaggagttctggacccgcttcttccagagccactacttccaccgggaccggctgaacacaggcagcaaggacctgtttgctgaatgtgccaagattgatgagaagggcctgaagaccatggtgtccctgggcgtgaagaaccccctgctggacctgacagccctggaggacaagcccctggatgagggctacggcatcagctctgtgcccagcgccagcaacagcaagagcatcaaggagaacagcaatgctgccatcatcaagcgcttcaaccaccacagcgccatggtgctggccgccggcctgaggaagcaggaggcccagaatgagcagaccagcgagcccagcaacatggatggcaacagcggagatgctgactgcttccagcctgctgtgaagagggccaagctgcaggagagcattgaatatgaggacctgggcaagaacaacagcgtgaagaccatcgccctgaacctgaagaagagtgaccgctactaccacggccccacccccatccagagcctgcagtatgccaccagccaggacatcatcaacagcttccagagcatccggcaggagatggaggcctacacccccaagctgacccaggtgctgagcagcagcgctgccagcagcaccatcacagccctgagccctgggggcgccctgatgcagggcggcacccagcaggccatcaaccagatggtgcccaatgacatccagagcgagctgaagcacctgtatgtggccgtgggggagctgctgcggcacttctggagctgcttccctgtgaacacccccttcctggaggagaaggtggtgaagatgaagagcaacctggagcgcttccaggtgaccaagctgtgccccttccaggagaagatccggcggcagtacctgagcaccaacctggtgagccacatcgaggagatgctgcagacagcctacaacaagctgcacacctggcagagccggcggctgatgaagaagacctag

SEQ ID NO: 153681 - DNA, 1647 bp, Artificial Sequence; identical to SEQ ID NO: 153680
  Description of Artificial Sequence: Synthetic coding sequence

SEQ ID NO: 153682 - DNA, 288 bp, Artificial Sequence
  Description of Artificial Sequence: Synthetic coding sequence
atggccaccagcagcgaggaggtgctgctgattgtgaagaaggtgcggcagaagaagcaggatggagccctgtacctgatggccgagagaattgcctgggcccctgagggcaaggaccgcttcaccatcagccacatgtatgctgacatcaagtgccagaagatcagccctgagggcaaggccaagatccagctgcagctggtgctgcatgctggggacaccaccaacttccacttcagcaatgaaagcacagctgtgaaggagagagatgctgtgaaggacctgtag

SEQ ID NO: 153683 - DNA, 1299 bp, Artificial Sequence
  Description of Artificial Sequence: Synthetic coding sequence
atgctgcaggaggaccctgtgctcttccagctgtacaaggacctggtggtgtcccaggtgatctctgctgaggagttctgggccaaccggctgaatgtgaatgccacagacagcagcagcaccagcaaccacaagcaggatgtgggcatctctgctgccttcctggctgatgtgcggccccagacagatggctgcaatggcctgcgctacaacctgaccagtgacatcatcgagagcatcttccgcacctacccagctgtgaagatgaagtatgcagaaaatgtgccccacaacatgacagagaaggagttctggacccgcttcttccagagccactacttccaccgggaccggctgaacacaggcagcaaggacctgtttgctgaatgtgccaagattgatgagaagggcctgaagaccatggtgtccctgggcgtgaagaaccccctgctggacctgacagccctggaggacaagcccctggatgagggctacggcatcagctctgtgcccagcgccagcaacagcaagagcatcaaggagaacagcaatgctgccatcatcaagcgcttcaaccaccacagcgccatggtgctggccgccggcctgaggaagcaggaggcccagaatgagcagaccagcgagcccagcaacatggatggcaacagcggagatgctgactgcttccagcctgctgtgaagagggccaagctgcaggagagcattgaatatgaggacctgggcaagaacaacagcgtgaagaccatcgccctgaacctgaagaagagtgaccgctactaccacggccccacccccatccagagcctgcagtatgccaccagccaggacatcatcaacagcttccagagcatccggcaggagatggaggcctacacccccaagctgacccaggtgctgagcagcagcgctgccagcagcaccatcacagccctgagccctgggggcgccctgatgcagggcggcacccagcaggccatcaaccagatggtgcccaatgacatccagagcgagctgaagcacctgtatgtggccgtgggggagctgctgcggcacttctggagctgcttccctgtgaacacccccttcctggaggagaaggtggtgaagatgaagagcaacctggagcgcttccaggtgaccaagctgtgccccttccaggagaagatccggcggcagtacctgagcaccaacctggtgagccacatcgaggagatgctgcagacagcctacaacaagctgcacacctggcagagccggcggctgatgaagaagacctag

SEQ ID NO: 153684 - DNA, 1188 bp, Artificial Sequence
  Description of Artificial Sequence: Synthetic coding sequence
atggatgaggagcctgagaggaccaagcgctgggagggcggctatgaaagaacctgggagatcctgaaggaggatgaaagtggcagcctgaaggccaccatcgaggacatcctcttcaaggccaagaggaagagggtgtttgagcaccacggccaggtgcggctgggcatgatgaggcacctgtatgtggtggtggatggcagcaggaccatggaggaccaggacctgaagcccaaccggctgacctgcaccctgaagctgctggagtactttgtggaggagtactttgaccagaaccccatcagccagatcggcatcatcgtgaccaagagcaagagagctgagaagctgacagagctgagcggcaaccccaggaagcacatcaccagcctgaagaaggctgtggacatgacctgccacggggagcccagcctgtacaacagcctgagcatcgccatgcagaccctgaagcacatgcctggccacaccagccgggaggtgctgatcatcttcagcagcctgaccacctgtgaccccagcaacatctatgacctgatcaagaccctgaaggccgccaagatccgggtgtctgtgattggcctgtctgctgaggtgcgggtgtgcaccgtgctggcccgggagactggaggcacctaccacgtgatcctggatgagagccactacaaggagctgctgacccaccacgtgagccccccaccagccagcagcagcagcgagtgcagcctcatccgcatgggcttcccccagcacaccatcgccagcctgagtgaccaggatgccaagcccagcttctccatggcccacctggatggcaacacagagcccggcctgaccctgggcggctacttctgcccccagtgccgggccaagtactgtgagctgcctgtggagtgcaagatctgtggcctgaccctggtgtctgccccccacctggcccggagctaccaccacctgttccccctggatgccttccaggagatccccctggaggagtacaacggggagcgcttctgctacggctgccagggcgagctgaaggaccagcacgtgtatgtgtgtgctgtgtgccagaatgtgttctgtgtggactgtgatgtgtttgtgcatgacagcctgcactgctgccccggctgcatccacaagatcccagcccccagcggcgtgtag

SEQ ID NO: 153685 - DNA, 1188 bp, Artificial Sequence; identical to SEQ ID NO: 153684
  Description of Artificial Sequence: Synthetic coding sequence

SEQ ID NO: 153686 - DNA, 1017 bp, Artificial Sequence
  Description of Artificial Sequence: Synthetic coding sequence
atgaggcacctgtatgtggtggtggatggcagcaggaccatggaggaccaggacctgaagcccaaccggctgacctgcaccctgaagctgctggagtactttgtggaggagtactttgaccagaaccccatcagccagatcggcatcatcgtgaccaagagcaagagagctgagaagctgacagagctgagcggcaaccccaggaagcacatcaccagcctgaagaaggctgtggacatgacctgccacggggagcccagcctgtacaacagcctgagcatcgccatgcagaccctgaagcacatgcctggccacaccagccgggaggtgctgatcatcttcagcagcctgaccacctgtgaccccagcaacatctatgacctgatcaagaccctgaaggccgccaagatccgggtgtctgtcatcggcctgtctgctgaggtgcgggtgtgcaccgtgctggcccgggagaccggcggcacctaccacgtgatcctggatgagagccactacaaggagctgctgacccaccacgtgtccccacctccagccagcagcagcagtgaatgttccctcatccgcatgggcttcccccagcacaccatcgccagcctgagtgaccaggatgccaagcccagcttctccatggcccacctggatggcaacacagagcccggcctgaccctgggcggctacttctgcccccagtgccgggccaagtactgtgagctgcctgtggagtgcaagatctgtggcctgaccctggtgtctgccccccacctggcccggagctaccaccacctgttccccctggatgccttccaggagatccccctggaggagtacaatggagagcgcttctgctacggctgccagggcgagctgaaggaccagcacgtgtatgtgtgtgctgtgtgccagaatgtgttctgtgtggactgtgatgtgtttgtgcatgacagcctgcactgctgccccggctgcatccacaagatcccagcccccagcggcgtgtag

SEQ ID NO: 153687 - DNA, 1188 bp, Artificial Sequence; identical to SEQ ID NO: 153684
  Description of Artificial Sequence: Synthetic coding sequence

SEQ ID NO: 153688 - DNA, 1389 bp, Artificial Sequence
  Description of Artificial Sequence: Synthetic coding sequence
atggagagcacccccagccggggcctgaacagagtgcacctgcagtgcaggaacctgcaggagttcctgggcggcctgagccctggggtgctggaccggctgtatggccacccagccacctgcctggccgtgttccgggagctgcccagcctggccaagaactgggtgatgaggatgctgttcctggagcagcccctgccccaggccgctgtggccctgtgggtgaagaaggagttcagcaaggcccaggaggagagcacaggcctgctgagcggcctgcgcatctggcacacccagctgctgcccggcggcctgcagggcctcatcctgaaccccatcttccggcagaacctgcgcatcgccctgctgggcggcggcaaggcctggagcgatgacaccagccagctgggccctgacaagcacgccagagatgtgcccagcctggacaagtatgcagaggagcgctgggaggtggtgctgcacttcatggtgggcagccccagcgctgctgtgtcccaggacctggcccagctgctgagccaggccggcctgatgaagagcacagagcccggggagcccccctgcatcaccagcgctggcttccagttcctgctgctggacaccccagcccagctgtggtacttcatgctgcagtacctgcagacagcccagagccggggcatggacctggtggagatcctgtccttcctgttccagctgtccttcagcaccctgggcaaggactacagcgtggagggcatgtctgacagcctgctgaacttcctgcagcacctgcgggagtttggcctggtgttccagaggaagaggaagagccgccgctactaccccacccggctggccatcaacctgagcagcggcgtgtctggagctgggggcaccgtgcaccagcccggcttcatcgtggtggagaccaactaccgcctgtatgcctacacagaaagtgagctgcagatcgccctgattgccctcttcagcgagatgctgtaccgcttccccaacatggtggtggcccaggtgacccgggagagcgtgcagcaggccatcgccagcggcatcacagcccagcagatcatccacttcctgcggacccgggcccaccctgtgatgctgaagcagacccctgtgctgccccccaccatcacagaccagatccggctgtgggagctggagcgggaccggctgcgcttcacagagggcgtgctgtacaaccagttcctgagccaggtggactttgagctgctgctggcccacgcccgggagctgggcgtgctggtgtttgagaacagcgccaagaggctgatggtggtgaccccagctggccacagtgatgtgaagcgcttctggaagaggcagaagcacagcagctag

SEQ ID NO: 153689 - DNA, 1389 bp, Artificial Sequence; identical to SEQ ID NO: 153688
  Description of Artificial Sequence: Synthetic coding sequence

SEQ ID NO: 153690 - DNA, 1389 bp, Artificial Sequence; identical to SEQ ID NO: 153688
  Description of Artificial Sequence: Synthetic coding sequence

SEQ ID NO: 153691 - DNA, 1389 bp, Artificial Sequence; identical to SEQ ID NO: 153688
  Description of Artificial Sequence: Synthetic coding sequence

SEQ ID NO: 153692 - DNA, 1389 bp, Artificial Sequence; identical to SEQ ID NO: 153688
  Description of Artificial Sequence: Synthetic coding sequence

SEQ ID NO: 153693 - DNA, 417 bp, Artificial Sequence
  Description of Artificial Sequence: Synthetic coding sequence
atggagagcacccccagccggggcctgaacagagtgcacctgcagtgcaggaacctgcaggagttcctgggcggcctgagccctggggtgctggaccggctgtatggccacccagccacctgcctggccgtgttccgggagctgcccagcctggccaagaactgggtgatgaggatgctgttcctggagcagcccctgccccaggccgctgtggccctgtgggtgaagaaggagttcagcaaggcccaggaggagagcacaggcctgctgagcggcctgcgcatctggcacacccagctgctgcccggcggcctgcagggcctcatcctgaaccccatcttccggcagaacctgcgcatcgccctgctgggcggcaccggcatcactggagtgagccactgtgcctggccaggatag

SEQ ID NO: 153694 - DNA, 1389 bp, Artificial Sequence; identical to SEQ ID NO: 153688
  Description of Artificial Sequence: Synthetic coding sequence

SEQ ID NO: 153695 - DNA, 417 bp, Artificial Sequence; identical to SEQ ID NO: 153693
  Description of Artificial Sequence: Synthetic coding sequence

SEQ ID NO: 153696 - DNA, 1389 bp, Artificial Sequence; identical to SEQ ID NO: 153688
  Description of Artificial Sequence: Synthetic coding sequence

SEQ ID NO: 153697 - DNA, 417 bp, Artificial Sequence; identical to SEQ ID NO: 153693
  Description of Artificial Sequence: Synthetic coding sequence

SEQ ID NO: 153698 - DNA, 1389 bp, Artificial Sequence; identical to SEQ ID NO: 153688
  Description of Artificial Sequence: Synthetic coding sequence

SEQ ID NO: 153699 - DNA, 1389 bp, Artificial Sequence; identical to SEQ ID NO: 153688
  Description of Artificial Sequence: Synthetic coding sequence

SEQ ID NO: 153700 - DNA, 1389 bp, Artificial Sequence; identical to SEQ ID NO: 153688
  Description of Artificial Sequence: Synthetic coding sequence

SEQ ID NO: 153701 - DNA, 1389 bp, Artificial Sequence; identical to SEQ ID NO: 153688
  Description of Artificial Sequence: Synthetic coding sequence

SEQ ID NO: 153702 - DNA, 417 bp, Artificial Sequence; identical to SEQ ID NO: 153693
  Description of Artificial Sequence: Synthetic coding sequence

SEQ ID NO: 153703 - DNA, 417 bp, Artificial Sequence; identical to SEQ ID NO: 153693
  Description of Artificial Sequence: Synthetic coding sequence

SEQ ID NO: 153704 - DNA, 417 bp, Artificial Sequence; identical to SEQ ID NO: 153693
  Description of Artificial Sequence: Synthetic coding sequence

SEQ ID NO: 153705 - DNA, 1389 bp, Artificial Sequence; identical to SEQ ID NO: 153688
  Description of Artificial Sequence: Synthetic coding sequence

SEQ ID NO: 153706 - DNA, 663 bp, Artificial Sequence
  Description of Artificial Sequence: Synthetic coding sequence
atgaggatgctgttcctggagcagcccctgccccaggccgctgtggccctgtgggtgaagaaggagttcagcaaggcccaggaggagagcacaggcctgctgagcggcctgcgcatctggcacacccagctgctgcccggcggcctgcagggcctcatcctgaaccccatcttccggcagaacctgcgcatcgccctgctgggcggcggcaaggcctggagcgatgacaccagccagctgggccctgacaagcacgccagagatgtgcccagcctggacaagtatgcagaggagcgctgggaggtggtgctgcacttcatggtgggcagccccagcgctgctgtgtcccaggacctggcccagctgctgagccaggccggcctgatgaagagcacagagcccggggagcccccctgcatcaccagcgctggcttccagttcctgctgctggacaccccagcccagctgtggtacttcatgctgcagtacctgcagacagcccagagccggggcatggacctggtggagatcctgtccttcctgttccagctgtccttcagcaccctgggcaaggactacagcgtggagggcatgtctgacagcctgctgaacttcctgcagcacctgcgggagtttggcctggtgttccagaggaaggtgtag

SEQ ID NO: 153707 - DNA, 663 bp, Artificial Sequence; identical to SEQ ID NO: 153706
  Description of Artificial Sequence: Synthetic coding sequence

SEQ ID NO: 153708 - DNA, 663 bp, Artificial Sequence; identical to SEQ ID NO: 153706
  Description of Artificial Sequence: Synthetic coding sequence

SEQ ID NO: 153709 - DNA, 663 bp, Artificial Sequence; identical to SEQ ID NO: 153706
  Description of Artificial Sequence: Synthetic coding sequence

SEQ ID NO: 153710 - DNA, 663 bp, Artificial Sequence; identical to SEQ ID NO: 153706
  Description of Artificial Sequence: Synthetic coding sequence

SEQ ID NO: 153711 - DNA, 663 bp, Artificial Sequence; identical to SEQ ID NO: 153706
  Description of Artificial Sequence: Synthetic coding sequence

SEQ ID NO: 153712 - DNA, 216 bp, Artificial Sequence
  Description of Artificial Sequence: Synthetic coding sequence
atggtgaatgtgctgaagggcgtgctgattgaatgtgaccctgccatgaagcagttcctgctgtacctggatgagagcaatgccctgggcaagaagttcatcatccaggacattgatgacacccacgtgtttgtgattgctgagctggtgaatgtgctgcaggagcgggtgggggagctgatggaccagaatgccttcagcctgacccagaagtag

SEQ ID NO: 153713 - DNA, 2997 bp, Artificial Sequence
  Description of Artificial Sequence: Synthetic coding sequence
atggcccaggtggccatgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgctgtggagattgagaccctgaggaagacagtggaggactacttctgcttctgctacggcaaggccctgggcaagagcacagtggtgcctgtgccctatgagaagatgctgcgggaccagagcgctgtggtggtgcagggcctgcctgagggcgtggccttcaagcacccagaaaattatgacctggccaccctgaagtggatcctggagaacaaggccggcatctccttcatcatcaagaggcccttcctggagcccaagaagcacgtgggcggccgggtgatggtgacagatgctgacaggagcatcctgagccctgggggcagctgtggccccatcaaggtgaagacagagcccacagaggacagcggcatcagcctggagatggctgctgtgacagtgaaggaggagagcgaggaccctgactactaccagtacaacatccaggccggccccagcgagacagatgatgtggatgagaagcagcccctgagcaagcccctgcagggcagccaccacagcagcgagggcaatgaaggaacagagatggaggtgcctgctgaggacagcacccagcacgtgcccagcgagaccagtgaagatcctgaggtggaggtgaccattgaagatgatgactacagcccccccagcaagaggcccaaggccaatgagctgccccagccccctgtgcctgagcccgccaatgccggcaagaggaaggtgcgggagttcaactttgagaagtggaatgcccgcatcacagacctgaggaagcaggtggaggagctgtttgagaggaaatatgcccaggccatcaaggccaagggccctgtgaccatcccctaccccctcttccagagccacgtggaggacctgtatgtggagggcctgcctgagggcatccccttcagaagacccagcacctacggcatcccccggctggagcgcatcctgctggccaaggagcgcatccgctttgtgatcaagaagcatgagctgctgaacagcacccgggaggacctgcagctggacaagccagccagcggcgtgaaggaggagtggtacgcccgcatcaccaagctgaggaagatggtggaccagctgttctgcaagaagtttgctgaggccctgggcagcacagaggccaaggctgtgccctaccagaagtttgaggcccaccccaatgacctgtatgtggagggcctgcctgagaacatccccttccgcagccccagctggtacggcatcccccggctggagaagatcatccaggtgggcaaccgcatcaagtttgtgatcaagaggcctgagctgctgacccacagcaccacagaggtgacccagcccaggaccaacacccctgtgaaggaggactggaatgtgcgcatcaccaagctgaggaagcaggtggaggagatcttcaacctgaagtttgcccaggccctgggcctgacagaggccgtgaaggtgccctaccctgtgtttgagagcaaccctgagttcctgtatgtggagggcctgcctgagggcatccccttccgcagccccacctggtttggcatcccccggctggagcgcatcgtgcggggcagcaacaagatcaagtttgtggtgaagaagccagagctggtgatctcctacctgcccccaggcatggccagcaagatcaacaccaaggccctgcagagccccaagaggcccaggagccctggcagcaacagcaaggtgcctgagattgaggtgacagtggagggccccaacaacaacaacccccagaccagcgctgtgaggacccccacccagaccaacggcagcaatgtgcccttcaagccccggggccgggagttctcctttgaggcctggaatgccaagatcacagacctgaagcagaaggtggagaacctcttcaatgagaagtgtggggaggccctgggcctgaagcaggccgtgaaggtgccctttgccctgtttgagagcttccctgaggacttctacgtggagggcctgcctgagggcgtgcccttcagaagacccagcaccttcggcatcccccggctggagaagatcctgaggaacaaggccaagatcaagttcatcatcaagaagccagagatgtttgaaacagccatcaaggagagcaccagcagcaagagcccccccaggaagatcaacagcagccccaacgtgaacaccacagccagcggcgtggaggacctgaacatcatccaggtgaccatcccagatgatgacaatgaaaggctgagcaaggtggagaaggcccggcagctgcgggagcaggtgaatgacctcttcagcaggaagtttggagaggccatcggcatgggcttccctgtgaaggtgccctacaggaagatcaccatcaaccctggctgtgtggtggtggatggcatgcctcctggggtgtccttcaaggcccccagctacctggagatcagctccatgaggcgcatcctggacagcgctgagttcatcaagttcaccgtcatccggcccttccctggcctggtgatcaacaaccagctggtggaccagagcgagagcgagggccctgtgatccaggagagcgctgagcccagccagctggaggtgcctgccacagaggagatcaaggagacagatggcagcagccagatcaagcaggagccagaccccacctggtag

SEQ ID NO: 153714 - DNA, 2934 bp, Artificial Sequence
  Description of Artificial Sequence: Synthetic coding sequence
atggcccaggtggccatgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgctgtggagattgagaccctgaggaagacagtggaggactacttctgcttctgctacggcaaggccctgggcaagagcacagtggtgcctgtgccctatgagaagatgctgcgggaccagagcgctgtggtggtgcagggcctgcctgagggcgtggccttcaagcacccagaaaattatgacctggccaccctgaagtggatcctggagaacaaggccggcatctccttcatcatcaagaggcccttcctggagcccaagaagcacgtgggcggccgggtgatggtgacagatgctgacaggagcatcctgagccctgggggcagctgtggccccatcaaggtgaagacagagcccacagaggacagcggcatcagcctggagatggctgctgtgacagtgaaggaggagagcgaggaccctgactactaccagtacaacatccaggccggccccagcgagacagatgatgtggatgagaagcagcccctgagcaagcccctgcagggcagccaccacagcagcgagggcaatgaaggaacagagatggaggtgcctgcagaagatgatgactacagcccccccagcaagaggcccaaggccaatgagctgccccagccccctgtgcctgagcccgccaatgctgggaagaggaaggtgcgggagttcaactttgagaagtggaatgcccgcatcacagacctgaggaagcaggtggaggagctgtttgagaggaaatatgcccaggccatcaaggccaagggccctgtgaccatcccctaccccctcttccagagccacgtggaggacctgtatgtggagggcctgcctgagggcatccccttccggcggcccagcacctacggcatcccccggctggagcgcatcctgctggccaaggagcgcatccgcttcgtcatcaagaagcatgagctgctgaacagcacccgggaggacctgcagctggacaagccagccagcggcgtgaaggaggagtggtacgcccgcatcaccaagctgaggaagatggtggaccagctgttctgcaagaagtttgctgaggccctgggcagcacagaggccaaggctgtgccctaccagaagtttgaggcccaccccaatgacctgtatgtggagggcctgcctgagaacatccccttccgcagccccagctggtacggcatcccccggctggagaagatcatccaggtgggcaaccgcatcaagtttgtgatcaagaggcctgagctgctgacccacagcaccacagaggtgacccagcccaggaccaacacccctgtgaaggaggactggaatgtgcgcatcaccaagctgaggaagcaggtggaggagatcttcaacctgaagtttgcccaggccctgggcctgacagaagctgtgaaggtgccctaccctgtgtttgagagcaaccctgagttcctgtatgtggagggcctgcctgagggcatccccttccgcagccccacctggtttggcatcccccggctggagagaattgtgcggggcagcaacaagatcaagtttgtggtgaagaagccagagctggtgatctcctacctgcccccaggcatggccagcaagatcaacaccaaggccctgcagagccccaagaggcccaggagccctggcagcaacagcaaggtgcctgagattgaggtgacagtggagggccccaacaacaacaacccccagaccagcgctgtgaggacccccacccagaccaacggcagcaatgtgcccttcaagccccggggccgggagttctcctttgaggcctggaatgccaagatcacagacctgaagcagaaggtggagaacctcttcaatgaaaaatgtggggaggccctgggcctgaagcaggccgtgaaggtgccctttgccctgtttgagagcttccctgaggacttctacgtggagggcctgcctgagggcgtgcccttccggcggcccagcaccttcggcatcccccggctggagaagatcctgaggaacaaggccaagatcaagttcatcatcaagaagccagagatgtttgaaacagccatcaaggagagcaccagcagcaagagcccccccaggaagatcaacagcagccccaacgtgaacaccacagccagcggcgtggaggacctgaacatcatccaggtgaccatcccagatgatgacaatgaaaggctgagcaaggtggagaaggcccggcagctgcgggagcaggtgaatgacctcttcagcaggaagtttggagaggccatcggcatgggcttccctgtgaaggtgccctacaggaagatcaccatcaaccctggctgtgtggtggtggatggcatgcctcctggggtgtccttcaaggcccccagctacctggagatcagctccatgaggcgcatcctggacagcgctgagttcatcaagttcaccgtcatccggcccttccctggcctggtgatcaacaaccagctggtggaccagagcgagagcgagggccctgtgatccaggagagcgctgagcccagccagctggaggtgcctgccacagaggagatcaaggagacagatggcagcagccagatcaagcaggagccagaccccacctggtag

SEQ ID NO: 153715 - DNA, 2937 bp, Artificial Sequence
  Description of Artificial Sequence: Synthetic coding sequence
atggcccaggtggccatgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgctgtggagattgagaccctgaggaagacagtggaggactacttctgcttctgctacggcaaggccctgggcaagagcacagtggtgcctgtgccctatgagaagatgctgcgggaccagagcgctgtggtggtgcagggcctgcctgagggcgtggccttcaagcacccagaaaattatgacctggccaccctgaagtggatcctggagaacaaggccggcatctccttcatcatcaagaggcccttcctggagcccaagaagcacgtgggcggccgggtgatggtgacagatgctgacaggagcatcctgagccctgggggcagctgtggccccatcaaggtgaagacagagcccacagaggacagcggcatcagcctggagatggctgctgtgacagtgaaggaggagagcgaggaccctgactactaccagtacaacatccagggcagccaccacagcagcgagggcaatgaaggaacagagatggaggtgcctgctgaggacagcacccagcacgtgcccagcgagaccagtgaagatcctgaggtggaggtgaccattgaagatgatgactacagcccccccagcaagaggcccaaggccaatgagctgccccagccccctgtgcctgagcccgccaatgccggcaagaggaaggtgcgggagttcaactttgagaagtggaatgcccgcatcacagacctgaggaagcaggtggaggagctgtttgagaggaaatatgcccaggccatcaaggccaagggccctgtgaccatcccctaccccctcttccagagccacgtggaggacctgtatgtggagggcctgcctgagggcatccccttcagaagacccagcacctacggcatcccccggctggagcgcatcctgctggccaaggagcgcatccgctttgtgatcaagaagcatgagctgctgaacagcacccgggaggacctgcagctggacaagccagccagcggcgtgaaggaggagtggtacgcccgcatcaccaagctgaggaagatggtggaccagctgttctgcaagaagtttgctgaggccctgggcagcacagaggccaaggctgtgccctaccagaagtttgaggcccaccccaatgacctgtatgtggagggcctgcctgagaacatccccttccgcagccccagctggtacggcatcccccggctggagaagatcatccaggtgggcaaccgcatcaagtttgtgatcaagaggcctgagctgctgacccacagcaccacagaggtgacccagcccaggaccaacacccctgtgaaggaggactggaatgtgcgcatcaccaagctgaggaagcaggtggaggagatcttcaacctgaagtttgcccaggccctgggcctgacagaggccgtgaaggtgccctaccctgtgtttgagagcaaccctgagttcctgtatgtggagggcctgcctgagggcatccccttccgcagccccacctggtttggcatcccccggctggagcgcatcgtgcggggcagcaacaagatcaagtttgtggtgaagaagccagagctggtgatctcctacctgcccccaggcatggccagcaagatcaacaccaaggccctgcagagccccaagaggcccaggagccctggcagcaacagcaaggtgcctgagattgaggtgacagtggagggccccaacaacaacaacccccagaccagcgctgtgaggacccccacccagaccaacggcagcaatgtgcccttcaagccccggggccgggagttctcctttgaggcctggaatgccaagatcacagacctgaagcagaaggtggagaacctcttcaatgagaagtgtggggaggccctgggcctgaagcaggccgtgaaggtgccctttgccctgtttgagagcttccctgaggacttctacgtggagggcctgcctgagggcgtgcccttcagaagacccagcaccttcggcatcccccggctggagaagatcctgaggaacaaggccaagatcaagttcatcatcaagaagccagagatgtttgaaacagccatcaaggagagcaccagcagcaagagcccccccaggaagatcaacagcagccccaacgtgaacaccacagccagcggcgtggaggacctgaacatcatccaggtgaccatcccagatgatgacaatgaaaggctgagcaaggtggagaaggcccggcagctgcgggagcaggtgaatgacctcttcagcaggaagtttggagaggccatcggcatgggcttccctgtgaaggtgccctacaggaagatcaccatcaaccctggctgtgtggtggtggatggcatgcctcctggggtgtccttcaaggcccccagctacctggagatcagctccatgaggcgcatcctggacagcgctgagttcatcaagttcaccgtcatccggcccttccctggcctggtgatcaacaaccagctggtggaccagagcgagagcgagggccctgtgatccaggagagcgctgagcccagccagctggaggtgcctgccacagaggagatcaaggagacagatggcagcagccagatcaagcaggagccagaccccacctggtag

SEQ ID NO: 153716 - DNA, 2874 bp, Artificial Sequence
  Description of Artificial Sequence: Synthetic coding sequence
atggcccaggtggccatgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgctgtggagattgagaccctgaggaagacagtggaggactacttctgcttctgctacggcaaggccctgggcaagagcacagtggtgcctgtgccctatgagaagatgctgcgggaccagagcgctgtggtggtgcagggcctgcctgagggcgtggccttcaagcacccagaaaattatgacctggccaccctgaagtggatcctggagaacaaggccggcatctccttcatcatcaagaggcccttcctggagcccaagaagcacgtgggcggccgggtgatggtgacagatgctgacaggagcatcctgagccctgggggcagctgtggccccatcaaggtgaagacagagcccacagaggacagcggcatcagcctggagatggctgctgtgacagtgaaggaggagagcgaggaccctgactactaccagtacaacatccagggcagccaccacagcagcgagggcaatgaaggaacagagatggaggtgcctgcagaagatgatgactacagcccccccagcaagaggcccaaggccaatgagctgccccagccccctgtgcctgagcccgccaatgctgggaagaggaaggtgcgggagttcaactttgagaagtggaatgcccgcatcacagacctgaggaagcaggtggaggagctgtttgagaggaaatatgcccaggccatcaaggccaagggccctgtgaccatcccctaccccctcttccagagccacgtggaggacctgtatgtggagggcctgcctgagggcatccccttccggcggcccagcacctacggcatcccccggctggagcgcatcctgctggccaaggagcgcatccgcttcgtcatcaagaagcatgagctgctgaacagcacccgggaggacctgcagctggacaagccagccagcggcgtgaaggaggagtggtacgcccgcatcaccaagctgaggaagatggtggaccagctgttctgcaagaagtttgctgaggccctgggcagcacagaggccaaggctgtgccctaccagaagtttgaggcccaccccaatgacctgtatgtggagggcctgcctgagaacatccccttccgcagccccagctggtacggcatcccccggctggagaagatcatccaggtgggcaaccgcatcaagtttgtgatcaagaggcctgagctgctgacccacagcaccacagaggtgacccagcccaggaccaacacccctgtgaaggaggactggaatgtgcgcatcaccaagctgaggaagcaggtggaggagatcttcaacctgaagtttgcccaggccctgggcctgacagaagctgtgaaggtgccctaccctgtgtttgagagcaaccctgagttcctgtatgtggagggcctgcctgagggcatccccttccgcagccccacctggtttggcatcccccggctggagagaattgtgcggggcagcaacaagatcaagtttgtggtgaagaagccagagctggtgatctcctacctgcccccaggcatggccagcaagatcaacaccaaggccctgcagagccccaagaggcccaggagccctggcagcaacagcaaggtgcctgagattgaggtgacagtggagggccccaacaacaacaacccccagaccagcgctgtgaggacccccacccagaccaacggcagcaatgtgcccttcaagccccggggccgggagttctcctttgaggcctggaatgccaagatcacagacctgaagcagaaggtggagaacctcttcaatgaaaaatgtggggaggccctgggcctgaagcaggccgtgaaggtgccctttgccctgtttgagagcttccctgaggacttctacgtggagggcctgcctgagggcgtgcccttccggcggcccagcaccttcggcatcccccggctggagaagatcctgaggaacaaggccaagatcaagttcatcatcaagaagccagagatgtttgaaacagccatcaaggagagcaccagcagcaagagcccccccaggaagatcaacagcagccccaacgtgaacaccacagccagcggcgtggaggacctgaacatcatccaggtgaccatcccagatgatgacaatgaaaggctgagcaaggtggagaaggcccggcagctgcgggagcaggtgaatgacctcttcagcaggaagtttggagaggccatcggcatgggcttccctgtgaaggtgccctacaggaagatcaccatcaaccctggctgtgtggtggtggatggcatgcctcctggggtgtccttcaaggcccccagctacctggagatcagctccatgaggcgcatcctggacagcgctgagttcatcaagttcaccgtcatccggcccttccctggcctggtgatcaacaaccagctggtggaccagagcgagagcgagggccctgtgatccaggagagcgctgagcccagccagctggaggtgcctgccacagaggagatcaaggagacagatggcagcagccagatcaagcaggagccagaccccacctggtag

SEQ ID NO: 153717 - DNA, 321 bp, Artificial Sequence
  Description of Artificial Sequence: Synthetic coding sequence
atggcccaggtggccatgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgcctag

SEQ ID NO: 153718 - DNA, 825 bp, Artificial Sequence
  Description of Artificial Sequence: Synthetic coding sequence
atggcccaggtggccatgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgctgtggagattgagaccctgaggaagacagtggaggactacttctgcttctgctacggcaaggccctgggcaagagcacagtggtgcctgtgccctatgagaagatgctgcgggaccagagcgctgtggtggtgcagggcctgcctgagggcgtggccttcaagcacccagaaaattatgacctggccaccctgaagtggatcctggagaacaaggccggcatctccttcatcatcaagaggcccttcctggagcccaagaagcacgtgggcggccgggtgatggtgacagatgctgacaggagcatcctgagccctgggggcagctgtggccccatcaaggtgaagacagagcccacagaggacagcggcatcagcctggagatggctgctgtgacagtgaaggaggagagcgaggaccctgactactaccagtacaacatccagggcagccaccacagcagcgagggcaatgaaggaacagagatggaggtgcctgctgagggctag

SEQ ID NO: 153719 - DNA, 2982 bp, Artificial Sequence
  Description of Artificial Sequence: Synthetic coding sequence
atgagcaccctgcctgtggaggatgaggagagcagcgagagcaggatggtggtgaccttcctgatgtctgccctggagagcatgtgcaaggagctggccaagagcaaggccgaggtggcctgcatcgctgtgtatgaaacagatgtgtttgtggtgggcacagagcggggccgggcctttgtgaacaccaggaaggacttccagaaggactttgtgaagtactgtgtggaggaggaggagaaggctgctgagatgcacaagatgaagagcaccacccaggccaacaggatgtctgtggatgctgtggagattgagaccctgaggaagacagtggaggactacttctgcttctgctacggcaaggccctgggcaagagcacagtggtgcctgtgccctatgagaagatgctgcgggaccagagcgctgtggtggtgcagggcctgcctgagggcgtggccttcaagcaccctgagaactatgacctggccaccctgaagtggatcctggagaacaaggccggcatctccttcatcatcaagaggcccttcctggagcccaagaagcacgtgggcggccgggtgatggtgacagatgctgacaggagcatcctgagccctgggggcagctgtggccccatcaaggtgaagacagagcccacagaagattctggcatcagcctggagatggctgctgtgacagtgaaggaggagagtgaagatcctgactactaccagtacaacatccaggccggccccagcgagacagatgatgtggatgagaagcagcccctgagcaagcccctgcagggcagccaccacagcagcgagggcaatgaaggaacagagatggaggtgcctgctgaggacagcacccagcacgtgcccagcgagaccagcgaggaccctgaggtggaggtgaccattgaagatgatgactacagcccccccagcaagaggcccaaggccaatgagctgccccagccccctgtgcctgagcccgccaatgctgggaagaggaaggtgcgggagttcaactttgagaagtggaatgcccgcatcacagacctgaggaagcaggtggaggagctgtttgagaggaaatatgcccaggccatcaaggccaagggccctgtgaccatcccctaccccctcttccagagccacgtggaggacctgtatgtggagggcctgcctgagggcatccccttccggcggcccagcacctacggcatcccccggctggagcgcatcctgctggccaaggagcgcatccgcttcgtcatcaagaagcatgagctgctgaacagcacccgggaggacctgcagctggacaagccagccagcggcgtgaaggaggagtggtacgcccgcatcaccaagctgaggaagatggtggaccagctgttctgcaagaagtttgctgaggccctgggcagcacagaggccaaggctgtgccctaccagaagtttgaggcccaccccaatgacctgtatgtggagggcctgcctgagaacatccccttccgcagccccagctggtacggcatcccccggctggagaagatcatccaggtgggcaaccgcatcaagtttgtgatcaagaggcctgagctgctgacccacagcaccacagaggtgacccagcccaggaccaacacccctgtgaaggaggactggaatgtgcgcatcaccaagctgaggaagcaggtggaggagatcttcaacctgaagtttgcccaggccctgggcctgacagaagctgtgaaggtgccctaccctgtgtttgagagcaaccctgagttcctgtatgtggagggcctgcctgagggcatccccttccgcagccccacctggtttggcatcccccggctggagagaattgtgcggggcagcaacaagatcaagtttgtggtgaagaagccagagctggtgatctcctacctgcccccaggcatggccagcaagatcaacaccaaggccctgcagagccccaagaggcccaggagccctggcagcaacagcaaggtgcctgagattgaggtgacagtggagggccccaacaacaacaacccccagaccagcgctgtgaggacccccacccagaccaacggcagcaatgtgcccttcaagccccggggccgggagttctcctttgaggcctggaatgccaagatcacagacctgaagcagaaggtggagaacctcttcaatgaaaaatgtggggaggccctgggcctgaagcaggccgtgaaggtgccctttgccctgtttgagagcttccctgaggacttctacgtggagggcctgcctgagggcgtgcccttccggcggcccagcaccttcggcatcccccggctggagaagatcctgaggaacaaggccaagatcaagttcatcatcaagaagccagagatgtttgaaacagccatcaaggagagcaccagcagcaagagcccccccaggaagatcaacagcagccccaacgtgaacaccacagccagcggcgtggaggacctgaacatcatccaggtgaccatcccagatgatgacaatgaaaggctgagcaaggtggagaaggcccggcagctgcgggagcaggtgaatgacctcttcagcaggaagtttggagaggccatcggcatgggcttccctgtgaaggtgccctacaggaagatcaccatcaaccctggctgtgtggtggtggatggcatgcctcctggggtgtccttcaaggcccccagctacctggagatcagctccatgaggcgcatcctggacagcgctgagttcatcaagttcaccgtcatccggcccttccctggcctggtgatcaacaaccagctggtggaccagagcgagagcgagggccctgtgatccaggagagcgctgagcccagccagctggaggtgcctgccacagaggagatcaaggagacagatggcagcagccagatcaagcaggagccagaccccacctggtag

SEQ ID NO: 153720 - DNA, 642 bp, Artificial Sequence
  Description of Artificial Sequence: Synthetic coding sequence
atggctgctgctgctgatgagaggagcccagaagatggagaagatgaggaggaggaggagcagctggtgctggtggagctgagcggcatcatcgacagcgacttcctgagcaaatgtgagaacaagtgcaaggtgctgggcatcgacacagagcggcccatcctgcaggtggacagctgtgtgtttgctggggagtatgaggacaccctgggcacctgtgtgatctttgaggagaatgtggagcacgccgacacagagggcaacaacaagacagtgctgaagtacaagtgccacaccatgaagaagctgtccatgaccaggaccctgctgacagagaagaaggagggggaggagaacatcggcggcgtggagtggctgcagatcaaggacaatgacttctcctaccggcccaacatgatctgcaacttcctgcatgaaaatgaagatgaggaggtggtggccagcgccccagacaagagcctggagctggaggaggaggagatccagatgaatgacagcagcaacctgagctgtgagcaggagaagcccatgcacctggagattgaagattctggccccctgattgacatccccagcgagacagagggcagcgtcttcatggagacccagatgctgccctag

SEQ ID NO: 153721 - DNA, 2118 bp, Artificial Sequence
  Description of Artificial Sequence: Synthetic coding sequence
atggccacagagggcatgatcctgaccaaccacgaccaccagatccgggtgggcgtgctgactgtgtctgacagctgcttcaggaacctggccgaggacagaagtggcatcaacctgaaggacctggtgcaggaccccagcctgctgggcggcaccatcagcgcctacaagatcgtgcctgatgaaattgaggagatcaaggccaccaaggaggtgattgagcgggaggcccctggcatggccctggccatgctgatgggcagcctgaatgtgacccccctgggcatgctgagcaggcctgtgtgtggcatccggggcaagaccctcatcatcaacctgcccggcagcaagaagggcagccaggagtgcttccagttcatcctgcctgccctgccccacgccatcgacctgctgagagatgccatcgtgaaggtgaaggaggtgcatgatgagctggaggacctgcccagccccccaccacccctgagccccccacccaccaccagcccccacaagcagacagaagataaaggagtgcagtgtgaggaggaggaggaggagaagaaggacagcggcgtggccagcacagaggacagcagcagcagccacatcacagctgctgccatcgccgccaagatcccagacagcatcatcagcagaggagtgcaggtgctgccccgggacacagccagcctgagcaccaccccatctgagagcccccgggcccaggccaccagccggctgagcacagccagctgccccacccccaaggtgcagagccgctgcagcagcaaggagaacatcctgcgggccagccacagcgctgtggacatcaccaaggtggcccggcggcacaggatgagccccttccccctgacctccatggacaaggccttcatcaccgtgctggagatgacccctgtgctgggcacagagatcatcaactacagagatggcatgggccgggtgctggcccaggatgtgtatgccaaggacaacctgccccccttccctgcctctgtgaaggatggctatgctgtgcgggcagcagatggccctggggaccgcttcatcattggagagagccaggccggggagcagcccacccagacagtgatgcctggccaggtgatgagggtgaccaccggggcccccatcccctgtggggctgatgctgtggtgcaggtggaggacacagagctgatccgggagagtgatgatggaacagaggagctggaggtgcgcatcctggtgcaggcccggcccggccaggacatccggcccatcggccatgacatcaagagaggagaatgtgtgctggccaagggcacccacatgggccccagcgagatcggcctgctggccaccgtgggcgtgacagaggtggaggtgaacaagtttcctgtggtggccgtgatgagcactggaaatgagctgctgaacccagaagatgacctgctgcccgggaagatccgggacagcaacagaagcaccctgctggccaccatccaggagcacggctaccccaccatcaacctgggcatcgtgggggacaacccagatgacctgctgaatgccctgaatgaaggcatcagcagagcagatgtgatcatcaccagcggcggcgtgtccatgggagagaaggactacctgaagcaggtgctggacatcgacctgcacgcccagatccacttcggccgggtcttcatgaagccaggcctgcccaccacctttgccaccctggacattgatggagtgaggaagatcatctttgccctgcccggcaaccctgtgtctgctgtggtgacctgcaacctgtttgtggtgcctgccctgaggaagatgcagggcatcctggacccccggcccaccatcatcaaggcccggctgagctgtgatgtgaagctggaccccaggcctgagtaccaccgctgcatcctgacctggcaccaccaggagcccctgccctgggcccagagcactggaaaccagatgagcagccggctgatgtccatgaggtctgccaacggcctgctgatgctgccccccaagacagagcagtatgtggagctgcacaagggggaggtggtggatgtgatggtgattggccgcctgtag

SEQ ID NO: 153722 - DNA, 2211 bp, Artificial Sequence
  Description of Artificial Sequence: Synthetic coding sequence
atggccacagagggcatgatcctgaccaaccacgaccaccagatccgggtgggcgtgctgactgtgtctgacagctgcttcaggaacctggccgaggacagaagtggcatcaacctgaaggacctggtgcaggaccccagcctgctgggcggcaccatcagcgcctacaagatcgtgcctgatgaaattgaggagatcaaggagaccctgattgactggtgtgatgagaaggagctgaacctgatcctgaccactggaggcaccggctttgcccccagagatgtgaccccagaggccaccaaggaggtgattgaaagagaggcccctggcatggccctggccatgctgatgggcagcctgaatgtgacccccctgggcatgctgagcaggcctgtgtgtggcatccggggcaagaccctcatcatcaacctgcccggcagcaagaagggcagccaggagtgcttccagttcatcctgcctgccctgccccacgccatcgacctgctgagagatgccatcgtgaaggtgaaggaggtgcatgatgagctggaggacctgcccagccccccaccacccctgagccccccacccaccaccagcccccacaagcagacagaggacaagggcgtgcagtgtgaggaggaggaggaggagaagaaggacagcggcgtggccagcacagaggacagcagcagcagccacatcacagctgctgccatcgccgccaagatcccagacagcatcatcagccggggcgtgcaggtgctgccccgggacacagccagcctgagcaccacccccagcgagagcccccgggcccaggccaccagccggctgagcacagccagctgccccacccccaaggtgcagagccgctgcagcagcaaagaaaacatcctgcgggccagccacagcgctgtggacatcaccaaggtggcccggcggcacaggatgagccccttccccctgacctccatggacaaggccttcatcaccgtgctggagatgacccctgtgctgggcacagagatcatcaactacagagatggcatgggccgggtgctggcccaggatgtgtatgccaaggacaacctgccccccttccctgcctctgtgaaggatggctatgctgtgcgggctgctgatggccctggggaccgcttcatcatcggggagagccaggccggggagcagcccacccagacagtgatgcctggccaggtgatgagggtgaccactggagcccccatcccctgtggggctgatgctgtggtgcaggtggaggacacagagctgatccgggagagtgatgatggaacagaggagctggaggtgcgcatcctggtgcaggcccggcccggccaggacatccggcccatcggccatgacatcaagagaggagaatgtgtgctggccaagggcacccacatgggccccagcgagatcggcctgctggccaccgtgggcgtgacagaggtggaggtgaacaagtttcctgtggtggccgtgatgagcactggaaatgagctgctgaacccagaagatgacctgctgcccgggaagatccgggacagcaacagaagcaccctgctggccaccatccaggagcacggctaccccaccatcaacctgggcatcgtgggggacaacccagatgacctgctgaatgccctgaatgaaggcatcagcagagcagatgtgatcatcaccagcggaggagtgtccatgggagagaaggactacctgaagcaggtgctggacatcgacctgcacgcccagatccacttcggccgggtcttcatgaagccaggcctgcccaccacctttgccaccctggacattgatggagtgaggaagatcatctttgccctgcccggcaaccctgtgtctgctgtggtgacctgcaacctgtttgtggtgcctgccctgaggaagatgcagggcatcctggacccccggcccaccatcatcaaggcccggctgagctgtgatgtgaagctggaccccaggcctgagtaccaccgctgcatcctgacctggcaccaccaggagcccctgccctgggcccagagcacaggcaaccagatgagcagccggctgatgtccatgaggtctgccaacggcctgctgatgctgccccccaagacagagcagtatgtggagctgcacaagggggaggtggtggatgtgatggtgattggccgcctgtag

SEQ ID NO: 153723 - DNA, 2310 bp, Artificial Sequence
  Description of Artificial Sequence: Synthetic coding sequence
atggccacagagggcatgatcctgaccaaccacgaccaccagatccgggtgggcgtgctgactgtgtctgacagctgcttcaggaacctggccgaggacagaagtggcatcaacctgaaggacctggtgcaggaccccagcctgctgggcggcaccatcagcgcctacaagatcgtgcctgatgaaattgaggagatcaaggagaccctgattgactggtgtgatgagaaggagctgaacctgatcctgaccactggaggcaccggctttgcccccagagatgtgaccccagaggccaccaaggaggtgattgaaagagaggcccctggcatggccctggccatgctgatgggcagcctgaatgtgacccccctgggcatgctgagcaggcctgtgtgtggcatccggggcaagaccctcatcatcaacctgcccggcagcaagaagggcagccaggagtgcttccagttcatcctgcctgccctgccccacgccatcgacctgctgagagatgccatcgtgaaggtgaaggaggtgcatgatgagctggaggacctgcccagccccccaccacccctgagccccccacccaccaccagcccccacaagcagacagaggacaagggcgtgcagtgtgaggaggaggaggaggagaagaaggacagcggcgtggccagcacagaggacagcagcagcagccacatcacagctgctgccatcgccgccaagaagcaccccttctacaccagccctgctgtggtgatggcccatggagagcagcccatccctggcctcatcaactacagccaccacagcacagatgagcgcatcccagacagcatcatcagcagaggagtgcaggtgctgccccgggacacagccagcctgagcaccaccccatctgagagcccccgggcccaggccaccagccggctgagcacagccagctgccccacccccaaggtgcagagccgctgcagcagcaaggagaacatcctgcgggccagccacagcgctgtggacatcaccaaggtggcccggcggcacaggatgagccccttccccctgacctccatggacaaggccttcatcaccgtgctggagatgacccctgtgctgggcacagagatcatcaactacagagatggcatgggccgggtgctggcccaggatgtgtatgccaaggacaacctgccccccttccctgcctctgtgaaggatggctatgctgtgcgggcagcagatggccctggggaccgcttcatcattggagagagccaggccggggagcagcccacccagacagtgatgcctggccaggtgatgagggtgaccaccggggcccccatcccctgtggggctgatgctgtggtgcaggtggaggacacagagctgatccgggagagtgatgatggaacagaggagctggaggtgcgcatcctggtgcaggcccggcccggccaggacatccggcccatcggccatgacatcaagagaggagaatgtgtgctggccaagggcacccacatgggccccagcgagatcggcctgctggccaccgtgggcgtgacagaggtggaggtgaacaagtttcctgtggtggccgtgatgagcactggaaatgagctgctgaacccagaagatgacctgctgcccgggaagatccgggacagcaacagaagcaccctgctggccaccatccaggagcacggctaccccaccatcaacctgggcatcgtgggggacaacccagatgacctgctgaatgccctgaatgaaggcatcagcagagcagatgtgatcatcaccagcggcggcgtgtccatgggagagaaggactacctgaagcaggtgctggacatcgacctgcacgcccagatccacttcggccgggtcttcatgaagccaggcctgcccaccacctttgccaccctggacattgatggagtgaggaagatcatctttgccctgcccggcaaccctgtgtctgctgtggtgacctgcaacctgtttgtggtgcctgccctgaggaagatgcagggcatcctggacccccggcccaccatcatcaaggcccggctgagctgtgatgtgaagctggaccccaggcctgagtaccaccgctgcatcctgacctggcaccaccaggagcccctgccctgggcccagagcactggaaaccagatgagcagccggctgatgtccatgaggtctgccaacggcctgctgatgctgccccccaagacagagcagtatgtggagctgcacaagggggaggtggtggatgtgatggtgattggccgcctgtag

SEQ ID NO: 153724 - DNA, 903 bp, Artificial Sequence
  Description of Artificial Sequence: Synthetic coding sequence
atggagaagacccaggagaccgtgcagaggatcctgctggagccctacaagtacctgctgcagctgcccgggaagcaggtgaggaccaagctgagccaggccttcaaccactggctgaaggtgcctgaggacaagctgcagatcatcatcgaggtgacagagatgctgcacaatgccagcctgctgattgatgacatcgaggacaacagcaagctgcggcggggcttccctgtggcccacagcatctacggcatccccagcgtcatcaacagcgccaactacgtgtacttcctgggcctggagaaggtgctgaccctggaccacccagatgctgtgaagctgttcacccggcagctgctggagctgcaccagggccagggcctggacatctactggagggacaactacacctgccccacagaggaggagtacaaggccatggtgctgcagaagacaggaggcctgtttggcctggccgtgggcctgatgcagctgttcagtgactacaaggaggacctgaagcccctgctgaacaccctgggcctcttcttccagatcagagatgattatgccaacctgcacagcaaggagtacagcgagaacaagagcttctgtgaggacctgacagagggcaagttctccttccccaccatccacgccatctggagcaggcctgagagcacccaggtgcagaacatcctgcggcagaggacagaaaatattgacatcaagaagtactgtgtgcactacctggaggatgtgggcagctttgagtacaccaggaacaccctgaaggagctggaggccaaggcctacaagcagattgatgcccggggcggcaaccctgagctggtggccctggtgaagcacctgagcaagatgttcaaggaggagaatgaatag

SEQ ID NO: 153725 - DNA, 903 bp, Artificial Sequence; identical to SEQ ID NO: 153724
  Description of Artificial Sequence: Synthetic coding sequence

SEQ ID NO: 153726 - DNA, 729 bp, Artificial Sequence
  Description of Artificial Sequence: Synthetic coding sequence
atggagaagacccaggagaccgtgcagaggatcctgctggagccctacaagtacctgctgcagctgcccgggaagcaggtgaggaccaagctgagccaggccttcaaccactggctgaaggtgcctgaggacaagctgcagatcatcatcgaggtgacagagatgctgcacaatgccagcctgctgattgatgacatcgaggacaacagcaagctgcggcggggcttccctgtggcccacagcatctacggcatccccagcgtcatcaacagcgccaactacgtgtacttcctgggcctggagaaggtgctgaccctggaccacccagatgctgtgaagctgttcacccggcagctgctggagctgcaccagggccagggcctggacatctactggagggacaactacacctgccccacagaggaggagtacaaggccatggtgctgcagaagacaggaggcctgtttggcctggccgtgggcctgatgcagctgttcagtgactacaaggaggacctgaagcccctgctgaacaccctgggcctcttcttccagatcagagatgattatgccaacctgcacagcaaggagtacagcgagaacaagagcttctgtgaggacctgacagagggcaagttctccttccccaccatccacgccatctggagcaggcctgagagcacccaggtgcagaacatcctgcggcagaggacagaaaatattgattag

SEQ ID NO: 153727 - DNA, 903 bp, Artificial Sequence; identical to SEQ ID NO: 153724
  Description of Artificial Sequence: Synthetic coding sequence

SEQ ID NO: 153728 - DNA, 903 bp, Artificial Sequence; identical to SEQ ID NO: 153724
  Description of Artificial Sequence: Synthetic coding sequence

SEQ ID NO: 153729 - DNA, 693 bp, Artificial Sequence
  Description of Artificial Sequence: Synthetic coding sequence
atggagaagacccaggagaccgtgcagaggatcctgctggagccctacaagtacctgctgcagctgcccgggaagcaggtgaggaccaagctgagccaggccttcaaccactggctgaaggtgcctgaggacaagctgcagatcatcatcgaggtgacagagatgctgcacaatgccagcctgctgattgatgacatcgaggacaacagcaagctgcggcggggcttccctgtggcccacagcatctacggcatccccagcgtcatcaacagcgccaactacgtgtacttcctgggcctggagaaggtgctgaccctggaccacccagatgctgtgaagctgttcacccggcagctgctggagctgcaccagggccagggcctggacatctactggagggacaactacacctgccccacagaggaggagtacaaggccatggtgctgcagaagacaggaggcctgtttggcctggccgtgggcctgatgcagctgttcagtgactacaaggaggacctgaagcccctgctgaacaccctgggcctcttcttccagatcagagatgattatgccaacctgcacagcaaggagtacagcgagaacaagagcttctgtgaggacctgacagagggcaagttctccttccccaccatccacgccatctggagcaggcctgagagcacccaggtgtag

SEQ ID NO: 153730 - DNA, 537 bp, Artificial Sequence
  Description of Artificial Sequence: Synthetic coding sequence
atgggcaacagcctgctgcgggagaacagacggcagcagaacacccaggagatgccctggaatgtgaggatgcagagccccaagcagaggaccagccgctgctgggaccaccacatcgccgagggctgcttctgcctgccctggaagaagatcctgatctttgagaagaggcaggacagccagaatgaaaatgaaagaatgagcagcacccccatccaggacaacgtggaccagacctacagcgaggagctgtgctacaccctcatcaaccaccgggtgctgtgcacccggcccagcggcaacagcgctgaggagtactatgaaaatgtgccctgcaaggccgagcggccccgggagagcctgggcggcacagaaacagagtacagcctgctgcacatgcccagcacagaccccaggcatgcccggagcccagaagatgaatatgagctgctgatgccccaccgcatcagcagccacttcctgcagcagccccggcccctgatggcccccagcgagacccagttcagccacctgtag

SEQ ID NO: 153731 - DNA, 492 bp, Artificial Sequence
  Description of Artificial Sequence: Synthetic coding sequence
atgggcaacagcctgctgcgggagaacagacggcagcagaacacccaggagatgccctggaatgtgaggatgcagagccccaagcagaggaccagcaggaagaagatcctgatctttgagaagaggcaggacagccagaatgaaaatgaaagaatgagcagcacccccatccaggacaacgtggaccagacctacagcgaggagctgtgctacaccctcatcaaccaccgggtgctgtgcacccggcccagcggcaacagcgctgaggagtactatgaaaatgtgccctgcaaggccgagcggccccgggagagcctgggcggcacagaaacagagtacagcctgctgcacatgcccagcacagaccccaggcatgcccggagcccagaagatgaatatgagctgctgatgccccaccgcatcagcagccacttcctgcagcagccccggcccctgatggcccccagcgagacccagttcagccacctgtag

SEQ ID NO: 153732 - DNA, 543 bp, Artificial Sequence
  Description of Artificial Sequence: Synthetic coding sequence
atgggcaacagcctgctgcgggagaacagcttccggcggcagcagaacacccaggagatgccctggaatgtgaggatgcagagccccaagcagaggaccagccgctgctgggaccaccacatcgccgagggctgcttctgcctgccctggaagaagatcctgatctttgagaagaggcaggacagccagaatgaaaatgaaagaatgagcagcacccccatccaggacaacgtggaccagacctacagcgaggagctgtgctacaccctcatcaaccaccgggtgctgtgcacccggcccagcggcaacagcgctgaggagtactatgaaaatgtgccctgcaaggccgagcggccccgggagagcctgggcggcacagaaacagagtacagcctgctgcacatgcccagcacagaccccaggcatgcccggagcccagaagatgaatatgagctgctgatgccccaccgcatcagcagccacttcctgcagcagccccggcccctgatggcccccagcgagacccagttcagccacctgtag

SEQ ID NO: 153733 - DNA, 351 bp, Artificial Sequence
  Description of Artificial Sequence: Synthetic coding sequence
atgcccagccctggcaccgtgtgcagcctgctgctgctgggcatgctgtggctggacctggccatggccggcagcagcttcctgagccctgagcaccagagggtgcagaggaaggagagcaagaagcccccagccaagctgcagccccgggccctggccggctggctgcggccagaagatggcggccaggccgagggcgcagaagatgagctggaggtgcgcttcaatgccccctttgatgtgggcatcaagctgagcggcgtgcagtaccagcagcacagccaggccctgggcaagttcctgcaggacatcctgtgggaggaggccaaggaggccccagctgacaagtag

SEQ ID NO: 153734 - DNA, 354 bp, Artificial Sequence
  Description of Artificial Sequence: Synthetic coding sequence
atgcccagccctggcaccgtgtgcagcctgctgctgctgggcatgctgtggctggacctggccatggccggcagcagcttcctgagccctgagcaccagagggtgcagcagaggaaggagagcaagaagcccccagccaagctgcagccccgggccctggccggctggctgcggccagaagatggcggccaggccgagggcgcagaagatgagctggaggtgcgcttcaatgccccctttgatgtgggcatcaagctgtctggagtgcagtaccagcagcacagccaggccctgggcaagttcctgcaggacatcctgtgggaggaggccaaggaggccccagctgacaagtag

SEQ ID NO: 153735 - DNA, 276 bp, Artificial Sequence
  Description of Artificial Sequence: Synthetic coding sequence
atgcccagccctggcaccgtgtgcagcctgctgctgctgggcatgctgtggctggacctggccatggccggcagcagcttcctgagccctgagcaccagagggtgcagcagaggaaggagagcaagaagcccccagccaagctgcagccccgggccctggccggctggctgcggccagaagatggcggccaggccgagggcgcagaagatgagctggaggtgagaagaccccagcccaccagtgaccggccccaggccctgctgaccagcctgtag

SEQ ID NO: 153736 - DNA, 102 bp, Artificial Sequence
  Description of Artificial Sequence: Synthetic coding sequence
atgcccagccctggcaccgtgtgcagcctgctgctgctgggcatgctgtggctggacctggccatggccggcagcagcttcctgagccctgagcaccagtag

SEQ ID NO: 153737 - DNA, 354 bp, Artificial Sequence; identical to SEQ ID NO: 153734
  Description of Artificial Sequence: Synthetic coding sequence

SEQ ID NO: 153738 - DNA, 351 bp, Artificial Sequence; identical to SEQ ID NO: 153733
  Description of Artificial Sequence: Synthetic coding sequence

SEQ ID NO: 153739 - DNA, 318 bp, Artificial Sequence
  Description of Artificial Sequence: Synthetic coding sequence
atgttcacctgctggtggagctacctgcggagcaccctggccgctgtgcctggagaggccagccgggtgcagcagaggaaggagagcaagaagcccccagccaagctgcagccccgggccctggccggctggctgcggccagaagatggcggccaggccgagggcgcagaagatgagctggaggtgcgcttcaatgccccctttgatgtgggcatcaagctgtctggagtgcagtaccagcagcacagccaggccctgggcaagttcctgcaggacatcctgtgggaggaggccaaggaggccccagctgacaagtag

SEQ ID NO: 153740 - DNA, 201 bp, Artificial Sequence
  Description of Artificial Sequence: Synthetic coding sequence
atgttcacctgctggtggagctacctgcggagcaccctggccgctgtgcctggagaggccagccgggtgcagttcaatgccccctttgatgtgggcatcaagctgagcggcgtgcagtaccagcagcacagccaggccctgggcaagttcctgcaggacatcctgtgggaggaggccaaggaggccccagctgacaagtag

SEQ ID NO: 153741 - DNA, 315 bp, Artificial Sequence
  Description of Artificial Sequence: Synthetic coding sequence
atgttcacctgctggtggagctacctgcggagcaccctggccgctgtgcctggagaggccagccgggtgcagaggaaggagagcaagaagcccccagccaagctgcagccccgggccctggccggctggctgcggccagaagatggcggccaggccgagggcgcagaagatgagctggaggtgcgcttcaatgccccctttgatgtgggcatcaagctgagcggcgtgcagtaccagcagcacagccaggccctgggcaagttcctgcaggacatcctgtgggaggaggccaaggaggccccagctgacaagtag

SEQ ID NO: 153742 - DNA, 351 bp, Artificial Sequence; identical to SEQ ID NO: 153733
  Description of Artificial Sequence: Synthetic coding sequence

SEQ ID NO: 153743 - DNA, 354 bp, Artificial Sequence; identical to SEQ ID NO: 153734
  Description of Artificial Sequence: Synthetic coding sequence

SEQ ID NO: 153744 - DNA, 354 bp, Artificial Sequence; identical to SEQ ID NO: 153734
  Description of Artificial Sequence: Synthetic coding sequence

SEQ ID NO: 153745 - DNA, 1794 bp, Artificial Sequence
  Description of Artificial Sequence: Synthetic coding sequence
atggccgagggcagcgctgtgtctgacccccagcacgccgcccggctgctgcgggccctgagcagcttccgggaggagagccgcttctgtgatgcccacctggtgctggatggagaggagatccctgtgcagaagaacatcctggccgccgccagcccctacatccgcaccaagctgaactacaacccccccaaggatgatggcagcacctacaagattgagctggagggcatctctgtgatggtgatgagggagatcctggactacatcttcagcggccagatccggctgaatgaagacaccatccaggatgtggtgcaggccgctgacctgctgctgctgacagacctgaagaccctgtgctgtgagttcctggagggctgcatcgctgctgagaactgcatcggcatccgggactttgccctgcactactgcctgcaccacgtgcactacctggccacagagtacctggagacccacttcagagatgtgagcagcacagaggagttcctggagctgagcccccagaagctgaaggaggtgatcagcctggagaagctgaatgtgggcaatgaaagatatgtgtttgaggccgtcatccgctggatcgcccatgacacagagatcaggaaggtgcacatgaaggatgtgatgtctgccctgtgggtgtctggcctggacagcagctacctgcgggagcagatgctgaatgagcccctggtgcgggagatcgtgaaggaatgtagcaacatccccctgagccagccccagcagggcgaggccatgctggccaacttcaagccccggggctacagtgaatgtattgtgacagtgggcggggaggagcgggtgtccaggaagcccacagctgccatgcgctgcatgtgccccctgtatgaccccaaccggcagctgtggattgagctggcccccctgtccatgccccgcatcaaccacggcgtgctgtctgctgagggcttcctgtttgtgtttggaggccaggatgagaacaagcagaccctgagcagtggagagaagtatgaccctgatgccaacacctggacagccctgccccccatgaatgaggcccggcacaactttggaattgtggagattgatggcatgctgtacatcctgggcggggaggatggagagaaggagctgatctccatggagtgctatgacatctacagcaagacctggaccaagcagcctgacctgaccatggtgaggaagattggctgctatgctgccatgaagaagaagatctatgccatgggcggcggcagctatggcaagctgtttgaatctgtggagtgctatgaccccaggacccagcagtggacagccatctgccccctgaaggagaggagatttggagctgtggcctgtggggtggccatggagctgtatgtgtttggaggagtgcgcagccgggaggatgcccagggcagcgagatggtgacctgcaagtctgagttctaccatgatgagttcaagcgctggatctacctgaatgaccagaacctgtgcatcccagccagcagcagctttgtgtatggagctgtgcccatcggggccagcatctacgtgattggagacctggacaccggcaccaactatgactatgtgcgggagttcaagaggagcacaggcacctggcaccacaccaagcccctgctgcccagcgacctgcggaggacaggctgtgccgccctgagaattgccaactgcaagctgttccggctgcagctgcagcagggcctcttccgcatccgggtgcacagcccctag

SEQ ID NO: 153746 - DNA, 591 bp, Artificial Sequence
  Description of Artificial Sequence: Synthetic coding sequence
atgttctgtgagaaggccatggagctgatccgggagctgcaccgggcccctgagggccagctgcctgccttcaatgaagatggcctgcggcaggtgctggaggagatgaaggccctgtatgagcagaaccagagtgatgtgaatgaggccaagagcggcggccgcagtgacctgatccccaccatcaagttccgccactgcagcctgctgaggaacagacgctgcaccgtggcctacctgtatgaccggctgctgcgcatccgggccctgcgctgggagtatggctctgtgctgcccaatgccctgcgcttccacatggctgctgaggagatggagtggttcaacaactacaagaggagcctggccacctacatgaggagcctgggcggagatgagggcctggacatcacccaggacatgaagccacccaagagcctgtacatcgaggtgcgctgcctgaaggactatggagaatttgaggtggatgatggcacctctgtgctgctgaagaagaacagccagcacttcctgccccgctggaagtgtgagcagctgatccggcagggcgtgctggagcacatcctgtcctag

SEQ ID NO: 153747 - DNA, 498 bp, Artificial Sequence
  Description of Artificial Sequence: Synthetic coding sequence
atgttctgtgagaaggccatggagctgatccgggagctgcaccgggcccctgagggccagctgcctgccttcaatgaagatggcctgcggcaggtgctggaggagatgaaggccctgtatgagcagaaccagagtgatgtgaatgaggccaagagcggcggccgcagtgacctgatccccaccatcaagttccgccactgcagcctgctgaggaacagacgctgcaccgtggcctacctgtatgaccggctgctgcgcatccgggccctgcgctgggagtatggctctgtgctgcccaatgccctgcgcttccacatggctgctgaggagatggagagccgctctgtggcccaggccggcgtgcagtggtgcatcctgtgcagcctgcagctgcccccacctggcttcaagcagttcagctgcctgagcctgcccagcagctgtgactaccgctggagcggcctcatcatcatcaaggacctgctgctgctgatctag

SEQ ID NO: 153748 - DNA, 558 bp, Artificial Sequence
  Description of Artificial Sequence: Synthetic coding sequence
atggatgctgctgaggtggagttcctggccgagaaggagctggtgaccatcatccccaacttcagcctggacaagatctacctgattggaggagacctgggccccttcaaccctggcctgcctgtggaggtgcccctgtggctggccatcaacctgaagcagaggcagaagtgccgcctgctgcccccagagtggatggatgtggagaagctggagaagatgagggaccacgagaggaaggaggagaccttcacccccatgcccagcccctactacatggagctgaccaagctgctgctgaaccacgccagtgacaacatccccaaggcagatgagatccgcaccctggtgaaggacatgtgggacaccagaattgccaagctgcgggtgtctgctgacagctttgtgcggcagcaggaggcccacgccaagctggacaacctgaccctgatggagatcaacaccagcggcaccttcctgacccaggccctgaaccacatgtacaagctgcggaccaacctgcagcccctggagagcacccagagccaggacttctag

SEQ ID NO: 153749 - DNA, 651 bp, Artificial Sequence
  Description of Artificial Sequence: Synthetic coding sequence
atgtctgaggcctacttccgggtggagagcggggccctgggccctgaggagaacttcctgagcctggatgacatcctgatgagccatgagaagctgcctgtgaggacagaaacagccatgccccggctgggcgccttcttcctggagaggtctgctggagctgagacagacaatgctgtgccccagggcagcaagctggagctgcccctgtggctggccaagggcctgtttgacaacaagaggcgcatcctgtctgtggagctgcccaagatctaccaggagggctggaggacagtgttttctgctgaccccaacgtggtggacctgcacaagatgggcccccacttctacggcttcggcagccagctgctgcactttgacagcccagaaaatgctgacatcagccagagcctgctgcagaccttcatcggccgcttccgccgcatcatggacagcagccagaatgcctacaatgaagacaccagcgccctggtggcccggctggatgagatggagcggggcctcttccagacaggccagaagggcctgaatgacttccagtgctgggagaagggccaggccagccagatcacagccagcaacctggtgcagaactacaagaagaggaagttcacagacatggaggactag

SEQ ID NO: 153750 - DNA, 417 bp, Artificial Sequence
  Description of Artificial Sequence: Synthetic coding sequence
atgtctgaggcctacttccgggtggagagcggggccctgggccctgaggagaacttcctgagcctggatgacatcctgatgagccatgagaagctgcctgtgaggacagaaacagccatgccccggctgggcgccttcttcctggagaggtctgctggagctgagacagacaatgctgtgccccagaccttcatcggccgcttccgccgcatcatggacagcagccagaatgcctacaatgaagacaccagcgccctggtggcccggctggatgagatggagcggggcctcttccagacaggccagaagggcctgaatgacttccagtgctgggagaagggccaggccagccagatcacagccagcaacctggtgcagaactacaagaagaggaagttcacagacatggaggactag

SEQ ID NO: 153751 - DNA, 768 bp, Artificial Sequence
  Description of Artificial Sequence: Synthetic coding sequence
atgtctgaggcctacttccgggtggagagcggggccctgggccctgaggagaacttcctgagcctggatgacatcctgatgagccatgagaagctgcctgtgaggacagaaacagccatgccccggctgggcgccttcttcctggagaggtctgctggagctgagacagacaatgctgtgccccagggctttgccctgctgccccggctggagtgcagcggggtcatctggctgacagctgccctgaccagccaggcccctgagatcctgcccccccagccccccatgtggctggtgctgcagggcagcaagctggagctgcccctgtggctggccaagggcctgtttgacaacaagaggcgcatcctgtctgtggagctgcccaagatctaccaggagggctggaggacagtgttttctgctgaccccaacgtggtggacctgcacaagatgggcccccacttctacggcttcggcagccagctgctgcactttgacagcccagaaaatgctgacatcagccagagcctgctgcagaccttcatcggccgcttccgccgcatcatggacagcagccagaatgcctacaatgaagacaccagcgccctggtggcccggctggatgagatggagcggggcctcttccagacaggccagaagggcctgaatgacttccagtgctgggagaagggccaggccagccagatcacagccagcaacctggtgcagaactacaagaagaggaagttcacagacatggaggactag

SEQ ID NO: 153752 - DNA, 672 bp, Artificial Sequence
  Description of Artificial Sequence: Synthetic coding sequence
atgacagaggaggtggacttcctgggccaggacagtgatggcggcagcgaggaggtggtgctgaccccagctgagctgattgagcggctggagcaggcctggatgaatgagaagtttgcccctgagctgctggagagcaagccagagatcgtggagtgtgtgatggagcagctggagcacatggaggagaacctgcggcgggccaagcgggaggacctgaaggtgtccatccaccagatggagatggagcgcatccgctacgtgctgagcagctacctgcgctgccgcctgatgaagattgagaagttcttcccccacgtgctggagaaggagaagaccaggcctgagggggagcccagcagcctgagccctgaggagctggcctttgcccgggagttcatggccaacacagagagctacctgaagaatgtggccctgaagcacatgccacccaacctgcagaaggtggacctcttccgggctgtgcccaagccagacctggacagctatgtgttcctgcgggtgcgggagcggcaggagaacatcctggtggagccagacacagatgagcagagggactatgtgattgacctggagaagggcagccagcacctgatccgctacaagaccatcgcccccctggtggccagcggggctgtgcagctgatctag

SEQ ID NO: 153753 - DNA, 672 bp, Artificial Sequence; identical to SEQ ID NO: 153752
  Description of Artificial Sequence: Synthetic coding sequence

SEQ ID NO: 153754 - DNA, 303 bp, Artificial Sequence
  Description of Artificial Sequence: Synthetic coding sequence
atgacagaggaggtggacttcctgggccaggacagtgatggcggcagcgaggaggtggtgctgaccccagctgagctgattgagcggctggagcaggcctggatgaatgagaagtttgcccctgagctgctggagagcaagccagagatcgtggagtgtgtgatggagcagctggagcacatggaggagaacctgcggcgggccaagcgggaggacctgaaggtgtccatccaccagatggagatggagcgcatccgctacgtgctgagcagctacctgcgctgccgcctgatgaaggtgtag

SEQ ID NO: 153755 - DNA, 939 bp, Artificial Sequence
  Description of Artificial Sequence: Synthetic coding sequence
atggagggcgctgctgcccgggaggcccggggcacagagaccccccgggccagcgcccctcctccagcccccagcgagcccccagctgccccccgggcccggccccggctggtgttccgcacccagctggcccacggcagccccaccgggaagattgagggcttcaccaacgtgcgggagctgtatgccaagattgctgaggcctttggaattgcccccacagagatcctcttctgcaccctgaacagccacaaggtggacatgcagaagctgctgggcggccagatcggcctggaggacttcatctttgcccacgtgcggggggagaccaaggaggtggaggtgaccaagacagaagatgccctgggcctgaccatcacagacaatggagctggctacgccttcatcaagaggatcaaggagggcagcatcatcaaccgcatcgaggccgtgtgtgtgggggacagcattgaggccatcaatgaccacagcatcgtgggctgccgccactatgaggtggccaagatgctgcgggagctgcccaagagccagcccttcaccctgcggctggtgcagcccaagagggcctttgacatgattggccagaggagccgcagcagcaagtgccctgtggaggccaaggtgaccagcggccgggagaccctgcggctgcggagcggcggggccgccaccgtggaggaggcccccagcgagtttgaggaggaggccagcaggaaggtggatgacctgctggagagctacatgggcatccgggaccctgagctggccagcaccatggtggagaccagcaagaagacagccagcgcccaggagtttgcccgctgcctggacagcgtgctgggggagtttgccttcccagatgaatttgtggtggaggtgtgggccgccatcggggaggcccgggaggcctgtggctag

SEQ ID NO: 153756 - DNA, 2097 bp, Artificial Sequence
  Description of Artificial Sequence: Synthetic coding sequence
atgcccagcgagggccgctgctgggagaccctgaaggccctgcggagcagtgacaagggccgcctgtgctactacagagactggctgctgcggagagaagatgtgctggaggagtgcatgagcctgcccaagctgagcagctacagcggctgggtggtggagcacgtgctgccccacatgcaggagaaccagcccctgtctgagaccagccccagcagcaccagcgccagcgccctggaccagcccagctttgtgcccaagagcccagatgccagcagcgccttctccccagccagccctgccacccccaacggcaccaagggcaaggatgagagccagcacacagagagcatggtgctgcagagcagccggggcatcaaggtggagggctgtgtgaggatgtatgagctggtgcacaggatgaagggcacagagggcctgcggctgtggcaggaggagcaggagaggaaggtgcaggccctgtctgagatggccagcgagcagctgaagagatttgatgagtggaaggagctgaagcagcacaaggagttccaggacctgcgggaggtgatggagaagagcagccgggaggccctgggccaccaggagaagctgaaggccgagcaccgccaccgggccaagatcctgaacctgaagctgcgggaggccgagcagcagagggtgaagcaggccgagcaggagcggctgaggaaggaggagggccagatccggctgcgggccctgtatgccctgcaggaggagatgctgcagctgagccagcagctggatgccagcgagcagcacaaggccctgctgaaggtggacctggccgccttccagacccggggcaaccagctgtgcagcctcatcagcggcatcatccgggccagcagcgagagcagctaccccacagctgagagccaggccgaggccgagcgggccctgcgggagatgagggacctgctgatgaacctgggccaggagatcacccgggcctgtgaggacaagaggcggcaggatgaggaggaggcccaggtgaagctgcaggaggcccagatgcagcagggccctgaggcccacaaggagcccccagcccccagccagggccctgggggcaagcagaatgaagacctgcaggtgaaggtgcaggacatcaccatgcagtggtaccagcagctgcaggatgcctccatgcagtgtgtgctgacctttgagggcctgaccaacagcaaggacagccaggccaagaagatcaagatggacctgcagaaggccgccaccatccctgtgtcccagatcagcaccatcgccggcagcaagctgaaggagatctttgacaagatccacagcctgctgagcggcaagcctgtgcagagcggcggccgctctgtgtctgtgaccctgaacccccagggcctggactttgtgcagtacaagctggccgagaagtttgtgaagcagggcgaggaggaggtggccagccaccacgaggccgccttccccatcgctgtggtggccagcggcatctgggagctgcacccccgggtgggggacctgatcctggcccacctgcacaagaagtgcccctacagcgtgcccttctaccccaccttcaaggagggcatggccctggaggactaccagaggatgctgggctaccaggtgaaggacagcaaggtggagcagcaggacaacttcctgaagaggatgagcggcatgatccggctgtatgctgccatcatccagctgcgctggccctacggcaaccggcaggagatccacccccacggcctgaaccacggctggcgctggctggcccagatcctgaacatggagcccctgagtgatgtgacagccaccctgctgtttgacttcctggaggtgtgtggaaatgccctgatgaagcagtaccaggtgcagttctggaagatgctgatcctgatcaaggaggactacttcccccgcatcgaggccatcaccagcagcggccagatgggcagcttcatccggctgaagcagttcctggagaagtgcctgcagcacaaggacatccctgtgcccaagggcttcctgaccagcagcttctggaggagctag

SEQ ID NO: 153757 - DNA, 1980 bp, Artificial Sequence
  Description of Artificial Sequence: Synthetic coding sequence
atgcccagcgagggccgctgctgggagaccctgaaggccctgcggagcagtgacaagggccgcctgtgctactacagagactggctgctgcggagagaagatgtgctggaggagtgcatgagcctgcccaagctgagcagctacagcggctgggtggtggagcacgtgctgccccacatgcaggagaaccagcccctgtctgagaccagccccagcagcaccagcgccagcgccctggaccagcccagctttgtgcccaagagcccagatgccagcagcgccttctccccagccagccctgccacccccaacggcaccaagggcaaggatgagagccagcacacagagagcatggtgctgcagagcagccggggcatcaaggtggagggctgtgtgaggatgtatgagctggtgcacaggatgaagggcacagagggcctgcggctgtggcaggaggagcaggagaggaaggtgcaggccctgtctgagatggccagcgagcagctgaagagatttgatgagtggaaggagctgaagcagcacaaggagttccaggacctgcgggaggtgatggagaagagcagccgggaggccctgggccaccaggagaagctgaaggccgagcaccgccaccgggccaagatcctgaacctgaagctgcgggaggccgagcagcagagggtgaagcaggccgagcaggagcggctgaggaaggaggagggccagatccggctgcgggccctgtatgccctgcaggaggagatgctgcagctgagccagcagctggatgccagcgagcagcacaaggccctgctgaaggtggacctggccgccttccagacccggggcaaccagctgtgcagcctcatcagcggcatcatccgggccagcagcgagagcagctaccccacagctgagagccaggccgaggccgagcgggccctgcgggagatgagggacctgctgatgaacctgggccaggagatcacccgggcctgtgaggacaagaggcggcaggatgaggaggaggcccaggtgaagctgcaggaggcccagatgcagcagggccctgaggcccacaaggagcccccagcccccagccagggccctgggggcaagcagaatgaagacctgcaggtgaaggtgcaggacatcaccatgcagtggtaccagcagctgcaggatgcctccatgcagtgtgtgctgacctttgagggcctgaccaacagcaaggacagccaggccaagaagatcaagatggacctgcagaaggccgccaccatccctgtgtcccagatcagcaccatcgccggcagcaagctgaaggagatctttgacaagatccacagcctgctgagcggcaagcctgtgcagagcggcggccgctctgtgtctgtgaccctgaacccccagggcctggactttgtgcagtacaagctggccgagaagtttgtgaagcagggcgaggaggaggtggccagccaccacgaggccgccttccccatcgctgtggtggccagcggcatctgggagctgcacccccgggtgggggacctgatcctggcccacctgcacaagaagtgcccctacagcgtgcccttctaccccaccttcaaggagggcatggccctggaggactaccagaggatgctgggctaccaggtgaaggacagcaaggtggagcagcaggacaacttcctgaagaggatgagcggcatgatccggctgtatgctgccatcatccagctgcgctggccctacggcaaccggcaggagatccacccccacggcctgaaccacggctggcgctggctggcccagatcctgaacatggagcccctgagtgatgtgacagccaccctgctgtttgacttcctggaggtgtgtggaaatgccctgatgaagcagtaccaggtgcagttctggaagatgctgatcctgatcaaggaggactacttcccccgctaccaggcctgctag

SEQ ID NO: 153758 - DNA, 1335 bp, Artificial Sequence
  Description of Artificial Sequence: Synthetic coding sequence
atgctgcagctgagccagcagctggatgccagcgagcagcacaaggccctgctgaaggtggacctggccgccttccagacccggggcaaccagctgtgcagcctcatcagcggcatcatccgggccagcagcgagagcagctaccccacagctgagagccaggccgaggccgagcgggccctgcgggagatgagggacctgctgatgaacctgggccaggagatcacccgggcctgtgaggacaagaggcggcaggatgaggaggaggcccaggtgaagctgcaggaggcccagatgcagcagggccctgaggcccacaaggagcccccagcccccagccagggccctgggggcaagcagaatgaagacctgcaggtgaaggtgcaggacatcaccatgcagtggtaccagcagctgcaggatgcctccatgcagtgtgtgctgacctttgagggcctgaccaacagcaaggacagccaggccaagaagatcaagatggacctgcagaaggccgccaccatccctgtgtcccagatcagcaccatcgccggcagcaagctgaaggagatctttgacaagatccacagcctgctgagcggcaagcctgtgcagagcggcggccgctctgtgtctgtgaccctgaacccccagggcctggactttgtgcagtacaagctggccgagaagtttgtgaagcagggcgaggaggaggtggccagccaccacgaggccgccttccccatcgctgtggtggccagcggcatctgggagctgcacccccgggtgggggacctgatcctggcccacctgcacaagaagtgcccctacagcgtgcccttctaccccaccttcaaggagggcatggccctggaggactaccagaggatgctgggctaccaggtgaaggacagcaaggtggagcagcaggacaacttcctgaagaggatgagcggcatgatccggctgtatgctgccatcatccagctgcgctggccctacggcaaccggcaggagatccacccccacggcctgaaccacggctggcgctggctggcccagatcctgaacatggagcccctgagtgatgtgacagccaccctgctgtttgacttcctggaggtgtgtggaaatgccctgatgaagcagtaccaggtgcagttctggaagatgctgatcctgatcaaggaggactacttcccccgcatcgaggccatcaccagcagcggccagatgggcagcttcatccggctgaagcagttcctggagaagtgcctgcagcacaaggacatccctgtgcccaagggcttcctgaccagcagcttctggaggagctag

SEQ ID NO: 153759 - DNA, 2490 bp, Artificial Sequence
  Description of Artificial Sequence: Synthetic coding sequence
atggccctgaccagcatcaatgccacccccacccagctgagcagcagcagcaactgcctgagtgacaccaaccagaacaagcagagcagcgagagcgctgtgagcagcacagtgaaccctgtggccatccacaagaggagcaaggtgaagacagagcctgagggcctgcggcctgccagccccctggccctgacccagggccaggtgtctggccacggcagctgtggctgtgccctgcccctgagccaggagcagctggccgacctgaaggaggacctggacagagatgactgcaagcaggaggccgaggtggtgatctatgagaccaactgccactgggaggactgcaccaaggagtatgacacccaggagcagctggtgcaccacatcaacaatgagcacatccacggggagaagaaggagtttgtgtgccgctggcaggcctgcacccgggagcagaagcccttcaaggcccagtacatgctggtggtgcacatgagaagacacactggagagaagccccacaagtgcacctttgagggctgcagcaaggcctacagccggctggagaacctgaagacccacctgcggagccacactggagagaagccctacgtgtgtgaacatgagggctgcaacaaggccttcagcaatgccagtgaccgggccaagcaccagaacagaacccacagcaatgagaagccctacatctgcaagatccctggctgcaccaagcgctacacagaccccagcagcctgaggaagcacgtgaagacagtgcacggcccagatgcccacgtgaccaagaagcagagaaatgatgtgcacctgcggacccccctgctgaaggaaaatggagacagcgaggccggcacagagcccggcggccctgagagcacagaggccagcagcaccagccaggccgtggaggactgcctgcacgtgcgggccatcaagacagagagcagcggcctgtgccagagcagccctggggcccagagcagctgcagcagcgagcccagccccctgggcagcgcccccaacaatgattctggagtggagatgcctggcaccggccctggcagcctgggggacctgacagccctggatgacaccccacctggagctgacaccagcgccctggccgcccccagcgctgggggcctgcagctgaggaagcacatgaccaccatgcacagatttgagcagctgaagaaggagaagctgaagagcctgaaggacagctgctcctgggccggccccaccccccacaccaggaacaccaagctgccccccctgcccggcagcggcagcatcctggagaacttcagcggcagcggcggcggcggccctgctggcctgctgcccaacccccggctgtctgagctgagcgccagcgaggtgaccatgctgagccagctgcaggagcggcgggacagcagcaccagcacagtgtcctctgcctacacagtgtccagaagaagcagcggcatcagcccctacttcagcagcagaagaagcagcgaggccagccccctgggcgccggccggccccacaatgccagcagcgctgacagctatgaccccatcagcacagatgccagccgccgcagcagcgaggccagccagtgcagcggcggcagcggcctgctgaacctgaccccagcccagcagtacagcctgcgggccaagtatgctgctgccactggaggccccccacccacccccctgcccggcctggagaggatgagcctgcggacccggctggccctgctggatgcccctgagaggaccctgcctgctggctgcccccggcccctgggcccccggcggggcagtgatggccccacctacggccacggccatgctggagctgccccagccttcccccatgaggcccctgggggcggggcccggcgggccagtgaccctgtgcggcggccagatgccctgagcctgccccgggtgcagcgcttccacagcacccacaacgtgaaccctggccccctgcccccctgtgccgaccggcggggcctgcggctgcagagccaccccagcacagatggcggcctggcccggggggcctacagcccccggccccccagcatcagtgaaaatgtggccatggaggccgtggccgccggcgtggatggagctggccctgaggccgacctgggcctgcctgaagatgacctggtgctgcctgatgatgtggtgcagtacatcaaggcccacgccagcggggccctggatgagggcaccggccaggtgtaccccacagagagcacaggcttcagtgacaacccccggctgcccagccctggcctgcacggccagaggaggatggtggccgctgacagcaatgtgggccccagcgcccccatgctgggcggctgccagctgggctttggagcccccagcagcctgaacaagaacaacatgcctgtgcagtggaatgaggccagcgccacctggctgagcggcacctag

SEQ ID NO: 153760 - DNA, 4761 bp, Artificial Sequence
  Description of Artificial Sequence: Synthetic coding sequence
atggagaccagcgccagcgccacagccagcgagaagcaggaggccaagagcggcatcctggaggccgccggcttcccagaccccgggaagaaggccagccccctggtggtggccgctgctgctgctgctgctgtggccgcccagggcgtgccccagcacctgctgccccccttccacgcccccctgcccatcgacatgaggcaccaggagggccgctaccactatgagccccacagcgtgcatggagtgcacggccccccagccctgagcggcagccctgtgatcagtgacatcagcctcatccggctgagcccccaccctgctggccctggagagagccccttcaatgccccccacccctacgtgaacccccacatggagcactacctgcggtctgtgcacagcagccccaccctgtccatgatctctgctgcccggggcctgagccctgcagatgtggcccaggagcacctgaaggagcggggcctgtttggcctgcctgcccctggcaccacccccagcgactactaccaccagatgaccctggtggccggccacccagccccctacggggacctgctgatgcagagcggcggggccgccagcgccccccacctgcatgactacctgaaccctgtggatgtgagccgcttcagcagcccccgggtgaccccccggctgagcaggaagagggccctgagcatcagccccctgagtgatgccagcctggacctgcagaggatgatccgcaccagccccaacagcctggtggcctacatcaacaacagccgcagcagcagcgctgccagcggcagctatggccacctgtctgctggggccctgagccctgccttcaccttcccccaccccatcaaccctgtggcctaccagcagatcctgagccagcagaggggcctgggcagcgccttcggccacaccccacccctcatccagcccagccccaccttcctggcccagcagcccatggccctgaccagcatcaatgccacccccacccagctgagcagcagcagcaactgcctgagtgacaccaaccagaacaagcagagcagcgagagcgctgtgagcagcacagtgaaccctgtggccatccacaagaggagcaaggtgaagacagagcctgagggcctgcggcctgccagccccctggccctgacccagggccaggtgtctggccacggcagctgtggctgtgccctgcccctgagccaggagcagctggccgacctgaaggaggacctggacagagatgactgcaagcaggaggccgaggtggtgatctatgagaccaactgccactgggaggactgcaccaaggagtatgacacccaggagcagctggtgcaccacatcaacaatgagcacatccacggggagaagaaggagtttgtgtgccgctggcaggcctgcacccgggagcagaagcccttcaaggcccagtacatgctggtggtgcacatgagaagacacactggagagaagccccacaagtgcacctttgagggctgcagcaaggcctacagccggctggagaacctgaagacccacctgcggagccacactggagagaagccctacgtgtgtgaacatgagggctgcaacaaggccttcagcaatgccagtgaccgggccaagcaccagaacagaacccacagcaatgagaagccctacatctgcaagatccctggctgcaccaagcgctacacagaccccagcagcctgaggaagcacgtgaagacagtgcacggcccagatgcccacgtgaccaagaagcagagaaatgatgtgcacctgcggacccccctgctgaaggaaaatggagacagcgaggccggcacagagcccggcggccctgagagcacagaggccagcagcaccagccaggccgtggaggactgcctgcacgtgcgggccatcaagacagagagcagcggcctgtgccagagcagccctggggcccagagcagctgcagcagcgagcccagccccctgggcagcgcccccaacaatgattctggagtggagatgcctggcaccggccctggcagcctgggggacctgacagccctggatgacaccccacctggagctgacaccagcgccctggccgcccccagcgctgggggcctgcagctgaggaagcacatgaccaccatgcacagatttgagcagctgaagaaggagaagctgaagagcctgaaggacagctgctcctgggccggccccaccccccacaccaggaacaccaagctgccccccctgcccggcagcggcagcatcctggagaacttcagcggcagcggcggcggcggccctgctggcctgctgcccaacccccggctgtctgagctgagcgccagcgaggtgaccatgctgagccagctgcaggagcggcgggacagcagcaccagcacagtgtcctctgcctacacagtgtccagaagaagcagcggcatcagcccctacttcagcagcagaagaagcagcgaggccagccccctgggcgccggccggccccacaatgccagcagcgctgacagctatgaccccatcagcacagatgccagccgccgcagcagcgaggccagccagtgcagcggcggcagcggcctgctgaacctgaccccagcccagcagtacagcctgcgggccaagtatgctgctgccactggaggccccccacccacccccctgcccggcctggagaggatgagcctgcggacccggctggccctgctggatgcccctgagaggaccctgcctgctggctgcccccggcccctgggcccccggcggggcagtgatggccccacctacggccacggccatgctggagctgccccagccttcccccatgaggcccctgggggcggggcccggcgggccagtgaccctgtgcggcggccagatgccctgagcctgccccgggtgcagcgcttccacagcacccacaacgtgaaccctggccccctgcccccctgtgccgaccggcggggcctgcggctgcagagccaccccagcacagatggcggcctggcccggggggcctacagcccccggccccccagcatcagtgaaaatgtggccatggaggccgtggccgccggcgtggatggagctggccctgaggccgacctgggcctgcctgaagatgacctggtgctgcctgatgatgtggtgcagtacatcaaggcccacgccagcggggccctggatgagggcaccggccaggtgtaccccacagagagcacaggcttcagtgacaacccccggctgcccagccctggcctgcacggccagaggaggatggtggccgctgacagcaatgtgggccccagcgcccccatgctgggcggctgccagctgggctttggagcccccagcagcctgaacaagaacaacatgcctgtgcagtggaatgaggtgtcctctggaacagtggatgccctggccagccaggtgaagcccccacccttcccccagggcaacctggccgtggtgcagcagaagccagccttcggccagtacccaggctacagcccccagggcctgcaggccagccctgggggcctggacagcacccagccccacctgcagcccaggtctggggcccccagccagggcatcccccgggtgaactacatgcagcagctgcggcagcctgtggccggcagccagtgccccggcatgaccaccaccatgagcccccacgcctgctacggccaggtgcacccccagctgagccccagcaccatcagcggggccctgaaccagttcccccagagctgcagcaacatgcctgccaagccaggccacctgggccacccccagcagacagaggtggccccagaccccaccaccatgggcaacagacaccgggagctgggcgtgcctgattctgccctggccggcgtgcccccaccccaccctgtgcagagctacccccagcagagccaccacctggccgcctccatgagccaggagggctaccaccaggtgcccagcctgctgcctgcccggcagcccggcttcatggagccccagacaggccccatgggcgtggccacagctggcttcggcctggtgcagcccaggcctcccctggagcccagccccaccggccgccacagaggagtgcgggctgtgcagcagcagctggcctatgcccgggccactggacatgccatggccgccatgcccagcagccaggagacagctgaggccgtgcccaagggggccatgggcaacatgggctctgtgcccccccagcccccaccccaggatgctgggggcgccccagaccacagcatgctgtactactacggccagatccacatgtatgagcaggacggcggcctggagaacctgggcagctgccaggtgatgaggagccagcccccccagccccaggcctgccaggacagcatccagccccagcccctgcccagccctggggtgaaccaggtgagcagcacagtggacagccagctgctggaggccccccagattgactttgatgccatcatggatgatggagaccacagcagcctcttcagcggggccctgagccccagcctgctgcacagcctgagccagaacagcagccggctgaccacccccaggaacagcctgaccctgcccagcatcccagctggcatcagcaacatggctgtgggggacatgagctccatgctgaccagcctggccgaggagagcaagttcctgaacatgatgacctag

SEQ ID NO: 153761 - DNA, 249 bp, Artificial Sequence
  Description of Artificial Sequence: Synthetic coding sequence
atggagaccagcgccagcgccacagccagcgagaagcaggaggccaagagcggcatcctggaggccgccggcttcccagaccccgggaagaaggccagccccctggtggtggccgctgctgctgctgctgctgtggccgcccagggcgtgccccagcacctgctgccccccttccacgcccccctgcccatcgacatgaggcaccaggagggccgctaccactatgagccccacagcgtgcatggatag

SEQ ID NO: 153762 - DNA, 660 bp, Artificial Sequence
  Description of Artificial Sequence: Synthetic coding sequence
atggagaccagcgccagcgccacagccagcgagaagcaggaggccaagagcggcatcctggaggccgccggcttcccagaccccgggaagaaggccagccccctggtggtggccgctgctgctgctgctgctgtggccgcccagggcgtgccccagcacctgctgccccccttccacgcccccctgcccatcgacatgaggcaccaggagggccgctaccactatgagccccacagcgtgcatggagtgcacggcgtgcccttcctgcagcctgctggagatgcccctcctgagccccaggccggggctgtgcacctgcccaccctgcggcggcagcccggccctgctgctgatgacccccacctgacccagctggccagcggcctgcaccagcagctgcccaagcagctgggcggccagcgcttcctgcgggcctctgtgtctggctgcccccagcccagcctgcacctgcccccaccccaccagccccggggcctgcctgctgacagcgagcctgctgagggcagcggcgtgtccctgtggacccacaccaccccagaccctgccctgacccacctgcccggccctgctgcccacggcccccacctgcaccagtgccacgcccacccagcccagcagcagcagcagctgtctgagtag

SEQ ID NO: 153763 - DNA, 4761 bp, Artificial Sequence; identical to SEQ ID NO: 153760
  Description of Artificial Sequence: Synthetic coding sequence

SEQ ID NO: 153764 - DNA, 4743 bp, Artificial Sequence
  Description of Artificial Sequence: Synthetic coding sequence
atggaggcccagagccacagcagcaccaccacagagaagaagaaggtggagaacagcatcgtgaagtgcagcaccaggacagatgtgtctgagaaggctgtggccagcagcaccaccagcaatgaagatgagagccctggccagacctaccaccgggagaggagaaatgccatcaccatgcagccccagaatgtgcagggcctgagcaaggtgtctgaggagcccagcaccagcagtgatgagcgggccagcctcatcaagaaggagatccacggcagcctgccccacgtggccgagcccagcgtgccctaccggggcaccgtgtttgccatggaccccagaaatggctacatggagccccactaccaccccccccacctgtttcctgccttccacccccctgtgcccattgatgcccggcaccacgagggccgctaccactatgaccccagccccatcccccccctgcacatgaccagcgccctgagcagcagccccacctacccagacctgcccttcatccgcatcagcccccacaggaaccccacagctgccagcgagagccccttcagccccccccacccctacatcaacccctacatggactacatccgcagcctgcacagcagccccagcctgtccatgatcagcgccacccggggcctgagccccacagatgcccctcatgctggggtgtccccagctgagtactaccaccagatggccctgctgaccggccagaggagcccctatgctgacatcatccccagcgctgccacagctggcactggagccatccacatggagtacctgcacgccatggacagcacccgcttcagcagcccccggctgagcgcccggcccagcaggaagaggaccctgagcatcagccccctgagtgaccacagctttgacctgcagaccatgatccgcaccagccccaacagcctggtgaccatcctgaacaacagccgcagcagcagcagcgccagcggcagctatggccacctgagcgccagcgccatcagccctgccctgtccttcacctacagcagcgcccctgtgtccctgcacatgcaccagcagatcctgagccggcagcagagcctgggcagcgccttcggccacagccccccactcatccacccagcccccaccttccccacccagaggcccatccctggcatccccaccgtgctgaaccctgtgcaggtgagcagcggccccagcgagagcagccagaacaagcccaccagcgagagcgctgtgagcagcactggagaccccatgcacaacaagaggagcaagatcaagccagatgaggacctgcccagccctggggcccggggccagcaggagcagcctgagggcaccaccctggtgaaggaggagggggacaaggatgagagcaagcaggagcctgaggtgatctatgagaccaactgccactgggagggctgtgcccgggagtttgacacccaggagcagctggtgcaccacatcaacaatgaccacatccatggagagaagaaggagtttgtgtgccgctggctggactgcagccgggagcagaagcccttcaaggcccagtacatgctggtggtgcacatgaggaggcacactggagagaagccccacaagtgcacctttgagggctgcaccaaggcctacagccggctggagaacctgaagacccacctgcggagccacactggagagaagccctacgtgtgtgagcacgagggctgcaacaaggccttcagcaatgccagtgaccgggccaagcaccagaacagaacccacagcaatgagaagccctacgtgtgcaagatccctggctgcaccaagcgctacacagaccccagcagcctgaggaagcacgtgaagacagtgcacggccctgaggcccacgtgaccaagaagcagagaggagacatccacccccggcccccaccaccccgggacagcggcagccacagccagagccgcagccctggccggcccacccagggcgccctgggggagcagcaggacctgagcaacaccaccagcaagcgggaggagtgcctgcaggtgaagacagtgaaggccgagaagcccatgaccagccagcccagccctgggggccagagcagctgcagcagccagcagagccccatcagcaactacagcaacagcggcctggagctgcccctgacagatggcggcagcatcggggacctgagcgccattgatgagacccccatcatggacagcaccatcagcacagccaccacagccctggccctgcaggccaggagaaatcctgctggcaccaagtggatggagcacgtgaagctggagcggctgaagcaggtgaatggcatgttcccccggctgaaccccatcctgccccccaaggccccagctgtgagccccctgattggaaatggcacccagagcaacaacacctgcagcctgggcggccccatgaccctgctgcccggccgcagtgacctgagcggcgtggatgtgaccatgctgaacatgctgaacagaagagacagcagcgccagcaccatcagcagcgcctacctgagcagccgccgcagcagcggcatcagcccctgcttcagcagccgccgcagcagcgaggccagccaggccgagggccggccccagaatgtgtctgtggccgacagctatgaccccatcagcacagatgccagccgccgcagcagcgaggccagccagagtgatggcctgcccagcctgctgagcctgaccccagcccagcagtaccgcctgaaggccaagtatgctgctgccactggaggccccccacccacccccctgcccaacatggagaggatgagcctgaagacccggctggccctgctgggagatgccctggagcccggggtggccctgccccctgtgcacgccccccggcgctgcagtgatggaggagcccacggctatggaagaagacacctgcagccccatgatgcccctggccacggcgtgagaagagccagtgaccctgtgaggactggaagtgagggcctggccctgccccgggtgccccgcttcagcagcctgagcagctgcaaccccccagccatggccaccagcgctgagaagaggagcctggtgctgcagaactacaccaggcctgagggcggccagagcaggaacttccacagcagcccctgcccccccagcatcacagaaaatgtgaccctggagagcctgaccatggatgctgatgccaacctgaatgatgaggacttcctgcctgatgatgtggtgcagtacctgaacagccagaaccaggccggctatgagcagcacttccccagcgccctgcctgatgacagcaaggtgccccacggccctggggactttgatgcccctggcctgcctgacagccatgctggccagcagttccacgccctggagcagccctgcccagagggcagcaagacagacctgcccatccagtggaatgaggtgagcagcggcagcgctgacctgagcagcagcaagctgaagtgtggccccaggcctgctgtgccccagacccgggccttcggcttctgcaatggcatggtggtgcacccccagaaccccctgcggagcggccctgctgggggctaccagaccctgggggagaacagcaacccctatggaggccctgagcacctgatgctgcacaacagccctggcagcggcaccagcggaaatgccttccacgagcagccctgcaaggccccccagtatggcaactgcctgaaccggcagcctgtggcccctggggccctggatggagcctgtggggccggcatccaggccagcaagctgaagagcacccccatgcagggcagcggcggccagctgaactttggcctgcctgtggccccaaatgaatctgctggctccatggtgaatggcatgcagaaccaggaccctgtgggccagggctacctggcccaccagctgctgggggacagcatgcagcaccctggagctggccggcccggccagcagatgctgggccagatcagcgccaccagccacatcaacatctaccagggccctgagagctgcctgcccggggcccacggcatgggcagccagcccagcagcctggccgtggtgcggggctaccagccctgtgccagctttggaggcagccggcggcaggccatgccccgggacagcctggccctgcagagcggccagctgagtgacaccagccagacctgccgggtgaatggcatcaagatggagatgaagggccagccccaccccctgtgcagcaacctgcagaactacagcggccagttctatgaccagacagtgggcttcagccagcaggacaccaaggccggcagcttcagcatcagtgatgccagctgcctgctgcagggcaccagcgccaagaacagcgagctgctgagccctggggccaaccaggtgaccagcacagtggacagcctggacagccatgacctggagggcgtgcagattgactttgatgccatcattgatgatggagaccacagcagcctgatgtctggggccctgagccccagcatcatccagaacctgagccacagcagcagccggctgaccaccccccgggccagcctgcccttccctgccctgtccatgagcaccaccaacatggccatcggggacatgagcagcctgctgaccagcctggccgaggagagcaagttcctggccgtgatgcagtag

SEQ ID NO: 153765 - DNA, 543 bp, Artificial Sequence
  Description of Artificial Sequence: Synthetic coding sequence
atggaggcccagagccacagcagcaccaccacagagaagaagaaggtggagaacagcatcgtgaagtgcagcaccaggacagatgtgtctgagaaggctgtggccagcagcaccaccagcaatgaagatgagagccctggccagacctaccaccgggagaggagaaatgccatcaccatgcagccccagaatgtgcagggcctgagcaaggtgtctgaggagcccagcaccagcagtgatgagcgggccagcctcatcaagaaggagatccacggcagcctgccccacgtggccgagcccagcgtgccctaccggggcaccgtgtttgccatggaccccagaaatggctacatggagccccactaccaccccccccacctgtttcctgccttccacccccctgtgcccattgatgcccggcaccacgagggccgctaccactatgaccccagccccatcccccccctgcacatgaccagcgccctgagcagcagccccacctacccagacctgcccttcatccgcatcagcccccacaggtag

SEQ ID NO: 153766 - DNA, 1131 bp, Artificial Sequence
  Description of Artificial Sequence: Synthetic coding sequence
atggccgccctgggggacatccaggagagccccagcgtgcccagccctgtgtccctgagcagccctggcaccccaggcacccagcaccacgagccccagctgcacctgcacggccaccagcacggcagccctggcagcagccccaaggtgctgagccagcccagcgacctggacctgcaggatgtggaggaggtggagatcggccgggacaccttctggccagacagcgagcccaagccagagcaggcccccaggagccctggcagccaggccccagatgaaggagctgggggcgccctgcggagcctgctgcggagcctgccccggcgggcccgctgcagcgctggctttggacctgagagcagcgctgagaggcctgctggccagcccccaggagctgtgccctgtgcccagcccaggggggcctggagggtgaccctggtgcagcaggccgctgctggccctgagggcgcccctgagagagctgctgagctgggcgtgaactttggccgcagccggcagggcagcgcccggggggccaagccccaccgctgtgaggcctgtgggaagagcttcaagtacaacagcctgctgctgaagcaccagaggatccacactggagagaagccctatgcctgccatgaatgtgggaagcgcttccggggctggagcggcttcatccagcaccaccgcatccacactggagagaagccctatgaatgtggccagtgtggccgggccttcagccacagcagccacttcacccagcacctgcgcatccacaacggggagaagccctacaagtgtggagaatgtggccaggccttcagccagagcagcaacctggtgcgccaccagaggctgcacactggagagaagccctatgcctgcagccagtgtgggaaggccttcatctggagctctgtgctgattgagcaccagaggatccacactggagagaagccctatgagtgcagcgactgtgggaaggccttccggggccgcagccacttcttccgccacctgcggacccacactggagagaagccctttgcctgtggggcctgtgggaaggccttcggccagagcagccagctgatccagcaccagagggtgcactaccgggagtag

SEQ ID NO: 153767 - DNA, 1131 bp, Artificial Sequence; identical to SEQ ID NO: 153766
  Description of Artificial Sequence: Synthetic coding sequence

SEQ ID NO: 153768 - DNA, 801 bp, Artificial Sequence
  Description of Artificial Sequence: Synthetic coding sequence
atgagggtgaccctggccaccatcgcctggatggtgtcctttgtgagcaactacagccacacagccaacatcctgcctgacattgaaaatgaagacttcatcaaggactgtgtgcgcatccacaacaagttccgctctgaggtgaagcccacagccagtgacatgctgtacatgacctgggaccctgccctggcccagatcgccaaggcctgggccagcaactgccagttcagccacaacacccggctgaagccaccccacaagctgcaccccaacttcaccagcctgggggagaacatctggacaggctctgtgcccatcttctctgtgagcagcgccatcaccaactggtatgatgagatccaggactatgacttcaagacccgcatctgcaagaaggtgtgtggccactacacccaggtggtgtgggccgacagctacaaggtgggctgtgctgtgcagttctgccccaaggtgtctggctttgatgccctgagcaatggagcccacttcatctgcaactacggccctgggggcaactaccccacctggccctacaagagaggagccacctgcagcgcctgccccaacaatgacaagtgcctggacaacctgtgtgtgaaccggcagagggaccaggtgaagcgctactacagcgtggtgtacccaggctggcccatctaccccaggaaccgctacaccagcctcttcctgattgtgaacagcgtcatcctgatcctgagcgtcatcatcaccatcctggtgcagcacaagtaccccaacctggtgctgctggactag

SEQ ID NO: 153769 - DNA, 429 bp, Artificial Sequence
  Description of Artificial Sequence: Synthetic coding sequence
atgtctgacagcctggtggtgtgtgaggtggaccctgagctgacagagaagctgaggaagttccgcttcaggaaggagacagacaatgctgccatcatcatgaaggtggacaaggaccggcagatggtggtgctggaggaggagttccagaacatcagccctgaggagctgaagatggagctgcctgagcggcagcccaggtttgtggtgtacagctacaagtatgtgcatgatgatggccgggtgtcctaccccctgtgcttcatcttcagcagccctgtgggctgcaagccagagcagcagatgatgtatgccggcagcaagaaccggctggtgcagacagctgagctgaccaaggtgtttgagatccgcaccacagatgacctgacagaggcctggctgcaggagaagctgtccttcttcagatag

SEQ ID NO: 153770 - DNA, 429 bp, Artificial Sequence; identical to SEQ ID NO: 153769
  Description of Artificial Sequence: Synthetic coding sequence

SEQ ID NO: 153771 - DNA, 1299 bp, Artificial Sequence
  Description of Artificial Sequence: Synthetic coding sequence
atggagcggcggcgcatcaccagcgctgcccggcgctcctatgtgtcctctggagagatgatggtgggcggcctggcccctggaagaaggctgggccctggcacccggctgagcctggccaggatgcccccacccctgcccaccagggtggacttcagcctggccggggccctgaatgccggcttcaaggagacccgggccagcgagagagctgagatgatggagctgaatgacagatttgccagctacatcgagaaggtgcgcttcctggagcagcagaacaaggccctggccgctgagctgaaccagctgcgggccaaggagcccaccaagctggctgatgtgtaccaggccgagctgcgggagctgcggctgcggctggaccagctgacagccaacagcgcccggctggaggtggagcgggacaacctggcccaggacctggccaccgtgcggcagaagctgcaggatgagaccaacctgcggctggaggccgagaacaacctggccgcctaccggcaggaggctgatgaggccaccctggcccggctggacctggagaggaagattgagagcctggaggaggagatccgcttcctgaggaagatccacgaggaggaggtgcgggagctgcaggagcagctggcccggcagcaggtgcacgtggagctggatgtggccaagccagacctgacagctgccctgaaggagatccgcacccagtatgaggccatggccagcagcaacatgcatgaagctgaggagtggtaccgcagcaagtttgctgacctgacagatgctgctgccagaaatgctgagctgctgcggcaggccaagcatgaggccaatgactaccgccggcagctgcagagcctgacctgtgacctggagagcctgcggggcaccaatgaaagcctggagcggcagatgagggagcaggaggagagacatgtgcgggaggccgccagctaccaggaggccctggcccggctggaggaggagggccagagcctgaaggatgagatggcccggcacctgcaggagtaccaggacctgctgaatgtgaagctggccctggacattgaaattgccacctacaggaagctgctggagggggaggagaaccgcatcaccatccctgtgcagaccttcagcaacctgcagatccgggagaccagcctggacaccaagtctgtgtctgagggccacctgaagaggaacatcgtggtgaagacagtggagatgagagatggagaggtgatcaaggagagcaagcaggagcacaaggatgtgatgtag

SEQ ID NO: 153772 - DNA, 540 bp, Artificial Sequence
  Description of Artificial Sequence: Synthetic coding sequence
atggagcggcggcgcatcaccagcgctgcccggcgctcctatgtgtcctctggagagatgatggtgggcggcctggcccctggaagaaggctgggccctggcacccggctgagcctggccaggatgcccccacccctgcccaccagggtggacttcagcctggccggggccctgaatgccggcttcaaggagacccgggccagcgagagagctgagatgatggagctgaatgacagatttgccagctacatcgagaaggtgcgcttcctggagcagcagaacaaggccctggccgctgagctgaaccagctgcgggccaaggagcccaccaagctggctgatgtgtaccaggccgagctgcgggagctgcggctgcggctggaccagctgacagccaacagcgcccggctggaggtggagcgggacaacctggcccaggacctggccaccgtgcggcagaagaagcagatgaagccaccctggcctgtgtggatctggaggggccgcctgagccgctggaggagaagaagtggcagctag

SEQ ID NO: 153773 - DNA, 1224 bp, Artificial Sequence
  Description of Artificial Sequence: Synthetic coding sequence
atggagcggcggcgcatcaccagcgccacccggctgagcctggccaggatgcccccacccctgcccaccagggtggacttcagcctggccggggccctgaatgccggcttcaaggagacccgggccagcgagcgggcagagatgatggagctgaatgacagatttgccagctacatcgagaaggtgcgcttcctggagcagcagaacaaggccctggccgctgagctgaaccagctgcgggccaaggagcccaccaagctggctgatgtgtaccaggccgagctgcgggagctgcggctgcggctggaccagctgacagccaacagcgcccggctggaggtggagcgggacaacctggcccaggacctggccaccgtgcggcagaagctgcaggatgagaccaacctgcggctggaggccgagaacaacctggccgcctaccggcaggaggctgatgaggccaccctggcccggctggacctggagaggaagattgagagcctggaggaggagatccgcttcctgaggaagatccacgaggaggaggtgcgggagctgcaggagcagctggcccggcagcaggtgcacgtggagctggatgtggccaagccagacctgacagctgccctgaaggagatccgcacccagtatgaggccatggccagcagcaacatgcatgaggccgaggagtggtaccgcagcaagtttgctgacctgacagatgctgctgccagaaatgctgagctgctgcggcaggccaagcatgaggccaatgactaccgccggcagctgcagagcctgacctgtgacctggagagcctgcggggcaccaatgaaagcctggagcggcagatgagggagcaggaggagcggcacgtgcgggaggccgccagctaccaggaggccctggcccggctggaggaggagggccagagcctgaaggatgagatggcccggcacctgcaggagtaccaggacctgctgaatgtgaagctggccctggacatcgagatcgccacctacaggaagctgctggagggggaggagaaccgcatcaccatccctgtgcagaccttcagcaacctgcagatccgggagaccagcctggacaccaagtctgtgtctgagggccacctgaagagaaatattgtggtgaagacagtggagatgagagatggagaggtgatcaaggagagcaagcaggagcacaaggatgtgatgtag

SEQ ID NO: 153774 - DNA, 1296 bp, Artificial Sequence
  Description of Artificial Sequence: Synthetic coding sequence
atggagcggcggcgcatcaccagcgctgcccggcgctcctatgtgtcctctggagagatgatggtgggcggcctggcccctggaagaaggctgggccctggcacccggctgagcctggccaggatgcccccacccctgcccaccagggtggacttcagcctggccggggccctgaatgccggcttcaaggagacccgggccagcgagagagctgagatgatggagctgaatgacagatttgccagctacatcgagaaggtgcgcttcctggagcagcagaacaaggccctggccgctgagctgaaccagctgcgggccaaggagcccaccaagctggctgatgtgtaccaggccgagctgcgggagctgcggctgcggctggaccagctgacagccaacagcgcccggctggaggtggagcgggacaacctggcccaggacctggccaccgtgcggcagaagctgcaggatgagaccaacctgcggctggaggccgagaacaacctggccgcctaccggcaggaggctgatgaggccaccctggcccggctggacctggagaggaagattgagagcctggaggaggagatccgcttcctgaggaagatccacgaggaggaggtgcgggagctgcaggagcagctggcccggcagcaggtgcacgtggagctggatgtggccaagccagacctgacagctgccctgaaggagatccgcacccagtatgaggccatggccagcagcaacatgcatgaagctgaggagtggtaccgcagcaagtttgctgacctgacagatgctgctgccagaaatgctgagctgctgcggcaggccaagcatgaggccaatgactaccgccggcagctgcagagcctgacctgtgacctggagagcctgcggggcaccaatgaaagcctggagcggcagatgagggagcaggaggagagacatgtgcgggaggccgccagctaccaggaggccctggcccggctggaggaggagggccagagcctgaaggatgagatggcccggcacctgcaggagtaccaggacctgctgaatgtgaagctggccctggacattgaaattgccacctacaggaagctgctggagggggaggagaaccgcatcaccatccctgtgcagaccttcagcaacctgcagatccggggcggcaagagcaccaaggatggagagaaccacaaggtgacccgctacctgaagagcctgaccatccgggtcatccccatccaggcccaccagatcgtgaatggcaccccaccagcccggggctag

SEQ ID NO: 153775 - DNA, 1317 bp, Artificial Sequence
  Description of Artificial Sequence: Synthetic coding sequence
atggagcggcggcgcatcaccagcgctgcccggcgctcctatgtgtcctctggagagatgatggtgggcggcctggcccctggaagaaggctgggccctggcacccggctgagcctggccaggatgcccccacccctgcccaccagggtggacttcagcctggccggggccctgaatgccggcttcaaggagacccgggccagcgagagagctgagatgatggagctgaatgacagatttgccagctacatcgagaaggtgcgcttcctggagcagcagaacaaggccctggccgctgagctgaaccagctgcgggccaaggagcccaccaagctggctgatgtgtaccaggccgagctgcgggagctgcggctgcggctggaccagctgacagccaacagcgcccggctggaggtggagcgggacaacctggcccaggacctggccaccgtgcggcagaagctgcaggatgagaccaacctgcggctggaggccgagaacaacctggccgcctaccggcaggaggctgatgaggccaccctggcccggctggacctggagaggaagattgagagcctggaggaggagatccgcttcctgaggaagatccacgaggaggaggtgcgggagctgcaggagcagctggcccggcagcaggtgcacgtggagctggatgtggccaagccagacctgacagctgccctgaaggagatccgcacccagtatgaggccatggccagcagcaacatgcatgaagctgaggagtggtaccgcagcaagtttgctgacctgacagatgctgctgccagaaatgctgagctgctgcggcaggccaagcatgaggccaatgactaccgccggcagctgcagagcctgacctgtgacctggagagcctgcggggcaccaatgaaagcctggagcggcagatgagggagcaggaggagagacatgtgcgggaggccgccagctaccaggaggccctggcccggctggaggaggagggccagagcctgaaggatgagatggcccggcacctgcaggagtaccaggacctgctgaatgtgaagctggccctggacattgaaattgccacctacaggaagctgctggagggggaggagaaccgcatcaccatccctgtgcagaccttcagcaacctgcagatccggggccagtacagccgggcctcctgggagggccactggagccctgcccccagcagccgggcctgccgcctgctgcagacaggaacagaggaccagggcaagggcatccagctgagcctgggcgcctttgtgaccctgcagaggagctag

SEQ ID NO: 153776 - DNA, 861 bp, Artificial Sequence
  Description of Artificial Sequence: Synthetic coding sequence
atggccgcccgggtgctgcgggcccggggagctgcctgggccggcggcctgctgcagagagctgccccctgcagcctgctgccccggctgcggacctggaccagcagcagcaacagaagccgggaggacagctggctgaagagcctgtttgtgaggaaggtggaccccaggaaggatgcccacagcaacctgctggccaagaaggagaccagcaacctgtacaagctgcagttccacaacgtgaagccagagtgcctggaggcctacaacaagatctgccaggaggtgctgcccaagatccacgaggacaagcactacccctgcaccctggtgggcacctggaacacctggtacggggagcaggaccaggccgtgcacctgtggaggtatgagggcggctacccagccctgacagaggtgatgaacaagctgcgggagaacaaggagttcctggagttcaggaaggcccggagtgacatgctgctgagcaggaagaaccagctgctgctggagttctccttctggaatgaacctgtgcccaggagcggccccaacatctatgagctgcggagctaccagctgcggcccggcaccatgattgagtggggcaactactgggcccgggccatccgcttccggcaggatggaaatgaagctgtgggcggcttcttcagccagatcggccagctgtacatggtgcaccacctgtgggcctacagagacctgcagacccgggaggacatcagaaatgctgcctggcacaagcacggctgggaggagctggtgtactacacagtgcccctcatccaggagatggagagccgcatcatgatccccctgaagaccagccccctgcagtag

SEQ ID NO: 153777 - DNA, 744 bp, Artificial Sequence
  Description of Artificial Sequence: Synthetic coding sequence
atggccgcccgggtgctgcgggcccggggagctgcctgggccggcggcctgctgcagagagctgccccctgcagcctgctgccccggctgcggacctggaccagcagcagcaacagaagccgggaggacagctggctgaagagcctgtttgtgaggaaggtggaccccaggaaggatgcccacagcaacctgctggccaagaaggagaccagcaacctgtacaagctgcagttcaagcgctgctgccagcgcttcaccaagatcaacaccaccctggtgctgtggtggggcctgggcacccggggcatggccagcaggaccaagctggagttcctggagttcaggaaggcccggagtgacatgctgctgagcaggaagaaccagctgctgctggagttctccttctggaatgaacctgtgcccaggagcggccccaacatctatgagctgcggagctaccagctgcggcccggcaccatgattgagtggggcaactactgggcccgggccatccgcttccggcaggatggaaatgaggccgtgggcggcttcttcagccagatcggccagctgtacatggtgcaccacctgtgggcctacagagacctgcagacccgggaggacatcagaaatgctgcctggcacaagcacggctgggaggagctggtgtactacacagtgcccctcatccaggagatggagagccgcatcatgatccccctgaagaccagccccctgcagtag

SEQ ID NO: 153778 - DNA, 4683 bp, Artificial Sequence
  Description of Artificial Sequence: Synthetic coding sequence
atggatgatgaagatggccgctgcctgctggatgtgatctgtgacccccaggccctgaatgacttcctgcacggcagcgagaagctggacagtgatgacctgctggacaaccctggagaggcccagagcgccttctatgagggccctggcctgcacgtgcaggaggccagcggcaaccacctgaaccctgagcccaaccagcctgcccccagcgtggacctggacttcctggaggatgacatcctgggcagccctgccactggaggcggcggcggcggcagcggcggcgctgaccagccctgtgacatcctgcagcagagcctgcaggaggccaacatcacagagcagaccctggaggccgaggccgagctggacctgggccccttccagctgcccaccctgcagcctgcagatggaggagctggccccaccggggccggcggcgctgctgctgtggccgccggcccccaggccctcttccctggcagcacagacctgctgggcctgcagggcccccccaccgtgctgacccaccaggccctggtgcccccccaggatgtggtgaacaaggccctgtctgtgcagcccttcctgcagcctgtgggcctgggcaatgtgaccctgcagcccatccctggcctgcagggcctgcccaacggcagccctgggggcgccacagctgccaccctgggcctggcccccatccaggtggtgggccagcctgtgatggccctgaacacccccaccagccagctgctggccaagcaggtgcctgtgtctggctacctggccagcgctgctggccccagcgagcctgtgaccctggccagcgctggggtgagcccccagggcgccggcctggtgatccagaagaacctgtctgctgctgtggccaccaccctgaatggaaattctgtgtttggaggagctggggccgccagcgcccccaccggcaccccatctggccagcccctggccgtggcccctggcctgggcagcagccccctggtgcctgccccaaatgtcatcctgcacaggacccccacccccatccagcccaagccagctggggtgctgccccccaagctgtaccagctgacccccaagccctttgccccagctggggccaccctgaccatccagggcgagcccggggccctgccccagcagcccaaggccccccagaacctgaccttcatggccgccggcaaggccggccagaatgtggtgctgagcggcttccctgccccagccctgcaggccaacgtgttcaagcagcccccagccaccaccaccggggccgccccaccccagcccccaggggccctgagcaagcccatgtctgtgcacctgctgaaccagggcagcagcatcgtcatcccagcccagcacatgctgcccggccagaaccagttcctgctgcccggggccccagctgtgcagctgccccagcagctgagcgccctgcctgccaacgtgggcggccagatcctggccgctgctgccccccacactggaggccagctgattgccaaccccatcctgaccaaccagaacctggccggccccctgagcctgggccctgtgctggccccccacagcggggcccacagcgcccacatcctgtctgctgcccccatccaggtgggccagcctgccctcttccagatgcctgtgtccctggccgccggcagcctgcccacccagagccagcctgccccagctggccctgctgccaccaccgtgctgcagggcgtgaccctgcccccatctgctgtggccatgctgaacaccccagatggcctggtgcagcctgccaccccagctgctgccaccggggaggccgcccctgtgctgactgtgcagcctgccccccaggcccccccagctgtgtccacccccctgcccctgggcctgcagcagccccaggcccagcagcccccccaggcccccaccccccaggccgccgccccaccccaggccaccaccccccagcccagccctggcctggccagcagccctgagaagatcgtgctgggccagccccccagcgccacccccacagccatcctgacccaggacagcctgcagatgttcctgccccaggagaggagccagcagcccctgtctgctgagggcccccacctgtctgtgcctgcctctgtgattgtgtctgcccctcctccagcccaggaccctgccccagccacccctgtggccaagggagctggcctgggcccccaggccccagacagccaggccagccctgccccagccccccagatcccagctgctgcccccctgaagggccctggccccagcagcagccccagcctgccccaccaggcccccctgggggacagcccccacctgcccagcccccaccccaccaggcctcccagcaggcctcccagccggccccagagcgtgtccaggcctccttctgagccccccctgcacccctgccccccaccccaggccccacccaccctgcccggcatctttgtgatccagaaccagctgggcgtgcccccaccagccagcaacccagcccccacagcccctggccccccccagccccccctgcggccccagagccagcccccagagggccccctgcccccagccccccacctgccccccagcagcaccagcagcgctgtggccagcagcagcgagaccagcagccggctgcctgcccccacccccagcgacttccagctgcagtttcctcccagccagggcccccacaagagccccaccccaccacccaccctgcacctggtgcctgagcctgctgcccctcctcctcctccacccaggaccttccagatggtgaccacccccttccctgccctgccccagcccaaggccctgctggagcgcttccaccaggtgcccagcggcatcatcctgcagaacaaggccggcggggccccagctgccccccagaccagcaccagcctgggccccctgaccagccctgctgcctctgtgctggtgtctggccaggcccccagcggcacccccacagcccccagccacgccccagccccagcccccatggccgccaccggcctgccccccctgctgcctgctgagaacaaggcctttgccagcaacctgcccaccctgaatgtggccaaggccgccagcagcggccctgggaagcccagcggcctgcagtatgagagcaagctgagcggcctgaagaagccacccaccctgcagcccagcaaggaggcctgcttcctggagcacctgcacaagcaccagggctctgtgctgcacccagactacaagacagccttccccagctttgaagatgccctgcaccggctgctgccctaccacgtgtaccagggcgccctgcccagccccagcgactaccacaaggtggatgaggagtttgaaacagtgtccacccagctgctgaagaggacccaggccatgctgaacaagtaccgcctgctgctgctggaggagagccggcgggtgagccccagcgctgagatggtgatgattgacaggatgttcatccaggaggagaagaccaccctggccctggacaagcagctggccaaggagaagccagatgaatatgtgagcagcagccgcagcctgggcctgcccatcgccgccagcagcgagggccaccggctgcccggccacggccccctgagcagcagcgcccctggggccagcacccagcccccaccccacctgcccaccaagctggtgatccgccacggcggggccggcggcagccccagcgtgacctgggcccgggccagcagcagcctgagcagcagcagcagcagcagcagcgctgccagcagcctggatgctgatgaagatggccccatgcccagcaggaacagaccacccatcaagacctatgaggcccggagccgcatcggcctgaagctgaagatcaagcaggaggccggcctgagcaaggtggtgcacaacacagccctggaccctgtgcaccagcccccacctcctccagccaccctgaaggtggccgagcccccacccaggcctcctcctcctcctccacccaccggccagatgaatggcaccgtggaccaccccccacctgctgcccctgagaggaagcccctgggcacagccccccactgcccccggctgcccctgaggaagacctacagagaaaatgtgggcggccctggggcccctgagggcaccccagctggccgggcccggggcggcagccctgcccccctgcctgccaaggtggatgaggccaccagcggcctcatccgggagctggccgctgtggaggatgagctgtaccagaggatgctgaagggccccccacctgagcctgctgccagcgctgcccagggcactggagaccctgactgggaggcccctggcctgcccccagccaagaggaggaagtctgagagcccagatgtggaccaggccagcttcagcagtgacagcccccaggatgacaccctgacagagcacctgcagagcgccatcgacagcatcctgaacctgcagcaggcccctggccgcaccccagcccccagctacccccacgccgccagcgctggcaccccagccagccccccacccctgcacaggcctgaggcctacccacccagcagccacaacggcggcctgggcgcccggaccctgaccaggtag

SEQ ID NO: 153779 - DNA, 1437 bp, Artificial Sequence
  Description of Artificial Sequence: Synthetic coding sequence
atggctgctgggggcagcggcgtgggcggcaagaggagcagcaagagtgatgctgacagcggcttcctgggcctgcggcccacctctgtggaccctgccctgcggaggagaagaagaggccccaggaacaagaagaggggctggaggcggctggcccaggagcccctgggcctggaggtggaccagttcctggaggatgtgcggctgcaggagaggaccagcggcggcctgctgtctgaggccccaaatgagaagctgttctttgtggacaccggcagcaaggagaagggcctgaccaagaagaggaccaaggtgcagaagaagagcctgctgctgaagaagcccctgcgggtggacctgatcctggagaacaccagcaaggtgcctgcccccaaggatgtgctggcccaccaggtgcccaatgccaagaagctgcggaggaaggagcagctgtgggagaagctggccaagcagggcgagctgccccgggaggtgcggcgggcccaggcccggctgctgaaccccagcgccacccgggccaagccaggcccccaggacacagtggagcggcccttctatgacctgtgggccagtgacaaccccctggaccggcccctggtgggccaggatgagttcttcctggagcagaccaagaagaagggcgtgaagaggcctgcccggctgcacaccaagcccagccaggccccagctgtggaggtggccccagctggggccagctacaaccccagctttgaggaccaccagaccctgctgtctgctgcccacgaggtggagctgcagaggcagaaggaggccgagaagctggagcggcagctggccctgcctgccacagagcaggccgccacccaggagagcaccttccaggagctgtgtgagggcctgctggaggagagtgatggagagggggagcccggccagggcgagggccctgaggccggagatgctgaggtgtgccccaccccagcccggctggccaccacagagaagaagacagagcagcagaggagaagagagaaggctgtgcaccggctgcgggtgcagcaggccgccctgcgggccgcccggctgcggcaccaggagctgttccggctgcggggcatcaaggcccaggtggccctgcggctggccgagctggcccggcggcagaggcggcggcaggcccggcgggaggccgaggccgacaagccccggcggctgggccgcctgaagtaccaggccccagacattgatgtgcagctgagcagcgagctgacagacagcctgcggaccctgaagccagagggcaacatcctgcgggaccgcttcaagagcttccagaggaggaacatgattgagccccgggagcgggccaagttcaagaggaagtacaaggtgaagctggtggagaagagggccttccgggagatccagctgtag

SEQ ID NO: 153780 - DNA, 1419 bp, Artificial Sequence
  Description of Artificial Sequence: Synthetic coding sequence
atggctgctgggggcagcggcgtgggcggcaagaggagcagcaagagtgatgctgacagcggcttcctgggcctgcggcccacctctgtggaccctgccctgcggaggagaagaagaggccccaggaacaagaagaggggctggaggcggctggcccaggagcccctgggcctggaggtggaccagttcctggaggatgtgcggctgcaggagaggaccagcggcggcctgctgtctgaggccccaaatgagaagctgttctttgtggacaccggcagcaaggagaagggcctgaccaagaagaggaccaaggtgcagaagaagagcctgctgctgaagaagcccctgcgggtggacctgatcctggagaacaccagcaaggtgcctgcccccaaggatgtgctggcccaccaggtgcccaatgccaagaagctgcggaggaaggagcagctgtgggagaagctggccaagcagggcgagctgccccgggaggtgcggcgggcccaggcccggctgctgaaccccagcgccacccgggccaagccaggcccccaggacacagtggagcggcccttctatgacctgtgggccagtgacaaccccctggaccggcccctggtgggccaggatgagttcttcctggagcagaccaagaagaagggcgtgaagaggcctgcccggctgcacaccaagcccagccaggccccagctgtggaggtggccccagctggggccagctacaaccccagctttgaggaccaccagaccctgctgtctgctgcccacgaggtggagctgcagaggcagaaggaggccgagaagctggagcggcagctggccctgcctgccacagagcaggccgccacccaggagagcaccttccaggagctgtgtgagggcctgctggaggagagtgatggagagggggagcccggccagggcgagggccctgaggccggagatgctgaggtgtgccccaccccagcccggcaccaccgggaggaggatggagctgctgctgcccggcggctgtgcaccggctgcggctacagccggccccgctgtggccccccaggcagcggcaccaggagctgcagcggctgtgccggcagccctgggggccctgaggccggcggggcccggcggcagaggcggcggcaggcccggcgggaggccgaggccgacaagccccggcggctgggccgcctgaagtaccaggccccagacattgatgtgcagctgagcagcgagctgacagacagcctgcggaccctgaagccagagggcaacatcctgcgggaccgcttcaagagcttccagaggaggaacatgattgagccccgggagcgggccaagttcaagaggaagtacaaggtgaagctggtggagaagagggccttccgggagatccagctgtag

SEQ ID NO: 153781 - DNA, 792 bp, Artificial Sequence
  Description of Artificial Sequence: Synthetic coding sequence
atggctgctgggggcagcggcgtgggcggcaagaggagcagcaagagtgatgctgacagcggcttcctgggcctgcggcccacctctgtggaccctgccctgcggaggagaagaagaggccccaggaacaagaagaggggctggaggcggctggcccaggagcccctgggcctggaggtggaccagttcctggaggatgtgcggctgcaggagaggaccagcggcggcctgctgtctgaggccccaaatgagaagctgttctttgtggacaccggcagcaaggagaagggcctgaccaagaagaggaccaaggtgcagaagaagagcctgctgctgaagaagcccctgcgggtggacctgatcctggagaacaccagcaaggtgcctgcccccaaggatgtgctggcccaccaggtgcccaatgccaagaagctgcggaggaaggagcagctgtgggccagtgacaaccccctggaccggcccctggtgggccaggatgagttcttcctggagcagaccaagaagaagggcgtgaagaggcgggaggccgaggccgacaagccccggcggctgggccgcctgaagtaccaggccccagacattgatgtgcagctgagcagcgagctgacagacagcctgcggaccctgaagccagagggcaacatcctgcgggaccgcttcaagagcttccagaggaggaacatgattgagccccgggagcgggccaagttcaagaggaagtacaaggtgaagctggtggagaagagggccttccgggagatccagctgtag

SEQ ID NO: 153782 - DNA, 1656 bp, Artificial Sequence
  Description of Artificial Sequence: Synthetic coding sequence
atggcccggggagctgagggcggcagaggagatgctggctggggcctgcggggggccctggccgctgtggccctgctgagcgccctgaatgctgctggcaccgtgtttgccctgtgccagtggaggggcctgagcagcgccctgcgggccctggaggcccagaggggccgggagcagagagaagattctgccctgcgctccttcctggccgagctgagccgggcccccaggggggccagcgccccaccccaggaccctgccagcagcgccaggaacaagaggagccacagcggggagcccgccccccacatccgggcagagagccatgacatgctgatgatgatgacctacagcatggtgcccatccgggtgatggtggacctgtgcaacagcaccaagggcatctgcctgaccggccccagcggccccccaggccccccaggagctgggggcctgcccggccacaacggcctggatggccagcccggcccccagggccccaagggggagaagggggccaacgggaagaggggcaagatgggcatccctggagctgctggcaaccctggagagcggggggagaagggggaccacggggagctgggcctgcagggcaatgaaggacctcctggccagaagggggagaagggggacaagggagatgtgtccaatgatgtgctgctggccggggccaagggggaccagggccccccaggccccccaggccccccaggccccccaggccccccaggccccccaggcagccggcgggccaagggcccccggcagcccagcatgttcaacggccagtgccctggagagacctgtgccatccccaatgatgacaccctggtgggcaaggcagatgagaaggccagcgagcaccacagcccccaggccgagagcatgatcaccagcatcggcaaccctgtgcaggtgctgaaggtgacagagaccttcggcacctggatccgggagagcgccaacaagagtgatgaccgcatctgggtgacagagcacttcagcggcatcatggtgaaggagttcaaggaccagcccagcctgctgaatggcagctacaccttcatccacctgccctactacttccacggctgcggccacgtggtgtacaacaacagcctgtactaccacaagggcggcagcaacaccctggtgcgctttgaatttggccaggagaccagccagaccctgaagctggagaatgccctgtactttgacaggaagtacctgtttgccaacagcaagacctacttcaacctggccgtggatgagaagggcctgtggatcatctatgccagctctgtggatggcagcagcatcctggtggcccagctggatgagaggaccttctctgtggtgcagcacgtgaacaccacctaccccaagagcaaggctggaaatgccttcatcgcccggggcatcctgtatgtgacagacaccaaggacatgagggtgacctttgcctttgacctgctgggcggcaagcagatcaatgccaactttgacctgcggaccagccagagcgtgctggccatgctggcctacaacatgagggaccagcacctgtacagctgggaggatggccacctgatgctgtaccctgtgcagttcctgagcaccaccctgaaccagtag

SEQ ID NO: 153783 - DNA, 1284 bp, Artificial Sequence
  Description of Artificial Sequence: Synthetic coding sequence
atggtggacctgtgcaacagcaccaagggcatctgcctgaccggccccagcggccccccaggccccccaggagctgggggcctgcccggccacaacggcctggatggccagcccggcccccagggccccaagggggagaagggggccaacgggaagaggggcaagatgggcatccctggagctgctggcaaccctggagagcggggggagaagggggaccacggggagctgggcctgcagggcaatgaaggacctcctggccagaagggggagaagggggacaagggagatgtgtccaatgatgtgctgctggccggggccaagggggaccagggccccccaggccccccaggccccccaggccccccaggccccccaggccccccaggcagccggcgggccaagggcccccggcagcccagcatgttcaacggccagtgccctggagagacctgtgccatccccaatgatgacaccctggtgggcaaggcagatgagaaggccagcgagcaccacagcccccaggccgagagcatgatcaccagcatcggcaaccctgtgcaggtgctgaaggtgacagagaccttcggcacctggatccgggagagcgccaacaagagtgatgaccgcatctgggtgacagagcacttcagcggcatcatggtgaaggagttcaaggaccagcccagcctgctgaatggcagctacaccttcatccacctgccctactacttccacggctgcggccacgtggtgtacaacaacagcctgtactaccacaagggcggcagcaacaccctggtgcgctttgaatttggccaggagaccagccagaccctgaagctggagaatgccctgtactttgacaggaagtacctgtttgccaacagcaagacctacttcaacctggccgtggatgagaagggcctgtggatcatctatgccagctctgtggatggcagcagcatcctggtggcccagctggatgagaggaccttctctgtggtgcagcacgtgaacaccacctaccccaagagcaaggctggaaatgccttcatcgcccggggcatcctgtatgtgacagacaccaaggacatgagggtgacctttgcctttgacctgctgggcggcaagcagatcaatgccaactttgacctgcggaccagccagagcgtgctggccatgctggcctacaacatgagggaccagcacctgtacagctgggaggatggccacctgatgctgtaccctgtgcagttcctgagcaccaccctgaaccagtag

SEQ ID NO: 153784 - DNA, 1284 bp, Artificial Sequence; identical to SEQ ID NO: 153783
  Description of Artificial Sequence: Synthetic coding sequence

SEQ ID NO: 153785 - DNA, 1575 bp, Artificial Sequence
  Description of Artificial Sequence: Synthetic coding sequence
atgcacagcctggatgagcccctggacctgaagctgagcatcaccaagctgcgggccgcccgggagaagcgggagaggaccctgggcgtggtgcggccccgggccctgcaccgggagctgggcctggtggatgacagccccaccccaggcagccctggcagccccccatctggcttcctgctgaacagcaagtttcctgagaaggtggagggccgcttctctgctgcccccctggtggacctgagcctgagccccccatctggcctggacagccccaacggcagcagcagcctgagccctgagcggcagggcaatggagacctgccccctgtgcccagcgccagtgacttccagcccctgcgctacctggatggagtgcccagcagcttccagttcttcctgcccctgggcagcggcggggccctgcacctgcctgccagcagcttcctgaccccacccaaggacaagtgcctgagcccagacctgcccctgcccaagcagctggtgtgccgctgggccaagtgcaaccagctgtttgagctgctgcaggacctggtggaccacgtgaatgactaccacgtgaagccagagaaggatgctggctactgctgccactgggagggctgtgcccggcacggccggggcttcaatgcccgctacaagatgctgatccacatccgcacccacaccaatgagaagccccaccgctgccccacctgcagcaagagcttcagccggctggagaacctgaagatccacaacagaagccacactggagagaagccctacgtgtgcccctatgagggctgcaacaagcgctacagcaacagcagtgaccgcttcaagcacaccaggacccactacgtggacaagccctactactgcaagatgcctggctgccacaagcgctacacagaccccagcagcctgaggaagcacatcaaggcccacggccactttgtgtcccatgagcagcaggagctgctgcagctgcggcccccacccaagccacccctgcctgccccagatggcggcccctacgtgtctggggcccagatcatcatccccaacccagctgccctgtttggaggccctggcctgcccggcctgcccctgcccctggcccctggccccctggacctgagcgccctggcctgtggaaatggaggcggcagcggcggcggcggcggcatgggccctggcctgcccggccctgtgctgcccctgaacctggccaagaaccccctgctgcccagcccctttggagctgggggcctgggcctgcctgtggtgtccctgctggccggggccgccggcggcaaggccgagggggagaagggccggggctctgtgcccacccgggccctgggcatggagggccacaagacccccctggagaggacagagagcagctgcagccggcccagcccagatggcctgcccctgctgcccggcaccgtgctggacctgagcactggagtgaacagcgctgccagcagccctgaggccctggcccctggctgggtggtgatccccccaggctctgtgctgctgaagccagctgtggtgaactag

SEQ ID NO: 153786 - DNA, 1575 bp, Artificial Sequence; identical to SEQ ID NO: 153785
  Description of Artificial Sequence: Synthetic coding sequence

SEQ ID NO: 153787 - DNA, 2328 bp, Artificial Sequence
  Description of Artificial Sequence: Synthetic coding sequence
atgatggtgcagaggctgggcctcatcagccccccagccagccaggtgtccacagcctgcaaccagatcagccccagcctgcagagggccatgaatgctgccaacctgaacatccccccaagtgacaccaggagcctcatcagccgggagagcctggccagcaccaccctgagcctgacagagagccagagcgccagctccatgaagcaggagtggagccagggctaccgggccctgcccagcctgagcaaccacggcagccagaatggcctggacctgggggacctgctgagcctgcccccaggcacctccatgagcagcaacagcgtgagcaacagcctgcccagctacctgtttggaacagagagcagccacagcccctaccccagccccaggcacagcagcaccaggagccacagcgcccggagcaagaagagggccctgagcctgagccccctgagtgatggcattggaattgacttcaacaccatcatccgcaccagccccaccagcctggtggcctacatcaatggcagccgggccagccctgccaacctgagcccccagcctgaggtgtatggccacttcctgggcgtgcggggcagctgcatcccccagcccaggcctgtgcccggcagccagaagggcgtgctggtggcccctgggggcctggccctgcctgcctatggagaagatggagccctggagcacgagaggatgcagcagctggagcacggcggcctgcagcccggcctggtgaaccacatggtggtgcagcacggcctgcccggccctgacagccagagcgctggcctcttcaagacagagcggctggaggagttccctggcagcacagtggacctgcccccagccccacccctgccccccctgcccccacctcctggccccccaccaccctaccacgcccacgcccacctgcaccaccctgagctgggcccccacgcccagcagctggccctgccccaggccaccctggatgatgatggagagatggatggcattggaggcaagcactgctgccgctggattgactgcagcgccctgtatgaccagcaggaggagctggtgcgccacatcgagaaggtgcacatcgaccagaggaaaggagaggacttcacctgcttctgggccggctgcccccggcgctacaagcccttcaatgcccgctacaagctgctgatccacatgagggtgcacagcggggagaagcccaacaagtgcacctttgagggctgtgagaaggccttcagccggctggagaacctgaagatccacctgcggagccacactggagagaagccctacctgtgccagcaccctggctgccagaaggccttcagcaacagcagtgaccgggccaagcaccagaggacccacctggacaccaagccctatgcctgccagatccctggctgcaccaagcgctacacagaccccagcagcctgaggaagcacgtgaaggcccacagcagcaaggagcagcaggccaggaagaagctgcggagcagcacagagctgcacccagacctgctgacagactgcctgactgtgcagagcctgcagcctgccaccagccccagagatgctgctgctgagggcaccgtgggccgcagccctggccctggccctgacctgtacagcgcccccatcttcagcagcaactacagcagccgcagcggcacagctgctggagctgtgcccccaccccaccctgtgagccaccccagccctggccacaacgtgcagggcagcccccacaaccccagcagccagctgccccccctgacagctgtggatgctggagctgagagatttgcccccagcgcccccagcccccaccacatcagccccaggagagtgcctgcccccagcagcatcctgcagaggacccagcccccctacacccagcagcccagcggcagccacctgaagagctaccagcctgagaccaacagcagcttccagcccaacggcatccacgtgcacggcttctacggccagctgcagaagttctgccccccccactacccagacagccagagaattgtgccccctgtgagcagctgcagcgtggtgcccagctttgaggactgcctggtgcccacctccatgggccaggccagctttgatgtgttccaccgggccttcagcacccacagcggcatcaccgtgtatgacctgcccagcagcagcagcagcctgtttggagagagcctgcggagcggggctgaagatgccaccttcctgcagatcagcacagtggaccgctgccccagccagctgagctctgtgtacacagagggctag

SEQ ID NO: 153788 - DNA, 2793 bp, Artificial Sequence
  Description of Artificial Sequence: Synthetic coding sequence
atgaatggccgcagctgcagcatgagcctgcacaggaccagcggcaccccccagggccccaggatggtgtctggccaccacatcccagccatccgggcccacagcggcaccccaggccccagcccctgtggcagcaccagcagccccaccatggccagcctggccaacaacctgcacctgaagatgcccagcggcggcggcatggccccccagaacaacgtggccgagagccgcatccacctgcctgccctgagcccccggcggcagatgctgaccaacgggaagccccgcttccaggtgacccaggccggcggcatgagcggcagccacaccctgaagcccaagcagcaggagtttggcagccccttcccccccaaccctggaaaaggagccctgggcttcggcccccagtgcaagagcatcggcaagggcagctgcaacaacctggtggtgaccagcagccccatgatggtgcagaggctgggcctcatcagccccccagccagccaggtgtccacagcctgcaaccagatcagccccagcctgcagagggccatgaatgctgccaacctgaacatcccccccagcgacaccaggagcctcatcagccgggagagcctggccagcaccaccctgagcctgacagagagccagagcgccagctccatgaagcaggagtggagccagggctaccgggccctgcccagcctgagcaaccacggcagccagaatggcctggacctgggggacctgctgagcctgcccccaggcacctccatgagcagcaacagcgtgagcaacagcctgcccagctacctgtttggaacagagagcagccacagcccctaccccagccccaggcacagcagcaccaggagccacagcgcccggagcaagaagagggccctgagcctgagccccctgagtgatggcatcggcatcgacttcaacaccatcatccgcaccagccccaccagcctggtggcctacatcaatggcagccgggccagccctgccaacctgagcccccagcctgaggtgtatggccacttcctgggcgtgcggggcagctgcatcccccagcccaggcctgtgcccggcagccagaagggcgtgctggtggcccctgggggcctggccctgcctgcctacggggaggatggagccctggagcacgagaggatgcagcagctggagcacggcggcctgcagcccggcctggtgaaccacatggtggtgcagcacggcctgcccggccctgacagccagagcgctggcctcttcaagacagagcggctggaggagttccctggcagcacagtggacctgcccccagccccacccctgccccccctgcccccacctcctggccccccaccaccctaccacgcccacgcccacctgcaccaccctgagctgggcccccacgcccagcagctggccctgccccaggccaccctggatgatgatggagagatggatggcatcggcggcaagcactgctgccgctggattgactgcagcgccctgtatgaccagcaggaggagctggtgcgccacatcgagaaggtgcacatcgaccagaggaagggggaggacttcacctgcttctgggccggctgcccccggcgctacaagcccttcaatgcccgctacaagctgctgatccacatgagggtgcacagcggggagaagcccaacaagtgcacctttgagggctgtgagaaggccttcagccggctggagaacctgaagatccacctgcggagccacactggagagaagccctacctgtgccagcaccctggctgccagaaggccttcagcaacagcagtgaccgggccaagcaccagaggacccacctggacaccaagccctatgcctgccagatccctggctgcaccaagcgctacacagaccccagcagcctgaggaagcacgtgaaggcccacagcagcaaggagcagcaggccaggaagaagctgcggagcagcacagagctgcacccagacctgctgacagactgcctgactgtgcagagcctgcagcctgccaccagccccagagatgctgctgctgagggcaccgtgggccgcagccctggccctggccctgacctgtacagcgcccccatcttcagcagcaactacagcagccgctctggaacagctgctggagctgtgcccccaccccaccctgtgagccaccccagccctggccacaacgtgcagggcagcccccacaaccccagcagccagctgccccccctgacagctgtggatgctggagctgagagatttgcccccagcgcccccagcccccaccacatcagcccccggcgggtgcctgcccccagcagcatcctgcagaggacccagcccccctacacccagcagcccagcggcagccacctgaagagctaccagcctgagaccaacagcagcttccagcccaacggcatccacgtgcacggcttctacggccagctgcagaagttctgccccccccactacccagacagccagagaattgtgccccctgtgagcagctgcagcgtggtgcccagctttgaggactgcctggtgcccacctccatgggccaggccagctttgatgtgttccaccgggccttcagcacccacagcggcatcaccgtgtatgacctgcccagcagcagcagcagcctgtttggagagagcctgcggtctggagcagaagatgccaccttcctgcagatcagcacagtggaccgctgccccagccagctgagctctgtgtacacagagggctag

SEQ ID NO: 153789 - DNA, 270 bp, Artificial Sequence
  Description of Artificial Sequence: Synthetic coding sequence
atgatggtgcagaggctgggcctcatcagccccccagccagccaggtgtccacagcctgcaaccagatcagccccagcctgcagagggccatgaatgctgccaacctgaacatccccccaagtgacaccaggagcctcatcagccgggagagcctggccagcaccaccctgagcctgacagagagccagagcgccagctccatgaagcaggagtggagccagggctaccgggccctgcccagcctgagcaaccacggcagccagaactag

SEQ ID NO: 153790 - DNA, 735 bp, Artificial Sequence
  Description of Artificial Sequence: Synthetic coding sequence
atgaatggccgcagctgcagcatgagcctgcacaggaccagcggcaccccccagggccccaggatggtgtctggccaccacatcccagccatccgggcccacagcggcaccccaggccccagcccctgtggcagcaccagcagccccaccatggccagcctggccaacaacctgcacctgaagatgcccagcggcggcggcatggccccccagaacaacgtggccgagagccgcatccacctgcctgccctgagcccccggcggcagatgctgaccaacgggaagccccgcttccaggtgacccaggccggcggcatgagcggcagccacaccctgaagcccaagcagcaggagtttggcagccccttcccccccaaccctggaaaaggagccctgggcttcggcccccagtgcaagagcatcggcaagggcagctgcaacaacctggtggtgaccagcagccccatgatggtgcagaggctgggcctcatcagccccccagccagccaggtgtccacagcctgcaaccagatcagccccagcctgcagagggccatgaatgctgccaacctgaacatcccccccagcgacaccaggagcctcatcagccgggagagcctggccagcaccaccctgagcctgacagagagccagagcgccagctccatgaagcaggagtggagccagggctaccgggccctgcccagcctgagcaaccacggcagccagaactag

SEQ ID NO: 153791 - DNA, 270 bp, Artificial Sequence; identical to SEQ ID NO: 153789
  Description of Artificial Sequence: Synthetic coding sequence

SEQ ID NO: 153792 - DNA, 270 bp, Artificial Sequence; identical to SEQ ID NO: 153789
  Description of Artificial Sequence: Synthetic coding sequence

SEQ ID NO: 153793 - DNA, 735 bp, Artificial Sequence; identical to SEQ ID NO: 153790
  Description of Artificial Sequence: Synthetic coding sequence

SEQ ID NO: 153794 - DNA, 219 bp, Artificial Sequence
  Description of Artificial Sequence: Synthetic coding sequence
atgcacagaagaaggctggccctgggcctgggcttctgcctgctggccggcaccagcctgtctgtgctgtgggtgtacctggagaactggctgcctgtgtcctatgtgccctactacctgccctgcccagagatcctgctggagtacagaggagtcatcagcgcccactgcaacctgcacctgcccggcagcagcaactgccacgccagcgccacctag

SEQ ID NO: 153795 - DNA, 483 bp, Artificial Sequence
  Description of Artificial Sequence: Synthetic coding sequence
atgcacagaagaaggctggccctgggcctgggcttctgcctgctggccggcaccagcctgtctgtgctgtgggtgtacctggagaactggctgcctgtgtcctatgtgccctactacctgccctgcccagagatcctgcccatgatgatggccctgagctgcctgtgccaccagcagcacgaggccgccctgcaggagggggaggccaccccagcccggggcatggtgacagtgcccagcgcccaggccgccggggcccaggcccacacagctgctgacacccacaccctggtgggcgcccaccggctgcggggcaacctgcagccccgggccagcgctgcccacctgcctgccacagagccagaccactggggccacggcgtgtgccgcggggaggtgcacagcttccaccctgtgctgcccggggtgtcccggggcgtgctgcacgcctgggtgcctggggccctgctgcacctgcactag

SEQ ID NO: 153796 - DNA, 1044 bp, Artificial Sequence
  Description of Artificial Sequence: Synthetic coding sequence
atgcacagaagaaggctggccctgggcctgggcttctgcctgctggccggcaccagcctgtctgtgctgtgggtgtacctggagaactggctgcctgtgtcctatgtgccctactacctgccctgcccagagatcttcaacatgaagctgcactacaagcgggagaagcccctgcagcctgtggtgtggagccagtacccccagcccaagctgctggagcaccggcccacccagctgctgaccctgaccccctggctggcccccatcgtgtctgagggcaccttcaaccctgagctgctgcagcacatctaccagcccctgaacctgaccatcggcgtgacagtgtttgctgtgggcaagtacacccacttcatccagagcttcctggagagcgctgaggagttcttcatgaggggctacagagtgcactactacatcttcacagacaacccagctgctgtgcctggggtgcccctgggcccccaccggctgctgagcagcatccccatccagggccacagccactgggaggagacctccatgaggaggatggagaccatcagccagcacatcgccaagagggcccaccgggaggtggactacctgttctgcctggatgtggacatggtgttcaggaacccctggggccctgagaccctgggggacctggtggccgccatccaccccagctactatgctgtgccccggcagcagttcccctatgaaagaagaagagtgtccacagcctttgtggccgacagcgagggggacttctactacggcggcgctgtgtttggaggccaggtggcccgggtgtatgagttcacccggggctgccacatggccatcctggccgacaaggccaacggcatcatggccgcctggagggaggagagccacctgaacagacacttcatcagcaacaagcccagcaaggtgctgagccctgagtacctgtgggatgacaggaagccccagccccccagcctgaagctgatccgcttcagcaccctggacaaggacatcagctgcctgcggagctag

SEQ ID NO: 153797 - DNA, 885 bp, Artificial Sequence
  Description of Artificial Sequence: Synthetic coding sequence
atgcacagaagaaggctggccctgggcctgggcttctgcctgctggccggcaccagcctgtctgtgctgtgggtgtacctggagaactggctgcctgtgtcctatgtgccctactacctgccctgcccagagatcttcaacatgaagctgcactacaagcgggagaagcccctgcagcctgtggtgtggagccagtacccccagcccaagctgctggagcaccggcccacccagctgctgaccctgaccccctggctggcccccatcgtgtctgagggcaccttcaaccctgagctgctgcagcacatctaccagcccctgaacctgaccatcggcgtgacagtgtttgctgtgggcaaccccagctggagccagcccaggagcagcagctgtgtgggcaccggctgcaccaccaccagcagcctgaccaccctgcagcccttccctggcagccgctgggtgcccaccggcttcagcgcccccagccccagccgggtgacccccactggaagaagacacccctgtgccggctggaggccttctgccagcaccctgctgcggggcctgaccggccgctggaccaccagcagcgccctgatgtggacctggtgcttcggcaccaggggggccctgcggccctgggagacctggtggctgcccttcacccaggccaccacccccttccctgccagcagcagccccatgtctgctggggtcttccccctgcccctgtggcagacagccaagggcaccagcatcatggtgggccagagcagcggcggccgctggccaggctacatgagcctgctgggcgccgccacctggcccagctggaggacccggcccatggcctcctggctgcccggcggcaggaaggccacctag

SEQ ID NO: 153798 - DNA, 993 bp, Artificial Sequence
  Description of Artificial Sequence: Synthetic coding sequence
atgcacagaagaaggctggccctgggcctgggcttctgcctgctggccggcaccagcctgtctgtgctgtgggtgtacctggagaactggctgcctgtgtcctatgtgccctactacctgccctgcccagagatcctgagccagtacccccagcccaagctgctggagcaccggcccacccagctgctgaccctgaccccctggctggcccccatcgtgtctgagggcaccttcaaccctgagctgctgcagcacatctaccagcccctgaacctgaccatcggcgtgacagtgtttgctgtgggcaagtacacccacttcatccagagcttcctggagagcgctgaggagttcttcatgaggggctacagagtgcactactacatcttcacagacaacccagctgctgtgcctggggtgcccctgggcccccaccggctgctgagcagcatccccatccagggccacagccactgggaggagacctccatgaggaggatggagaccatcagccagcacatcgccaagagggcccaccgggaggtggactacctgttctgcctggatgtggacatggtgttcaggaacccctggggccctgagaccctgggggacctggtggccgccatccaccccagctactatgctgtgccccggcagcagttcccctatgaaagaagaagagtgtccacagcctttgtggccgacagcgagggggacttctactatggaggagctgtgtttggaggccaggtggcccgggtgtatgagttcacccggggctgccacatggccatcctggccgacaaggccaacggcatcatggccgcctggagggaggagagccacctgaacagacacttcatcagcaacaagcccagcaaggtgctgagccctgagtacctgtgggatgacaggaagccccagccccccagcctgaagctgatccgcttcagcaccctggacaaggacatcagctgcctgcggagctag

SEQ ID NO: 153799 - DNA, 1434 bp, Artificial Sequence
  Description of Artificial Sequence: Synthetic coding sequence
atgccaccctgccagccccagaggcccctgctgctgctgctgctgctgctggcctgccagccccaggtgcccagcgcccaggtgatggacttcctgtttgagaagtggaagctgtatggagaccagtgccaccacaacctgagcctgctgcccccacccacagagctggtgtgcaacagaacatttgacaagtacagctgctggccagacaccccagccaacaccacagccaacatcagctgcccctggtacctgccctggcaccacaaggtgcagcacagatttgtgttcaagagatgtggcccagatggccagtgggtgcggggcccccggggccagccctggagagatgccagccagtgccagatggatggagaggagattgaggtgcagaaggaggtggccaagatgtacagcagcttccaggtgatgtacacagtgggctacagcctgagcctgggcgccctgctgctggccctggccatcctgggcggcctgagcaagctgcactgcaccagaaatgccatccacgccaacctgtttgccagctttgtgctgaaggccagctctgtgctggtgattgatggcctgctgcggacccgctacagccagaagattggagatgacctgtctgtgtccacctggctgagtgatggagctgtggccggctgccgggtggccgctgtgttcatgcagtatggaattgtggccaactactgctggctgctggtggagggcctgtacctgcacaacctgctgggcctggccaccctgcctgagaggagcttcttcagcctgtacctgggcatcggctggggcgcccccatgctgtttgtggtgccctgggccgtggtgaagtgcctgtttgaaaatgtgcagtgctggaccagcaatgacaacatgggcttctggtggatcctgcgcttccctgtgttcctggccatcctgatcaacttcttcatctttgtgagaattgtgcagctgctggtggccaagctgcgggcccggcagatgcaccacacagactacaagttccggctggccaagagcaccctgaccctcatccccctgctgggcgtgcatgaggtggtgtttgcctttgtgacagatgagcacgcccagggcaccctgcggagcgccaagctgttctttgacctcttcctgagcagcttccagggcctgctggtggccgtgctgtactgcttcctgaacaaggaggtgcagagcgagctgcggcggcgctggcaccgctggaggctgggcaaggtgctgtgggaggagaggaacaccagcaaccaccgggccagcagcagccctggccacggcccccccagcaaggagctgcagtttggccggggcggcggcagccaggacagcagcgctgagacccccctggccggcggcctgccccggctggccgagagccccttctag

SEQ ID NO: 153800 - DNA, 1392 bp, Artificial Sequence
  Description of Artificial Sequence: Synthetic coding sequence
atggccggggcccctggccccctgcggctggccctgctgctgctgggcatggtgggccgggccggcccccggccccagggcgccaccgtgtccctgtgggagaccgtgcagaagtggagggagtaccgccggcagtgccagaggagcctgacagaggaccccccaccagccacagacctcttctgcaacagaacatttgatgaatatgcctgctggccagatggagagcccggcagctttgtgaatgtgtcctgcccctggtacctgccctgggccagctctgtgccccagggccacgtgtaccgcttctgcacagctgagggcctgtggctgcagaaggacaacagcagcctgccctggagggacctgtctgaatgtgaggagagcaagagaggagagaggagcagccctgaggagcagctgctcttcctgtacatcatctacacagtgggctacgccctgtccttcagcgccctggtgattgccagcgccatcctgctgggcttccgccacctgcactgcaccaggaactacatccacctgaacctgtttgccagcttcatcctgcgggccctgtctgtgttcatcaaggatgctgccctgaagtggatgtacagcacagctgcccagcagcaccagtgggatggcctgctgagctaccaggacagcctgagctgccgcctggtgttcctgctgatgcagtactgtgtggccgccaactactactggctgctggtggagggcgtgtacctgtacaccctgctggccttctctgtgctgtctgagcagtggatcttccggctgtatgtgtccatcggctggggcgtgcccctgctgtttgtggtgccctggggcatcgtgaagtacctgtatgaagatgagggctgctggaccaggaacagcaacatgaactactggctgatcatccggctgcccatcctgtttgccatcggcgtgaacttcctgatctttgtgcgggtcatctgcatcgtggtgtccaagctgaaggccaacctgatgtgcaagacagacatcaagtgccgcctggccaagagcaccctgaccctcatccccctgctgggcacccatgaagtcatctttgcctttgtgatggatgagcacgcccggggcaccctgcgcttcatcaagctgttcacagagctgtccttcaccagcttccagggcctgatggtggccatcctgtactgctttgtgaacaatgaggtgcagctggagttcaggaagtcctgggagcgctggaggctggagcacctgcacatccagagggacagctccatgaagcccctgaagtgccccaccagcagcctgagcagcggggccacagctggcagctccatgtacacagccacctgccaggccagctgcagctag

SEQ ID NO: 153801 - DNA, 1662 bp, Artificial Sequence
  Description of Artificial Sequence: Synthetic coding sequence
atgaagctgggcagcagccgggccggccctggccggggcagcgctggcctgctgcccggggtgcatgagctgcccatgggcatcccagccccctggggcaccagccccctgtccttccacaggaagtgcagcctgtgggcccctggccggcccttcctgaccctggtgctgctggtgtccatcaagcaggtgacaggcagcctgctggaggagaccaccaggaagtgggcccagtacaagcaggcctgcctgcgggacctgctgaaggagcccagcggcatcttctgcaatggcacctttgaccagtatgtgtgctggccccacagcagccctggaaatgtgtctgtgccctgccccagctacctgccctggtggagcgaggagagcagcggccgggcctaccgccactgcctggcccagggcacctggcagaccattgaaaatgccacagacatctggcaggatgattctgagtgcagcgagaaccacagcttcaagcagaatgtggacagatatgccctgctgagcaccctgcagctgatgtacacagtgggctacagcttcagcctcatcagcctcttcctggccctgaccctgctgctcttcctgaggaagctgcactgcaccaggaactacatccacatgaacctgtttgccagcttcatcctgcggaccctggccgtgctggtgaaggatgtggtgttctacaacagctacagcaagaggccagacaatgaaaatggctggatgagctacctgtctgagatgagcaccagctgccgctctgtgcaggtgctgctgcactactttgtgggcgccaactacctgtggctgctggtggagggcctgtacctgcacaccctgctggagcccaccgtgctgcctgagcggcggctgtggccccgctacctgctgctgggctgggccttccctgtgctgtttgtggtgccctggggctttgcccgggcccacctggagaacacaggctgctggaccaccaacggcaacaagaagatctggtggatcatccggggccccatgatgctgtgtgtgacagtgaacttcttcatcttcctgaagatcctgaagctgctgatcagcaagctgaaggcccaccagatgtgcttccgggactacaagtaccgcctggccaagagcaccctggtgctgatccccctgctgggcgtgcatgagatcctcttctccttcatcacagatgaccaggtggagggctttgccaagctgatccgcctcttcatccagctgaccctgagcagcttccacggcttcctggtggccctgcagtatggctttgccaacggggaggtgaaggccgagctgaggaagtactgggtgcgcttcctgctggcccggcacagcggctgccgggcctgtgtgctgggcaaggacttccgcttcctgggcaagtgccccaagaagctgtctgaaggagatggagctgagaagctgaggaagctgcagcccagcctgaacagcggccgcctgctgcacctggccatgaggggcctgggggagctgggcgcccagccccagcaggaccacgcccgctggccccggggcagcagcctgtctgagtgcagtgaaggagatgtgaccatggccaacaccatggaggagatcctggaggagagcgagatctag

SEQ ID NO: 153802 - DNA, 1053 bp, Artificial Sequence
  Description of Artificial Sequence: Synthetic coding sequence
atgggcatcccagccccctggggcaccagccccctgtccttccacaggaagtgcagcctgtgggcccctggccggcccttcctgaccctggtgctgctggtgtccatcaagcaggtgacaggcagcctgctggaggagaccaccaggaagtgggcccagtacaagcaggcctgcctgcgggacctgctgaaggagcccagcggcatcttctgcaatggcacctttgaccagtatgtgtgctggccccacagcagccctggaaatgtgtctgtgccctgccccagctacctgccctggtggagcgaggagagcagcggccgggcctaccgccactgcctggcccagggcacctggcagaccattgaaaatgccacagacatctggcaggatgacagtgaatgttctgagaaccacagcttcaagcagaatgtggacagatatgccctgctgagcaccctgcagctgatgtacacagtgggctacagcttcagcctcatcagcctcttcctggccctgaccctgctgctcttcctgaggaagctgcactgcaccaggaactacatccacatgaacctgtttgccagcttcatcctgcggaccctggccgtgctggtgaaggatgtggtgttctacaacagctacagcaagaggccagacaatgaaaatggctggatgagctacctgtctgagatgagcaccagctgccgctctgtgcaggtgctgctgcactactttgtgggcgccaactacctgtggctgctggtggagggcctgtacctgcacaccctgctggagcccaccgtgctgcctgagcggcggctgtggccccgctacctgctgctgggctgggccttccctgtgctgtttgtggtgccctggggctttgcccgggcccacctggagaacacaggctgctggaccaccaatggaaacaagaagatctggtggatcatccggggccccatgatgctgtgtgtgacagccctgggcctggaggagaccggcctgaagagaaatggcagcatccccttcggccacaaggaggacatctag

SEQ ID NO: 153803 - DNA, 1665 bp, Artificial Sequence
  Description of Artificial Sequence: Synthetic coding sequence
atgaagctgggcagcagccgggccggccctggccggggcagcgctggcctgctgcccggggtgcatgagctgcccatgggcatcccagccccctggggcaccagccccctgtccttccacaggaagtgcagcctgtgggcccctggccggcccttcctgaccctggtgctgctggtgtccatcaagcaggtgacaggcagcctgctggaggagaccaccaggaagtgggcccagtacaagcaggcctgcctgcgggacctgctgaaggagcccagcggcatcttctgcaatggcacctttgaccagtatgtgtgctggccccacagcagccctggaaatgtgtctgtgccctgccccagctacctgccctggtggagcgaggagagcagcggccgggcctaccgccactgcctggcccagggcacctggcagaccattgaaaatgccacagacatctggcaggatgattctgagtgcagcgagaaccacagcttcaagcagaatgtggacagatatgccctgctgagcaccctgcagctgatgtacacagtgggctacagcttcagcctcatcagcctcttcctggccctgaccctgctgctcttcctgaggaagctgcactgcaccaggaactacatccacatgaacctgtttgccagcttcatcctgcggaccctggccgtgctggtgaaggatgtggtgttctacaacagctacagcaagaggccagacaatgaaaatggctggatgagctacctgtctgagatgagcaccagctgccgctctgtgcaggtgctgctgcactactttgtgggcgccaactacctgtggctgctggtggagggcctgtacctgcacaccctgctggagcccaccgtgctgcctgagcggcggctgtggccccgctacctgctgctgggctgggccttccctgtgctgtttgtggtgccctggggctttgcccgggcccacctggagaacacaggctgctggaccaccaacggcaacaagaagatctggtggatcatccggggccccatgatgctgtgtgtgacagtgaacttcttcatcttcctgaagatcctgaagctgctgatcagcaagctgaaggcccaccagatgtgcttccgggactacaagtaccgcctggccaagagcaccctggtgctgatccccctgctgggcgtgcatgagatcctcttctccttcatcacagatgaccaggtggagggctttgccaagctgatccgcctcttcatccagctgaccctgagcagcttccacggcttcctggtggccctgcagtatggctttgccaacggggaggtgaaggccgagctgaggaagtactgggtgcgcttcctgctggcccggcacagcggctgccgggcctgtgtgctgggcaaggacttccgcttcctgggcaagtgccccaagaagctgtctgaaggagatggagctgagaagctgaggaagctgcagcccagcctgaacagcggccgcctgctgcacctggccatgaggggcctgggggagctgggcgcccagccccagcaggaccacgcccgctggccccggggcagcagcctgtctgagtgcagtgaaggagatgtgaccatggccaacaccatggaggagatcctggaggagaagaggagccagtag

SEQ ID NO: 153804 - DNA, 687 bp, Artificial Sequence
  Description of Artificial Sequence: Synthetic coding sequence
tgagccacagacatctggcaggatgacagtgaatgttctgagaaccacagcttcaagcagaatgtggacagatatgccctgctgagcaccctgcagctgatgtacacagtgggctacagcttcagcctcatcagcctcttcctggccctgaccctgctgctcttcctgaggaagctgcactgcaccaggaactacatccacatgaacctgtttgccagcttcatcctgcggaccctggccgtgctggtgaaggatgtggtgttctacaacagctacagcaagaggccagacaatgaaaatggctggatgagctacctgtctgagatgagcaccagctgccgctctgtgcaggtgctgctgcactactttgtgggcgccaactacctgtggctgctggtggagggcctgtacctgcacaccctgctggagcccaccgtgctgcctgagcggcggctgtggccccgctacctgctgctgggctgggccttccctgtgctgtttgtggtgccctggggctttgcccgggcccacctggagaacacaggctgctggaccaccaatggaaacaagaagatctggtggatcatccggggccccatgatgctgtgtgtgacagccctgggcctggaggagaccggcctgaagagaaatggcagcatccccttcggccacaaggaggacatctag

SEQ ID NO: 153805 - DNA, 1725 bp, Artificial Sequence
  Description of Artificial Sequence: Synthetic coding sequence
atggagcccacagagaacccctgccagggccccctgggccagaaggccggggagaagcccctggccgccggccctggagaggaggagctgctgcggggcagcgcccctcatgcccaggacacccagagcgaggagctgccccccagctgcaccatctctggagagaagaagcccccagctgtgtctggagaggccaccggggctgatgctggccgcctgtgccccccacccaggagccgggccccccacaaggacaggaccctggcccggagccggccccagacccagggcgaggactgcagcctgcctgtgggggaggtgaagattggcaagaggagctacagccctgcccctgggaagcagaagaagcccaatgccatgggcctggcccccaccagcagccctggggcccccaacagcgcccgggccacccacaaccctgtgccctgtggcagcggccggggcccctgccacctggccaacctgctgagcaccctggcccagagcaaccagaacagagaccacaagcagggccccccagaggtgacctgccagatcaggaagaagaccaggaccctgtacagaagtgaccagctggaggagctggagaagatcttccaggaggaccactacccagacagcgacaagagaagagagatcgcccagacagtgggcgtgaccccccagaggatcatggtgtggttccagaacagaagagccaagtggaggaagatggagaagctgaatggcaaggagagcaaggacaacccagctgcccctggccctgccagcagccagtgcagcagcgctgctgagatcctgcctgctgtgcccatggagcccaagccagaccccttcccccaggagagccccctggacaccttccctgagccccccatgctgctgaccagtgaccagaccctggcccccacccagcccagcgagggcgcccagagggtggtgaccccacccctcttcagccccccacctgtgcggcgggctgacctgcccttccccctgggccctgtgcacaccccccagctgatgcccctgctgatggatgtggccggcagtgacagcagccacaaggatggcccctgtggctcctggggcaccagcatcaccctgcccccaccctgcagctacctggaggagctggagccccaggactaccagcagagcaaccagcccggccccttccagttcagccaggccccccagcccccactcttccagagcccccagcccaagctgccctacctgcccaccttccccttctccatgcccagcagcctgaccctgcccccacctgaggacagcctcttcatgttcccctgtggccccagcggcggcaccagccagggctactgccctggggccagcagcggccagatcctgatgcagcccccagctggcaacatcggcacagcctcctggagcgacccctgcctgcctgagctgcccttccctggccccttctgcccccaggccctgggccaccccccaggaggagatggctacttcccagacctcttccccaccccctgcccccaggccctgggccggcagcccagcagcgccctgtcctggatgcctgagggcgcccggcccggcaccggccccctgctgagcaaggccaaggaggagcccccagctgccagcctggaccagcccagcgccctggaggaggcccggggagatgacaagaacagccacgtgccctag

SEQ ID NO: 153806 - DNA, 1722 bp, Artificial Sequence
  Description of Artificial Sequence: Synthetic coding sequence
atggccaatgctgaggtgtctgtgcctgtgggagatgtggtggtggtgcccacagagggcaatgaaggagagaaccctgaggacaccaagacccaggtgatcctgcagctgcagcctgtgcagcagggcctcttcattgatggccacttctacaaccgcatctatgaagctggcagcgagaacaacacagctgtggtggccgtggagacccacaccatccacaagattgaggagggcatcgacaccggcaccatcgaggccaatgaagacatggagatcgcctaccccatcacctgtggggagagcaaggccatcctgctgtggaagaagtttgtgtgccccggcatcaacgtgaagtgtgtgaagttcaatgaccagctgatcagccccaagcactttgtgcacctggccggcaagagcaccctgaaggactggaagagggccatccggctgggcggcatcatgctgaggaagatgatggacagcggccagattgacttctaccagcacgacaaggtgtgcagcaacacctgccgcagcaccaagtttgacctgctgatcagcagcgcccgggcccctgtgcccggccagcagacctctgtggtgcagacccccaccagcgcagatggcagcatcacccagatcgccatcagcgaggagagcatggaggaggccggcctggagtggaacagcgccctgacagctgctgtgaccatggccacagaggagggcgtgaagaaggacagcgaggagatcagcgaggacaccctgatgttctggaagggcattgctgatgtgggcctgatggaggaggtggtgtgcaacatccagaaggagattgaggagctgctgcggggcgtgcagcagaggctcatccaggcccccttccaggtgacagatgctgctgtgctgaacaacgtggcccacaccttcggcctgatggacacagtgaagaaggtgctggacaacagaagaaaccaggtggagcagggcgaggagcagttcctgtacaccctgacagacctggagcggcagctggaggagcagaagaagcagggccaggaccaccggctgaagagccagacagtgcagaatgtggtgctgatgcctgtgtccacccccaagccacccaagaggccccggctgcagaggcctgccagcaccaccgtgctgagccccagcccccctgtgcagcagccccagttcaccgtcatcagccccatcaccatcacccctgtgggccagagcttctccatgggcaacatccctgtggccaccctgagccagggcagcagccctgtgacagtgcacaccctgcccagcggcccccagctgttccgctatgccaccgtggtgagcagcgccaagagcagcagcccagacacagtgaccatccaccccagcagcagcctggccctgctgagcagcacagccatgcaggacggcagcaccctgggcaacatgaccaccatggtgtcccctgtggagctggtggccatggagagcggcctgaccagcgccatccaggccgtggagagcaccagtgaagatggccagaccatcatcgagattgatcctgccccagaccctgaggccgaggacacagagggcaaggctgtgatcctggagacagagctgaggacagaggagaaggtggtggccgagatggaggagcaccagcaccaggtgcacaacgtggagatcgtggtgctggaggactag

SEQ ID NO: 153807 - DNA, 1692 bp, Artificial Sequence
  Description of Artificial Sequence: Synthetic coding sequence
atggccaatgctgaggtgtctgtgcctgtgggagatgtggtggtggtgcccacagagggcaatgaaggagagaaccctgaggacaccaagacccaggtgatcctgcagctgcagcctgtgcagcagggcatctatgaagctggcagcgagaacaacacagctgtggtggccgtggagacccacaccatccacaagattgaggagggcatcgacaccggcaccatcgaggccaatgaagacatggagatcgcctaccccatcacctgtggggagagcaaggccatcctgctgtggaagaagtttgtgtgccccggcatcaacgtgaagtgtgtgaagttcaatgaccagctgatcagccccaagcactttgtgcacctggccggcaagagcaccctgaaggactggaagagggccatccggctgggcggcatcatgctgaggaagatgatggacagcggccagattgacttctaccagcacgacaaggtgtgcagcaacacctgccgcagcaccaagtttgacctgctgatcagcagcgcccgggcccctgtgcccggccagcagacctctgtggtgcagacccccaccagcgcagatggcagcatcacccagatcgccatcagcgaggagagcatggaggaggccggcctggagtggaacagcgccctgacagctgctgtgaccatggccacagaggagggcgtgaagaaggacagcgaggagatcagcgaggacaccctgatgttctggaagggcattgctgatgtgggcctgatggaggaggtggtgtgcaacatccagaaggagattgaggagctgctgcggggcgtgcagcagaggctcatccaggcccccttccaggtgacagatgctgctgtgctgaacaacgtggcccacaccttcggcctgatggacacagtgaagaaggtgctggacaacagaagaaaccaggtggagcagggcgaggagcagttcctgtacaccctgacagacctggagcggcagctggaggagcagaagaagcagggccaggaccaccggctgaagagccagacagtgcagaatgtggtgctgatgcctgtgtccacccccaagccacccaagaggccccggctgcagaggcctgccagcaccaccgtgctgagccccagcccccctgtgcagcagccccagttcaccgtcatcagccccatcaccatcacccctgtgggccagagcttctccatgggcaacatccctgtggccaccctgagccagggcagcagccctgtgacagtgcacaccctgcccagcggcccccagctgttccgctatgccaccgtggtgagcagcgccaagagcagcagcccagacacagtgaccatccaccccagcagcagcctggccctgctgagcagcacagccatgcaggacggcagcaccctgggcaacatgaccaccatggtgtcccctgtggagctggtggccatggagagcggcctgaccagcgccatccaggccgtggagagcaccagtgaagatggccagaccatcatcgagattgatcctgccccagaccctgaggccgaggacacagagggcaaggctgtgatcctggagacagagctgaggacagaggagaaggtggtggccgagatggaggagcaccagcaccaggtgcacaacgtggagatcgtggtgctggaggactag

SEQ ID NO: 153808 - DNA, 1692 bp, Artificial Sequence; identical to SEQ ID NO: 153807
  Description of Artificial Sequence: Synthetic coding sequence

SEQ ID NO: 153809 - DNA, 1083 bp, Artificial Sequence
  Description of Artificial Sequence: Synthetic coding sequence
atgctgcggcggctgcctgccctggccgcccggcggcccccagccaggagaagacgcatctatgaagctggcagcgagaacaacacagctgtggtggccgtggagacccacaccatccacaagattgaggagggcatcgacaccggcaccatcgaggccaatgaagacatggagatcgcctaccccatcacctgtggggagagcaaggccatcctgctgtggaagaagtttgtgtgccccggcatcaacgtgaagtgtgtgaagttcaatgaccagctgatcagccccaagcactttgtgcacctggccggcaagagcaccctgaaggactggaagagggccatccggctgggcggcatcatgctgaggaagatgatggacagcggccagattgacttctaccagcacgacaaggtgtgcagcaacacctgccgcagcaccaagtttgacctgctgatcagcagcgcccgggcccctgtgcccggccagcagacctctgtggtgcagacccccaccagcgcagatggcagcatcacccagatcgccatcagcgaggagagcatggaggaggccggcctggagtggaacagcgccctgacagctgctgtgaccatggccacagaggagggcgtgaagaaggacagcgaggagatcagcgaggacaccctgatgttctggaagggcattgctgatgtgggcctgatggaggaggtggtgtgcaacatccagaaggagattgaggagctgctgcggggcgtgcagcagaggctcatccaggcccccttccaggtgacagatgctgctgtgctgaacaacgtggcccacaccttcggcctgatggacacagtgaagaaggtgctggacaacagaagaaaccaggtggagcagggcgaggagcagttcctgtacaccctgacagacctggagcggcagctggaggagcagaagaagcagggccaggaccaccggctgaagagccagacagtgcagaatgtggtgctgatgcctgtgtccacccccaagccacccaagaggccccggctgcagaggcctgccagcaccaccgtgctgagccccagctag

SEQ ID NO: 153810 - DNA, 1593 bp, Artificial Sequence
  Description of Artificial Sequence: Synthetic coding sequence
atggccaccccagatgtgtctgtgcacatggaggaggtggtggtggtgaccaccccagacacagctgtggatggcagcggcgtggagggcgtgaagacagtgctggtgaccaccaacctggcccctcatggaggagacctgacagaggacaacatggagacagaaaatgctgctgctgctgctgctgctgccttcaccgccagcagccagctgaaggaggccgtgctggtgaagatggccgaggagggggagaacctggaggccgagatcgtgtaccccatcacctgtggggacagccgggccaacctgatctggaggaagtttgtgtgccccggcatcaacgtgaagtgtgtgcagtatgatgaacatgtgatcagccccaaggagtttgtgcacctggccggcaagagcaccctgaaggactggaagagggccatccgcatgaatggcatcatgctgaggaagatcatggattctggagagctggacttctaccagcacgacaaggtgtgcagcaacacctgccgcagcaccaagattgacctgagcggggcccgggtgtccctgagcagccccaccagcgctgagtacatccccctgaccccagctgctgctgatgtgaatggcagccctgccaccatcaccatcgagacctgtgaggaccccggggactggacagctgccatcggagatgacaccttcaccttctggaggggcctgaaggatgctggcctgctggatgaagtcatccaggagttccaccaggagctggtggagaccatgaggggcctgcagcagagggtgcaggacccccccctgcagctgagagatgctgtgctgctgaacaacatcgtgcagaactttggcatgctggacctggtgaagaaggtgctggccagccacaagtgccagatggacaggagccgggagcagtatgcccgggacctggccgccctggagcagcagtgtgatgagcacagaagaagagccaaggagctgaagcacaagagccagcacctgagcaatgtgctgatgaccctgacccctgtgtccctgcccccacctgtgaagaggccccggctggcccgggccaccagcggccctgctgccatggccagccaggtgctgacccagagcgcccagctggccctgggccctggggtgcctgtgccccagctgacctctgtgcccctgggcaaggtggtgtccaccctgcccagcacagtgctgggcaagggcagcctgcaggcccccccagccagcagccctgccagccccctgctgggcggctacacagtgctggccagcagcggcagcacctaccccagcacagtggagatccacccagatgccagcagcctgactgtgctgagcacagctgctgtgcaggacggcagcacagtgttcaaggtggtgagccccctgcagctgctgaccctgcccggcctgggccccaccctgcagaatgtggcccaggccagccctggcagcagcaccatcgtgacagtgcctgctggagctgcccctggccctgaggagcacacagccaccatcgaggtggccgccatggctgaagatcatgagaggaagtag

SEQ ID NO: 153811 - DNA, 1440 bp, Artificial Sequence
  Description of Artificial Sequence: Synthetic coding sequence
atggagacagaaaatgctgctgctgctgctgctgctgccttcaccgccagcagccagctgaaggaggccgtgctggtgaagatggccgaggagggggagaacctggaggccgagatcgtgtaccccatcacctgtggggacagccgggccaacctgatctggaggaagtttgtgtgccccggcatcaacgtgaagtgtgtgcagtatgatgagcacgtgatcagccccaaggagtttgtgcacctggccggcaagagcaccctgaaggactggaagagggccatccgcatgaatggcatcatgctgaggaagatcatggacagcggggagctggacttctaccagcacgacaaggtgtgcagcaacacctgccgcagcaccaagattgacctgagcggggcccgggtgtccctgagcagccccaccagcgctgagtacatccccctgaccccagctgctgctgatgtgaatggcagccctgccaccatcaccatcgagacctgtgaagatcctggggactggacagctgccatcggagatgacaccttcaccttctggaggggcctgaaggatgctggcctgctggatgaggtgatccaggagttccaccaggagctggtggagaccatgaggggcctgcagcagagggtgcaggacccccccctgcagctgagagatgctgtgctgctgaacaacatcgtgcagaactttggcatgctggacctggtgaagaaggtgctggccagccacaagtgccagatggacaggagccgggagcagtatgcccgggacctggccgccctggagcagcagtgtgatgagcacagaagaagagccaaggagctgaagcacaagagccagcacctgagcaatgtgctgatgaccctgacccctgtgtccctgcccccacctgtgaagaggccccggctggcccgggccaccagcggccctgctgccatggccagccaggtgctgacccagagcgcccagctggccctgggccctggggtgcctgtgccccagctgacctctgtgcccctgggcaaggtggtgtccaccctgcccagcacagtgctgggcaagggcagcctgcaggcccccccagccagcagccctgccagccccctgctgggcggctacacagtgctggccagcagcggcagcacctaccccagcacagtggagatccacccagatgccagcagcctgactgtgctgagcacagctgctgtgcaggacggcagcaccgtcttcaaggtggtgagccccctgcagctgctgaccctgcccggcctgggccccaccctgcagaatgtggcccaggccagccctggcagcagcaccatcgtgacagtgcctgctggggccgcccctggccctgaggagcacacagccaccatcgaggtggccgccatggccgaggaccacgagaggaagtag

SEQ ID NO: 153812 - DNA, 1593 bp, Artificial Sequence; identical to SEQ ID NO: 153810
  Description of Artificial Sequence: Synthetic coding sequence

SEQ ID NO: 153813 - DNA, 1401 bp, Artificial Sequence
  Description of Artificial Sequence: Synthetic coding sequence
atggccatggatgtgaccaggagccaggcccagacagccctgaccctggtggagcagatcctggccgagttccagctgcaggaggaggacctgaagaaggtgatgaggaggatgcagaaggagatggaccggggcctgcggctggagacccatgaggaggcctctgtgaagatgctgcccacctacgtgcgcagcaccccagagggcagcgaggtgggggacttcctgagcctggacctgggcggcaccaacttccgggtgatgctggtgaaggtgggggagggggaggagggccagtggagcgtgaagaccaagcaccagatgtacagcatcccagaagatgccatgactggaacagctgagatgctgtttgactacatcagcgagtgcatcagtgacttcctggacaagcaccagatgaagcacaagaagctgcccctgggcttcaccttctccttccctgtgagacatgaggacatcgacaagggcatcctgctgaactggaccaagggcttcaaggccagcggggctgagggcaacaacgtggtgggcctgctgagagatgccatcaagagaagaggagactttgagatggatgtggtggccatggtgaatgacacagtggccaccatgatcagctgctactatgaggaccaccagtgtgaggtgggcatgattgtgggcaccggctgcaatgcctgctacatggaggagatgcagaatgtggagctggtggagggagatgagggccgcatgtgtgtgaacacagagtggggcgcctttggagacagcggggagctggatgagttcctgctggagtatgaccggctggtggatgagagcagcgccaaccctggccagcagctgtatgagaagctgattggaggcaagtacatgggagagctggtgcggctggtgctgctgcggctggtggatgagaacctgctcttccacggggaggccagcgagcagctgcggaccaggggggcctttgagaccaggtttgtgtcccaggtggagagtgacacaggagacaggaagcagatctacaacatcctgagcaccctgggcctgcggcccagcaccacagactgtgacatcgtgagaagagcctgtgagagcgtgtccaccagggctgcccacatgtgcagcgctggcctggccggggtcatcaacaggatgagggagagccgctcagaagatgtgatgaggatcaccgtgggcgtggatggctctgtgtacaagctgcaccccagcttcaaggagcgcttccacgcctctgtgcggcggctgacccccagctgtgagatcaccttcatcgagagcgaggagggcagcggccgcggggccgccctggtgtctgctgtggcctgcaagaaggcctgcatgctgggccagtag

SEQ ID NO: 153814 - DNA, 1395 bp, Artificial Sequence
  Description of Artificial Sequence: Synthetic coding sequence
atgccccggcccaggagccagctgccccagcccaacagccaggtggagcagatcctggccgagttccagctgcaggaggaggacctgaagaaggtgatgaggaggatgcagaaggagatggaccggggcctgcggctggagacccatgaggaggcctctgtgaagatgctgcccacctacgtgcgcagcaccccagagggcagcgaggtgggggacttcctgagcctggacctgggcggcaccaacttccgggtgatgctggtgaaggtgggggagggggaggagggccagtggagcgtgaagaccaagcaccagatgtacagcatcccagaagatgccatgactggaacagctgagatgctgtttgactacatcagcgagtgcatcagtgacttcctggacaagcaccagatgaagcacaagaagctgcccctgggcttcaccttctccttccctgtgagacatgaggacatcgacaagggcatcctgctgaactggaccaagggcttcaaggccagcggggctgagggcaacaacgtggtgggcctgctgagagatgccatcaagagaagaggagactttgagatggatgtggtggccatggtgaatgacacagtggccaccatgatcagctgctactatgaggaccaccagtgtgaggtgggcatgattgtgggcaccggctgcaatgcctgctacatggaggagatgcagaatgtggagctggtggagggagatgagggccgcatgtgtgtgaacacagagtggggcgcctttggagacagcggggagctggatgagttcctgctggagtatgaccggctggtggatgagagcagcgccaaccctggccagcagctgtatgagaagctgattggaggcaagtacatgggagagctggtgcggctggtgctgctgcggctggtggatgagaacctgctcttccacggggaggccagcgagcagctgcggaccaggggggcctttgagaccaggtttgtgtcccaggtggagagtgacacaggagacaggaagcagatctacaacatcctgagcaccctgggcctgcggcccagcaccacagactgtgacatcgtgagaagagcctgtgagagcgtgtccaccagggctgcccacatgtgcagcgctggcctggccggggtcatcaacaggatgagggagagccgctcagaagatgtgatgaggatcaccgtgggcgtggatggctctgtgtacaagctgcaccccagcttcaaggagcgcttccacgcctctgtgcggcggctgacccccagctgtgagatcaccttcatcgagagcgaggagggcagcggccgcggggccgccctggtgtctgctgtggcctgcaagaaggcctgcatgctgggccagtag

SEQ ID NO: 153815 - DNA, 1398 bp, Artificial Sequence
  Description of Artificial Sequence: Synthetic coding sequence
atgctggatgaccgggccaggatggaggccgccaagaaggagaaggtggagcagatcctggccgagttccagctgcaggaggaggacctgaagaaggtgatgaggaggatgcagaaggagatggaccggggcctgcggctggagacccatgaggaggcctctgtgaagatgctgcccacctacgtgcgcagcaccccagagggcagcgaggtgggggacttcctgagcctggacctgggcggcaccaacttccgggtgatgctggtgaaggtgggggagggggaggagggccagtggagcgtgaagaccaagcaccagatgtacagcatcccagaagatgccatgactggaacagctgagatgctgtttgactacatcagcgagtgcatcagtgacttcctggacaagcaccagatgaagcacaagaagctgcccctgggcttcaccttctccttccctgtgagacatgaagatattgacaagggcatcctgctgaactggaccaagggcttcaaggccagcggggctgagggcaacaacgtggtgggcctgctgagagatgccatcaagagaagaggagactttgagatggatgtggtggccatggtgaatgacacagtggccaccatgatcagctgctactatgaggaccaccagtgtgaggtgggcatgattgtgggcaccggctgcaatgcctgctacatggaggagatgcagaatgtggagctggtggagggagatgagggccgcatgtgtgtgaacacagagtggggcgccttcggggacagcggggagctggatgagttcctgctggagtatgaccggctggtggatgagagcagcgccaaccctggccagcagctgtatgagaagctgattggaggcaagtacatgggagagctggtgcggctggtgctgctgcggctggtggatgagaacctgctcttccatggagaggccagcgagcagctgcggaccaggggggcctttgagaccaggtttgtgtcccaggtggagagtgacaccggggacaggaagcagatctacaacatcctgagcaccctgggcctgcggcccagcaccacagactgtgacatcgtgcggcgggcctgtgagagcgtgtccacccgggccgcccacatgtgcagcgctggcctggccggggtcatcaacaggatgagggagagccgctcagaagatgtgatgaggatcaccgtgggcgtggatggctctgtgtacaagctgcaccccagcttcaaggagcgcttccacgcctctgtgcggcggctgacccccagctgtgagatcaccttcattgaaagtgaggagggcagcggcagaggagctgccctggtgtctgctgtggcctgcaagaaggcctgcatgctgggccagtag

SEQ ID NO: 153816 - DNA, 1878 bp, Artificial Sequence
  Description of Artificial Sequence: Synthetic coding sequence
atgcctggcaccaagcgcttccagcacgtgattgagaccccagagcccgggaagtgggagctgagcggctatgaggccgctgtgcccatcacagagaagagcaaccccctgacccaggacctggacaaggcagatgctgaaaatattgtgcggctgctgggccagtgtgatgctgagatcttccaggaggagggccaggccctgagcacctaccagaggctgtacagcgagagcatcctgaccaccatggtgcaggtggccggcaaggtgcaggaggtgctgaaggagccagatggcggcctggtggtgctgagcggcggcggcaccagcggccgcatggccttcctgatgtctgtgtccttcaaccagctgatgaagggcctgggccagaagcccctgtacacctacctgattgctggaggagacagatctgtggtggccagccgggagggcacagaagattctgccctgcacggcatcgaggagctgaagaaggtggccgccggcaagaagagggtcatcgtcatcggcatctctgtgggcctgagcgccccctttgtggccggccagatggactgctgcatgaacaacacagctgtgttcctgcctgtgctggtgggcttcaaccctgtgtccatggccagaaatgaccccatcgaggactggagcagcaccttccggcaggtggccgagaggatgcagaagatgcaggagaagcagaaggcctttgtgctgaacccagccatcggccctgagggcctgagcggcagcagcaggatgaagggcggcagcgccaccaagatcctgctggagaccctgctgctggccgcccacaagacagtggaccagggcattgctgccagccagcgctgcctgctggagatcctgcggacctttgagcgggcccaccaggtgacctacagccagagccccaagatcgccaccctgatgaagtctgtgtccaccagcctggagaagaagggccacgtgtacctggtgggctggcagaccctgggcatcatcgccatcatggatggagtggagtgcatccacacctttggagctgacttcagagatgtgcggggcttcctgattggagaccacagcgacatgttcaaccagaaggccgagctgaccaaccagggcccccagttcaccttcagccaggaggacttcctgaccagcatcctgcccagcctgacagaaattgacacagtggtgttcatcttcaccctggatgacaacctgacagaggtgcagaccatcgtggagcaggtgaaggagaagaccaaccacatccaggccctggcccacagcacagtgggccagaccctgctgatccccctgaagaagctgttccccagcatcatcagcatcacctggcccctgctcttctttgaatatgagggcaacttcatccagaagttccagcgggagctgagcaccaagtgggtgctgaacacagtgtccactggagcccacgtgctgctgggcaagatcctgcagaaccacatgctggacctgcgcatcagcaacagcaagctgttctggagggccctggccatgctgcagcgcttcagcggccagagcaaggcccgctgcatcgagagcctgctgcgggccatccacttcccccagcccctgagtgatgacatccgggccgcccccatcagctgccacgtgcaggtggcccacgagaaggagcaggtgatccccatcgccctgctgagcctgctcttccgctgcagcatcacagaggcccaggcccacctggccgccgcccccagcgtgtgtgaggccgtgcgcagcgccctggccggccctggccagaagaggacagctgaccccctggagatcctggagccagatgtgcagtag

SEQ ID NO: 153817 - DNA, 1308 bp, Artificial Sequence
  Description of Artificial Sequence: Synthetic coding sequence
atggactgctgcatgaacaacacagctgtgttcctgcctgtgctggtgggcttcaaccctgtgtccatggccagaaatgaccccatcgaggactggagcagcaccttccggcaggtggccgagaggatgcagaagatgcaggagaagcagaaggcctttgtgctgaacccagccatcggccctgagggcctgagcggcagcagcaggatgaagggcggcagcgccaccaagatcctgctggagaccctgctgctggccgcccacaagacagtggaccagggcattgctgccagccagcgctgcctgctggagatcctgcggacctttgagcgggcccaccaggtgacctacagccagagccccaagatcgccaccctgatgaagtctgtgtccaccagcctggagaagaagggccacgtgtacctggtgggctggcagaccctgggcatcatcgccatcatggatggagtggagtgcatccacacctttggagctgacttcagagatgtgcggggcttcctgattggagaccacagcgacatgttcaaccagaaggccgagctgaccaaccagggcccccagttcaccttcagccaggaggacttcctgaccagcatcctgcccagcctgacagaaattgacacagtggtgttcatcttcaccctggatgacaacctgacagaggtgcagaccatcgtggagcaggtgaaggagaagaccaaccacatccaggccctggcccacagcacagtgggccagaccctgctgatccccctgaagaagctgttccccagcatcatcagcatcacctggcccctgctcttctttgaatatgagggcaacttcatccagaagttccagcgggagctgagcaccaagtgggtgctgaacacagtgtccactggagcccacgtgctgctgggcaagatcctgcagaaccacatgctggacctgcgcatcagcaacagcaagctgttctggagggccctggccatgctgcagcgcttcagcggccagagcaaggcccgctgcatcgagagcctgctgcgggccatccacttcccccagcccctgagtgatgacatccgggccgcccccatcagctgccacgtgcaggtggcccacgagaaggagcaggtgatccccatcgccctgctgagcctgctcttccgctgcagcatcacagaggcccaggcccacctggccgccgcccccagcgtgtgtgaggccgtgcgcagcgccctggccggccctggccagaagaggacagctgaccccctggagatcctggagccagatgtgcagtag

SEQ ID NO: 153818 - DNA, 1659 bp, Artificial Sequence
  Description of Artificial Sequence: Synthetic coding sequence
atgaggctgctgcccctggcccctggccgcctgcggcggggcagccccaggcacctgcccagctgcagccctgccctgctgctgctggtgctgggcggctgcctgggcgtgtttggagtggccgccggcacccggcggcccaacgtggtgctgctgctgacagatgaccaggatgaggtgctgggcggcatgacccccctgaagaagaccaaggccctgattggagagatgggcatgaccttcagcagcgcctacgtgcccagcgccctgtgctgccccagccgggccagcatcctgaccgggaagtacccccacaaccaccacgtggtgaacaacaccctggagggcaactgcagcagcaagtcctggcagaagatccaggagcccaacaccttccctgccatcctgcgctccatgtgtggctaccagaccttctttgctgggaagtacctgaatgaatatggagccccagatgctgggggcctggagcacgtgcccctgggctggagctactggtacgccctggagaagaacagcaagtactacaactacaccctgagcatcaatggcaaggccaggaagcatggagagaactacagcgtggactacctgacagatgtgctggccaacgtgtccctggacttcctggactacaagagcaactttgagcccttcttcatgatgattgccaccccagccccccacagcccctggacagctgccccccagtaccagaaggccttccagaatgtgtttgcccccaggaacaagaacttcaacatccacggcaccaacaagcactggctgatccggcaggccaagacccccatgaccaacagcagcatccagttcctggacaatgccttcaggaagcgctggcagaccctgctgtctgtggatgacctggtggagaagctggtgaagaggctggagttcaccggggagctgaacaacacctacatcttctacaccagtgacaatggctaccacacaggccagttcagcctgcccatcgacaagaggcagctgtatgaatttgacatcaaggtgcccctgctggtgcggggccctggcatcaagcccaaccagaccagcaagatgctggtggccaacatcgacctgggccccaccatcctggacattgctggctatgacctgaacaagacccagatggatggcatgagcctgctgcccatcctgcggggggccagcaacctgacctggaggagtgatgtgctggtggagtaccagggcgagggcagaaatgtgacagaccccacctgccccagcctgagccctggggtgtcccagtgcttcccagactgtgtgtgtgaagatgcctacaacaacacctacgcctgtgtgaggaccatgtctgccctgtggaacctgcagtactgtgaatttgatgaccaggaggtgtttgtggaggtgtacaacctgacagctgaccctgaccagatcaccaacatcgccaagaccattgatcctgagctgctgggcaagatgaactaccgcctgatgatgctgcagagctgcagcggccccacctgcaggaccccaggagtgtttgaccccggctacagatttgacccccggctgatgttcagcaacagaggctctgtgaggacccggcgcttcagcaagcacctgctgtag

SEQ ID NO: 153819 - DNA, 1410 bp, Artificial Sequence
  Description of Artificial Sequence: Synthetic coding sequence
atgtatgtgcccagcgccctgtgctgccccagccgggccagcatcctgaccgggaagtacccccacaaccaccacgtggtgaacaacaccctggagggcaactgcagcagcaagtcctggcagaagatccaggagcccaacaccttccctgccatcctgcgctccatgtgtggctaccagaccttctttgctgggaagtacctgaatgaatatggagccccagatgctgggggcctggagcacgtgcccctgggctggagctactggtacgccctggagaagaacagcaagtactacaactacaccctgagcatcaacgggaaggccaggaagcacggggagaactacagcgtggactacctgacagatgtgctggccaacgtgtccctggacttcctggactacaagagcaactttgagcccttcttcatgatgattgccaccccagccccccacagcccctggacagctgccccccagtaccagaaggccttccagaatgtgtttgcccccaggaacaagaacttcaacatccacggcaccaacaagcactggctgatccggcaggccaagacccccatgaccaacagcagcatccagttcctggacaatgccttcaggaagcgctggcagaccctgctgtctgtggatgacctggtggagaagctggtgaagaggctggagttcaccggggagctgaacaacacctacatcttctacaccagtgacaatggctaccacacaggccagttcagcctgcccatcgacaagaggcagctgtatgaatttgacatcaaggtgcccctgctggtgcggggccctggcatcaagcccaaccagaccagcaagatgctggtggccaacatcgacctgggccccaccatcctggacattgctggctatgacctgaacaagacccagatggatggcatgagcctgctgcccatcctgcggggggccagcaacctgacctggaggagtgatgtgctggtggagtaccagggcgagggcagaaatgtgacagaccccacctgccccagcctgagccctggggtgtcccagtgcttcccagactgtgtgtgtgaagatgcctacaacaacacctacgcctgtgtgaggaccatgtctgccctgtggaacctgcagtactgtgaatttgatgaccaggaggtgtttgtggaggtgtacaacctgacagctgaccctgaccagatcaccaacatcgccaagaccatcgaccctgagctgctgggcaagatgaactaccgcctgatgatgctgcagagctgcagcggccccacctgcaggaccccaggagtgtttgatcctggctacagatttgacccccggctgatgttcagcaacagaggctctgtgaggacccggcgcttcagcaagcacctgctgtag

SEQ ID NO: 153820 - DNA, 1599 bp, Artificial Sequence
  Description of Artificial Sequence: Synthetic coding sequence
atgaggctgctgcccctggcccctggccgcctgcggcggggcagccccaggcacctgcccagctgcagccctgccctgctgctgctggtgctgggcggctgcctgggcgtgtttggagtggccgccggcacccggcggcccaacgtggtgctgctgctgacagatgaccaggatgaggtgctgggcggcatgtatgtgcccagcgccctgtgctgccccagccgggccagcatcctgaccgggaagtacccccacaaccaccacgtggtgaacaacaccctggagggcaactgcagcagcaagtcctggcagaagatccaggagcccaacaccttccctgccatcctgcgctccatgtgtggctaccagaccttctttgctgggaagtacctgaatgaatatggagccccagatgctgggggcctggagcacgtgcccctgggctggagctactggtacgccctggagaagaacagcaagtactacaactacaccctgagcatcaatggcaaggccaggaagcatggagagaactacagcgtggactacctgacagatgtgctggccaacgtgtccctggacttcctggactacaagagcaactttgagcccttcttcatgatgattgccaccccagccccccacagcccctggacagctgccccccagtaccagaaggccttccagaatgtgtttgcccccaggaacaagaacttcaacatccacggcaccaacaagcactggctgatccggcaggccaagacccccatgaccaacagcagcatccagttcctggacaatgccttcaggaagcgctggcagaccctgctgtctgtggatgacctggtggagaagctggtgaagaggctggagttcaccggggagctgaacaacacctacatcttctacaccagtgacaatggctaccacacaggccagttcagcctgcccatcgacaagaggcagctgtatgaatttgacatcaaggtgcccctgctggtgcggggccctggcatcaagcccaaccagaccagcaagatgctggtggccaacatcgacctgggccccaccatcctggacattgctggctatgacctgaacaagacccagatggatggcatgagcctgctgcccatcctgcggggggccagcaacctgacctggaggagtgatgtgctggtggagtaccagggcgagggcagaaatgtgacagaccccacctgccccagcctgagccctggggtgtcccagtgcttcccagactgtgtgtgtgaagatgcctacaacaacacctacgcctgtgtgaggaccatgtctgccctgtggaacctgcagtactgtgaatttgatgaccaggaggtgtttgtggaggtgtacaacctgacagctgaccctgaccagatcaccaacatcgccaagaccattgatcctgagctgctgggcaagatgaactaccgcctgatgatgctgcagagctgcagcggccccacctgcaggaccccaggagtgtttgaccccggctacagatttgacccccggctgatgttcagcaacagaggctctgtgaggacccggcgcttcagcaagcacctgctgtag

SEQ ID NO: 153821 - DNA, 2154 bp, Artificial Sequence
  Description of Artificial Sequence: Synthetic coding sequence
atgcccatcggggactgcagcgtggccgccaagcccaggaagcagctgctgtgcagcctcttccagaccaccctgggctaccgggcccgggccagcggctggaagcccatggtgatctgccggggcagccacgccttcaaggacctgatcaacacctacaggatgattgagcaggatgactttgacatcaacacccggctgcacaccatcgtgcggggggaggatgaagctgccatggtggagagcgtgggcctggccctggtgaagctgcctgatgtgctgaaccggctgaagccagacatcatgattgtgcatggagacagatttgatgccctggccctggccaccagcgctgccctgatgaacatccgcatcctgcacatcgagggcggggaggtgtctggcaccattgatgacagcatcagacatgccatcaccaagctggcccactaccacgtgtgctgcaccaggtctgctgagcagcacctgatctccatgtgtgaggaccatgaccgcatcctgctggccggctgccccagctatgacaagctgctgagcgccaagaacaaggactacatgagcatcatccgcatgtggctgggagatgatgtgaagagcaaggactacatcgtggccctgcagcaccctgtgaccacagacatcaagcacagcatcaagatgtttgagctgaccctggatgccctgatctccttcaacaagaggaccctggtgctcttccccaacattgatgctggcagcaaggagatggtgcgggtgatgaggaagaagggcatcgagcaccaccccaacttccgggctgtgaagcacgtgccctttgaccagttcatccagctggtggcccatgctggctgcatgattggcaacagcagctgtggggtgcgggaggtgggcgccttcggcacccctgtgatcaacctgggcacccggcagatcggccgggagaccggggagaatgtgctgcacgtgagagatgctgacacccaggacaagatcctgcaggccctgcacctgcagtttgggaagcagtacccctgcagcaagatctatggagatggaaatgctgtgccccgcatcctgaagttcctgaagagcattgacctgcaggagcccctgcagaagaagttctgcttcccccctgtgaaggagaacatcagccaggacatcgaccacatcctggagaccctgagcgccctggccgtggacctgggcggcaccaacctgcgggtggccatcgtgtccatgaagggggagatcgtgaagaagtacacccagttcaaccccaagacctatgaggagcgcatcaacctgatcctgcagatgtgtgtggaggccgctgctgaggccgtgaagctgaactgccgcatcctgggcgtgggcatcagcactggaggccgggtgaacccccgggagggcatcgtgctgcacagcaccaagctgatccaggagtggaacagcgtggacctgcggacccccctgagtgacaccctgcacctgcctgtgtgggtggacaatgatggcaactgtgccgccctggccgagaggaagtttggccagggcaagggcctggagaactttgtgaccctcatcactggaactggaattggaggcggcatcatccaccagcacgagctgattcatggcagcagcttctgtgccgctgagctgggccacctggtggtgtccctggatggccctgactgcagctgtggcagccacggctgcatcgaggcctatgccagcggcatggccctgcagcgggaggccaagaagctgcatgatgaggacctgctgctggtggagggcatgtctgtgcccaaggatgaggccgtgggcgccctgcacctgatccaggccgccaagctgggcaatgccaaggcccagagcatcctgaggacagctggaacagccctgggcctgggcgtggtgaacatcctgcacaccatgaaccccagcctggtgatcctgtctggagtgctggccagccactacatccacatcgtgaaggatgtgatccggcagcaggccctgagctctgtgcaggatgtggatgtggtggtgtctgacctggtggaccctgccctgctgggcgccgcctccatggtgctggactacaccacccggcgcatctactag

SEQ ID NO: 153822 - DNA, 2169 bp, Artificial Sequence
  Description of Artificial Sequence: Synthetic coding sequence
atggagaagaatggaaacaacaggaagctgcgggtgtgtgtggccacctgcaacagagctgactacagcaagctggcccccatcatgtttggcatcaagacagagcctgagttctttgagctggatgtggtggtgctgggcagccacctgattgatgattatggcaacacctacaggatgattgagcaggatgactttgacatcaacacccggctgcacaccatcgtgagaggagaagatgaggccgccatggtggagagcgtgggcctggccctggtgaagctgcctgatgtgctgaaccggctgaagccagacatcatgattgtgcacggggacagatttgatgccctggccctggccaccagcgctgccctgatgaacatccgcatcctgcacattgaaggaggagaggtgtctggcaccattgatgacagcatcagacatgccatcaccaagctggcccactaccacgtgtgctgcaccaggtctgctgagcagcacctgatctccatgtgtgaagatcatgaccgcatcctgctggccggctgccccagctatgacaagctgctgagcgccaagaacaaggactacatgagcatcatccgcatgtggctgggagatgatgtgaagagcaaggactacatcgtggccctgcagcaccctgtgaccacagacatcaagcacagcatcaagatgtttgagctgaccctggatgccctgatctccttcaacaagaggaccctggtgctcttccccaacattgatgctggcagcaaggagatggtgcgggtgatgaggaagaagggcatcgagcaccaccccaacttccgggctgtgaagcacgtgccctttgaccagttcatccagctggtggcccacgccggctgcatgattggcaacagcagctgtggggtgcgggaggtgggcgccttcggcacccctgtgatcaacctgggcacccggcagatcggccgggagactggagaaaatgtgctgcacgtgagagatgctgacacccaggacaagatcctgcaggccctgcacctgcagtttgggaagcagtacccctgcagcaagatctatggagatggaaatgctgtgccccgcatcctgaagttcctgaagagcattgacctgcaggagcccctgcagaagaagttctgcttcccccctgtgaaggagaacatcagccaggacatcgaccacatcctggagaccctgagcgccctggccgtggacctgggcggcaccaacctgcgggtggccatcgtgtccatgaagggggagatcgtgaagaagtacacccagttcaaccccaagacctatgaggagcgcatcaacctgatcctgcagatgtgtgtggaggccgctgctgaggccgtgaagctgaactgccgcatcctgggcgtgggcatcagcactggaggccgggtgaacccccgggagggcatcgtgctgcacagcaccaagctgatccaggagtggaacagcgtggacctgcggacccccctgagtgacaccctgcacctgcctgtgtgggtggacaatgatggcaactgtgccgccctggccgagaggaagtttggccagggcaagggcctggagaactttgtgaccctcatcaccggcaccggcatcggcggcggcatcatccaccagcacgagctgatccacggcagcagcttctgtgccgctgagctgggccacctggtggtgtccctggatggccctgactgcagctgtggcagccacggctgcatcgaggcctatgccagcggcatggccctgcagcgggaggccaagaagctgcatgatgaggacctgctgctggtggagggcatgtctgtgcccaaggatgaagctgtgggcgccctgcacctgatccaggccgccaagctgggcaatgccaaggcccagagcatcctgaggacagctggaacagccctgggcctgggcgtggtgaacatcctgcacaccatgaaccccagcctggtgatcctgagcggcgtgctggccagccactacatccacatcgtgaaggatgtgatccggcagcaggccctgagctctgtgcaggatgtggatgtggtggtgtctgacctggtggaccctgccctgctgggcgccgcctccatggtgctggactacaccacccggcgcatctactag

SEQ ID NO: 153823 - DNA, 2262 bp, Artificial Sequence
  Description of Artificial Sequence: Synthetic coding sequence
atggagacctacggctacctgcagcgggagagctgcttccagggcccccatgagctgtacttcaagaacctgagcaagaggaacaagcagatcatggagaagaatggaaacaacaggaagctgcgggtgtgtgtggccacctgcaacagagctgactacagcaagctggcccccatcatgtttggcatcaagacagagcctgagttctttgagctggatgtggtggtgctgggcagccacctgattgatgattatggcaacacctacaggatgattgagcaggatgactttgacatcaacacccggctgcacaccatcgtgcggggggaggatgaagctgccatggtggagagcgtgggcctggccctggtgaagctgcctgatgtgctgaaccggctgaagccagacatcatgattgtgcatggagacagatttgatgccctggccctggccaccagcgctgccctgatgaacatccgcatcctgcacatcgagggcggggaggtgtctggcaccattgatgacagcatcagacatgccatcaccaagctggcccactaccacgtgtgctgcaccaggtctgctgagcagcacctgatctccatgtgtgaggaccatgaccgcatcctgctggccggctgccccagctatgacaagctgctgagcgccaagaacaaggactacatgagcatcatccgcatgtggctgggagatgatgtgaagagcaaggactacatcgtggccctgcagcaccctgtgaccacagacatcaagcacagcatcaagatgtttgagctgaccctggatgccctgatctccttcaacaagaggaccctggtgctcttccccaacattgatgctggcagcaaggagatggtgcgggtgatgaggaagaagggcatcgagcaccaccccaacttccgggctgtgaagcacgtgccctttgaccagttcatccagctggtggcccatgctggctgcatgattggcaacagcagctgtggggtgcgggaggtgggcgccttcggcacccctgtgatcaacctgggcacccggcagatcggccgggagaccggggagaatgtgctgcacgtgagagatgctgacacccaggacaagatcctgcaggccctgcacctgcagtttgggaagcagtacccctgcagcaagatctatggagatggaaatgctgtgccccgcatcctgaagttcctgaagagcattgacctgcaggagcccctgcagaagaagttctgcttcccccctgtgaaggagaacatcagccaggacatcgaccacatcctggagaccctgagcgccctggccgtggacctgggcggcaccaacctgcgggtggccatcgtgtccatgaagggggagatcgtgaagaagtacacccagttcaaccccaagacctatgaggagcgcatcaacctgatcctgcagatgtgtgtggaggccgctgctgaggccgtgaagctgaactgccgcatcctgggcgtgggcatcagcactggaggccgggtgaacccccgggagggcatcgtgctgcacagcaccaagctgatccaggagtggaacagcgtggacctgcggacccccctgagtgacaccctgcacctgcctgtgtgggtggacaatgatggcaactgtgccgccctggccgagaggaagtttggccagggcaagggcctggagaactttgtgaccctcatcactggaactggaattggaggcggcatcatccaccagcacgagctgattcatggcagcagcttctgtgccgctgagctgggccacctggtggtgtccctggatggccctgactgcagctgtggcagccacggctgcatcgaggcctatgccagcggcatggccctgcagcgggaggccaagaagctgcatgatgaggacctgctgctggtggagggcatgtctgtgcccaaggatgaggccgtgggcgccctgcacctgatccaggccgccaagctgggcaatgccaaggcccagagcatcctgaggacagctggaacagccctgggcctgggcgtggtgaacatcctgcacaccatgaaccccagcctggtgatcctgtctggagtgctggccagccactacatccacatcgtgaaggatgtgatccggcagcaggccctgagctctgtgcaggatgtggatgtggtggtgtctgacctggtggaccctgccctgctgggcgccgcctccatggtgctggactacaccacccggcgcatctactag

SEQ ID NO: 153824 - DNA, 399 bp, Artificial Sequence
  Description of Artificial Sequence: Synthetic coding sequence
atgtttgagctgaccctggatgccctgatctccttcaacaagaggaccctggtgctcttccccaacattgatgctggcagcaaggagatggtgcgggtgatgaggaagaagggcatcgagcaccaccccaacttccgggctgtgaagcacgtgccctttgaccagttcatccagctggtggcccatgctggctgcatgattggcaacagcagctgtggggtgcgggaggtgggcgccctgacccggctgtacacctacgtgtcctgctacaagcacacccacacccacacccacacccaccccagcagcagcaaccccaagctgcggagccagaaggtgatccagagtgaaaatagaggcaagagctaccaggagggcctgaagtacaccttcttctag

SEQ ID NO: 153825 - DNA, 2169 bp, Artificial Sequence; identical to SEQ ID NO: 153822
  Description of Artificial Sequence: Synthetic coding sequence

SEQ ID NO: 153826 - DNA, 1947 bp, Artificial Sequence
  Description of Artificial Sequence: Synthetic coding sequence
atggagaagaatggaaacaacaggaagctgcgggtgtgtgtggccacctgcaacagagctgactacagcaagctggcccccatcatgtttggcatcaagacagagcctgagttctttgagctggatgtggtggtgctgggcagccacctgattgatgattatggcaacacctacaggatgattgagcaggatgactttgacatcaacacccggctgcacaccatcgtgagaggagaagatgaggccgccatggtggagagcgtgggcctggccctggtgaagctgcctgatgtgctgaaccggctgaagccagacatcatgattgtgcacggggacagatttgatgccctggccctggccaccagcgctgccctgatgaacatccgcatcctgcacattgaaggaggagaggtgtctggcaccattgatgacagcatcagacatgccatcaccaagctggcccactaccacgtgtgctgcaccaggtctgctgagcagcacctgatctccatgtgtgaagatcatgaccgcatcctgctggccggctgccccagctatgacaagctgctgagcgccaagaacaaggactacatgagcatcatccgcatgtggctgggagatgatgtgaagagcaaggactacatcgtggccctgcagcaccctgtgaccacagacatcaagcacagcatcaagatgtttgagctgaccctggatgccctgatctccttcaacaagaggaccctggtgctcttccccaacattgatgctggcagcaaggagatggtgcgggtgatgaggaagaagggcatcgagcaccaccccaacttccgggctgtgaagcacgtgccctttgaccagttcatccagctggtggcccacgccggctgcatgattggcaacagcagctgtggggtgcgggaggtgggcgccttcggcacccctgtgatcaacctgggcacccggcagatcggccgggagactggagaaaatgtgctgcacgtgagagatgctgacacccaggacaagatcctgcaggccctgcacctgcagtttgggaagcagtacccctgcagcaagatctatggagatggaaatgctgtgccccgcatcctgaagttcctgaagagcattgacctgcaggagcccctgcagaagaagttctgcttcccccctgtgaaggagaacatcagccaggacatcgaccacatcctggagaccctgagcgccctggccgtggacctgggcggcaccaacctgcgggtggccatcgtgtccatgaagggggagatcgtgaagaagtacacccagttcaaccccaagacctatgaggagcgcatcaacctgatcctgcagatgtgtgtggaggccgctgctgaggccgtgaagctgaactgccgcatcctgggcgtgggcatcggcggcggcatcatccaccagcacgagctgatccacggcagcagcttctgtgccgctgagctgggccacctggtggtgtccctggatggccctgactgcagctgtggcagccacggctgcatcgaggcctatgccagcggcatggccctgcagcgggaggccaagaagctgcatgatgaggacctgctgctggtggagggcatgtctgtgcccaaggatgaagctgtgggcgccctgcacctgatccaggccgccaagctgggcaatgccaaggcccagagcatcctgaggacagctggaacagccctgggcctgggcgtggtgaacatcctgcacaccatgaaccccagcctggtgatcctgagcggcgtgctggccagccactacatccacatcgtgaaggatgtgatccggcagcaggccctgagctctgtgcaggatgtggatgtggtggtgtctgacctggtggaccctgccctgctgggcgccgcctccatggtgctggactacaccacccggcgcatctactag

SEQ ID NO: 153827 - DNA, 1839 bp, Artificial Sequence
  Description of Artificial Sequence: Synthetic coding sequence
atgattgagcaggatgactttgacatcaacacccggctgcacaccatcgtgcggggggaggatgaagctgccatggtggagagcgtgggcctggccctggtgaagctgcctgatgtgctgaaccggctgaagccagacatcatgattgtgcatggagacagatttgatgccctggccctggccaccagcgctgccctgatgaacatccgcatcctgcacatcgagggcggggaggtgtctggcaccattgatgacagcatcagacatgccatcaccaagctggcccactaccacgtgtgctgcaccaggtctgctgagcagcacctgatctccatgtgtgaggaccatgaccgcatcctgctggccggctgccccagctatgacaagctgctgagcgccaagaacaaggactacatgagcatcatccgcatgtggctgggcagcaaggagatggtgcgggtgatgaggaagaagggcatcgagcaccaccccaacttccgggctgtgaagcacgtgccctttgaccagttcatccagctggtggcccacgccggctgcatgattggcaacagcagctgtggggtgcgggaggtgggcgccttcggcacccctgtgatcaacctgggcacccggcagatcggccgggagactggagaaaatgtgctgcacgtgagagatgctgacacccaggacaagatcctgcaggccctgcacctgcagtttgggaagcagtacccctgcagcaagatctatggagatggaaatgctgtgccccgcatcctgaagttcctgaagagcattgacctgcaggagcccctgcagaagaagttctgcttcccccctgtgaaggagaacatcagccaggacatcgaccacatcctggagaccctgagcgccctggccgtggacctgggcggcaccaacctgcgggtggccatcgtgtccatgaagggggagatcgtgaagaagtacacccagttcaaccccaagacctatgaggagcgcatcaacctgatcctgcagatgtgtgtggaggccgctgctgaggccgtgaagctgaactgccgcatcctgggcgtgggcatcagcactggaggccgggtgaacccccgggagggcatcgtgctgcacagcaccaagctgatccaggagtggaacagcgtggacctgcggacccccctgagtgacaccctgcacctgcctgtgtgggtggacaatgatggcaactgtgccgccctggccgagaggaagtttggccagggcaagggcctggagaactttgtgaccctcatcaccggcaccggcatcggcggcggcatcatccaccagcacgagctgatccacggcagcagcttctgtgccgctgagctgggccacctggtggtgtccctggatggccctgactgcagctgtggcagccacggctgcatcgaggcctatgccagcggcatggccctgcagcgggaggccaagaagctgcatgatgaggacctgctgctggtggagggcatgtctgtgcccaaggatgaagctgtgggcgccctgcacctgatccaggccgccaagctgggcaatgccaaggcccagagcatcctgaggacagctggaacagccctgggcctgggcgtggtgaacatcctgcacaccatgaaccccagcctggtgatcctgagcggcgtgctggccagccactacatccacatcgtgaaggatgtgatccggcagcaggccctgagctctgtgcaggatgtggatgtggtggtgtctgacctggtggaccctgccctgctgggcgccgcctccatggtgctggactacaccacccggcgcatctactag

SEQ ID NO: 153828 - DNA, 870 bp, Artificial Sequence
  Description of Artificial Sequence: Synthetic coding sequence
atgaagctgatcatcctggagcactacagccaggccagcgagtgggccgccaagtacatccggaaccgcatcatccagttcaaccctggccctgagaagtacttcaccctgggcctgcccaccggcagcacccccctgggctgctacaagaagctgattgagtactacaagaatggagacctgtccttcaagtatgtgaagaccttcaacatggatgaatatgtgggcctgccccgggaccaccctgagagctaccacagcttcatgtggaacaacttcttcaagcacatcgacatccaccctgagaacacccacatcctggatggaaatgctgtggacctgcaggctgaatgtgatgcctttgaggagaagatcaaggccgccggcggcatcgagctgtttgtgggcggcatcggcccagatggccacatcgccttcaatgaacctggcagcagcctggtgtccaggaccagggtgaagaccctggccatggacaccatcctggccaatgcccgcttctttgatggagagctgaccaaggtgcccaccatggccctgactgtgggcgtgggcaccgtgatggatgcccgggaggtgatgatcctgatcaccggggcccacaaggcctttgccctgtacaaggccatcgaggagggcgtgaaccacatgtggacagtgtctgccttccagcagcaccccaggacagtgtttgtgtgtgatgaagatgccaccctggagctgaaggtgaagacagtgaagtacttcaagggcctgatgctggtgcacaacaagctggtggaccccctgtacagcatcaaggagaaggagacagagaagagccagagcagcaagaagccctacagcgactag

SEQ ID NO: 153829 - DNA, 768 bp, Artificial Sequence
  Description of Artificial Sequence: Synthetic coding sequence
atgaagctgatcatcctggagcactacagccaggccagcgagtgggccgccaagtacatccggaaccgcatcatccagttcaaccctggccctgagaagtacttcaccctgggcctgcccaccggcctgccccgggaccaccctgagagctaccacagcttcatgtggaacaacttcttcaagcacatcgacatccaccctgagaacacccacatcctggatggaaatgctgtggacctgcaggctgaatgtgatgcctttgaggagaagatcaaggccgccggcggcatcgagctgtttgtgggcggcatcggcccagatggccacatcgccttcaatgaacctggcagcagcctggtgtccaggaccagggtgaagaccctggccatggacaccatcctggccaatgcccgcttctttgatggagagctgaccaaggtgcccaccatggccctgactgtgggcgtgggcaccgtgatggatgcccgggaggtgatgatcctgatcaccggggcccacaaggcctttgccctgtacaaggccatcgaggagggcgtgaaccacatgtggacagtgtctgccttccagcagcaccccaggacagtgtttgtgtgtgatgaagatgccaccctggagctgaaggtgaagacagtgaagtacttcaagggcctgatgctggtgcacaacaagctggtggaccccctgtacagcatcaaggagaaggagacagagaagagccagagcagcaagaagccctacagcgactag

SEQ ID NO: 153830 - DNA, 870 bp, Artificial Sequence; identical to SEQ ID NO: 153828
  Description of Artificial Sequence: Synthetic coding sequence

SEQ ID NO: 153831 - DNA, 417 bp, Artificial Sequence
  Description of Artificial Sequence: Synthetic coding sequence
atgaagctgatcatcctggagcactacagccaggccagcgagtgggccgccaagtacatccggaaccgcatcatccagttcaaccctggccctgagaagtacttcaccctgggcctgcccaccggcagcacccccctgggctgctacaagaagctgattgagtactacaagaatggagacctgtccttcaagtatgtgaagaccttcaacatggatgaatatgtgggcctgccccgggaccaccctgagagctaccacagcttcatgtggaacaacttcttcaagcacatcgacatccaccctgagaacacccacatcctggatggaaatgctgtggacctgcaggctgaatgtgatgcctttgaggagaagatcaaggccgccggcggcatcgagctgtttgtgggcggcatctag

SEQ ID NO: 153832 - DNA, 870 bp, Artificial Sequence; identical to SEQ ID NO: 153828
  Description of Artificial Sequence: Synthetic coding sequence

SEQ ID NO: 153833 - DNA, 90 bp, Artificial Sequence
  Description of Artificial Sequence: Synthetic coding sequence
atgaagctgatcatcctggagcactacagccaggccagcgagtgggccgccaagtacatccggaaccgcatcatccagttcaacccctag

SEQ ID NO: 153834 - DNA, 870 bp, Artificial Sequence; identical to SEQ ID NO: 153828
  Description of Artificial Sequence: Synthetic coding sequence

SEQ ID NO: 153835 - DNA, 486 bp, Artificial Sequence
  Description of Artificial Sequence: Synthetic coding sequence
atgaagctgatcatcctggagcactacagccaggccagcgagtgggccgccaagtacatccggaaccgcatcatccagttcaaccctggccctgagaagtacttcaccctgggcctgcccaccggcagcacccccctgggctgctacaagaagctgattgagtactacaagaatggagacctgtccttcaagtatgtgaagaccttcaacatggatgaatatgtgggcctgccccgggaccaccctgagagctaccacagcttcatgtggaacaacttcttcaagcacatcgacatccaccctgagaacacccacatcctggatggaaatgctgtggacctgcaggctgaatgtgatgcctttgaggagaagatcaaggccgccggcggcatcgagctgtttgtgggcggcatcggcccagatggccacatcgccttcaatgaacctggcagcagcctggtgtccaggaccagggtgaagacctag

SEQ ID NO: 153836 - DNA, 639 bp, Artificial Sequence
  Description of Artificial Sequence: Synthetic coding sequence
atgaagctgatcatcctggagcactacagccaggccagcgagtgggccgccaagtacatccggaaccgcatcatccagttcaaccctggccctgagaagtacttcaccctgggcctgcccaccggcagcacccccctgggctgctacaagaagctgattgagtactacaagaatggagacctgtccttcaagtatgtgaagaccttcaatgagcccggcagcagcctggtgtccaggaccagggtgaagaccctggccatggacaccatcctggccaatgcccgcttctttgatggagagctgaccaaggtgcccaccatggccctgactgtgggcgtgggcaccgtgatggatgcccgggaggtgatgatcctgatcactggagcccacaaggcctttgccctgtacaaggccatcgaggagggcgtgaaccacatgtggacagtgtctgccttccagcagcaccccaggacagtgtttgtgtgtgatgaagatgccaccctggagctgaaggtgaagacagtgaagtacttcaagggcctgatgctggtgcacaacaagctggtggaccccctgtacagcatcaaggagaaggagacagagaagagccagagcagcaagaagccctacagcgactag

SEQ ID NO: 153837 - DNA, 831 bp, Artificial Sequence
  Description of Artificial Sequence: Synthetic coding sequence
atgaggctggtgatcctggacaactatgacctggccagcgagtgggccgccaagtacatctgcaaccgcatcatccagttcaagccaggccaggaccgctacttcaccctgggcctgcccaccggcagcacccccctgggctgctacaagaagctgattgagtaccacaagaatggccacctgtccttcaagtatgtgaagaccttcaacatggatgaatatgtgggcctgcccaggaaccaccctgagagctaccacagctacatgtggaacaacttcttcaagcacattgatattgaccccaacaatgcccacatcctggatggaaatgctgctgacctgcaggctgaatgtgatgcctttgagaacaagatcaaggaggccggcggcatcgacctgtttgtgggcggcatcggcccagatggccacatcgccttcaatgaacctggcagcagcctggtgtccaggacccggctgaagaccctggccatggacaccatcctggccaatgccaagtactttgatggagacctgagcaaggtgcccaccatggccctgactgtgggcgtgggcaccgtgatggatgcccgggaggtgatgatcctgatcaccggggcccacaaggcctttgccctgtacaaggccatcgaggagggcgtgaaccacatgtggacagtgtctgccttccagcagcaccccaggaccatctttgtgtgtgatgaagatgccaccctggagctgcgggtgaagacagtgaagtacttcaagggcctgatgcacgtgcacaacaagctggtggaccccctcttctccatgaaggatggcaactag

SEQ ID NO: 153838 - DNA, 780 bp, Artificial Sequence
  Description of Artificial Sequence: Synthetic coding sequence
atgaggctggtgatcctggacaactatgacctggccagcgagtgggccgccaagtacatctgcaaccgcatcatccagttcaagccaggccaggaccgctacttcaccctgggcctgcccaccggcagcacccccctgggctgctacaagaagctgattgagtaccacaagaatggccacctgtccttcaagtatgtgaagaccttcaacatggatgaatatgtgggcctgcccaggaaccaccctgagagctaccacagctacatgtggaacaacttcttcaagcacattgatattgaccccaacaatgcccacatcctggatggaaatgctgctgacctgcaggctgaatgtgatgcctttgagaacaagatcaaggaggccggcggcatcgacctgtttgtgggcggcatcggcccagatggccacatcgccttcaatgaacctggcagcagcctggtgtccaggacccggctgaagaccctggccatggacaccatcctggccaatgccaagtactttgatggagacctgagcaaggtgcccaccatggccctgactgtgggcgtgggcaccgtgatggatgcccgggaggtgatgatcctgatcaccggggcccacaaggcctttgccctgtacaaggccatcgaggagggcgtgaaccacatgtggacagtgtctgccttccagcagcaccccaggaccatctttgtgtgtgatgaagatgccaccctggagctgcgggtgaagacagtgaagtacttcaagggggagcactag

SEQ ID NO: 153839 - DNA, 729 bp, Artificial Sequence
  Description of Artificial Sequence: Synthetic coding sequence
atgaggctggtgatcctggacaactatgacctggccagcgagtgggccgccaagtacatctgcaaccgcatcatccagttcaagccaggccaggaccgctacttcaccctgggcctgcccaccggcctgcccaggaaccaccctgagagctaccacagctacatgtggaacaacttcttcaagcacattgatattgaccccaacaatgcccacatcctggatggaaatgctgctgacctgcaggctgaatgtgatgcctttgagaacaagatcaaggaggccggcggcatcgacctgtttgtgggcggcatcggcccagatggccacatcgccttcaatgaacctggcagcagcctggtgtccaggacccggctgaagaccctggccatggacaccatcctggccaatgccaagtactttgatggagacctgagcaaggtgcccaccatggccctgactgtgggcgtgggcaccgtgatggatgcccgggaggtgatgatcctgatcaccggggcccacaaggcctttgccctgtacaaggccatcgaggagggcgtgaaccacatgtggacagtgtctgccttccagcagcaccccaggaccatctttgtgtgtgatgaagatgccaccctggagctgcgggtgaagacagtgaagtacttcaagggcctgatgcacgtgcacaacaagctggtggaccccctcttctccatgaaggatggcaactag

SEQ ID NO: 153840 - DNA, 1287 bp, Artificial Sequence
  Description of Artificial Sequence: Synthetic coding sequence
atgctgcggaccctgctgcggcggcggctcttctcctaccccaccaagtactacttcatggtgctggtgctgagcctcatcaccttctctgtgctgcgcatccaccagaagccagagtttgtgtctgtgcgccacctggagctggccggggagaaccccagcagtgacatcaactgcaccaaggtgctgcagggagatgtgaatgagatccagaaggtgaagctggagatcctgactgtgaagttcaagaagaggccccgctggaccccagatgactacatcaacatgaccagtgactgcagcagcttcatcaagaggaggaagtacatcgtggagcccctgagcaaggaggaggccgagttccccatcgcctacagcatcgtggtgcaccacaagattgagatgctggaccggctgctgcgggccatctacatgccccagaacttctactgcatccacgtggacaccaagtcagaagattcctacctggccgctgtgatgggcatcgccagctgcttcagcaatgtgtttgtggccagccggctggagagcgtggtgtatgcctcctggagccgggtgcaggccgacctgaactgcatgaaggacctgtatgccatgtctgccaactggaagtacctgatcaacctgtgtggcatggacttccccatcaagaccaacctggagatcgtgaggaagctgaagctgctgatgggagagaacaacctggagacagagaggatgcccagccacaaggaggagcgctggaagaagagatatgaggtggtgaatggcaagctgaccaacacaggaacagtgaagatgctgccccccctggagacccccctcttcagcggcagcgcctactttgtggtgtcccgggagtatgtgggctacgtgctgcagaatgagaagatccagaagctgatggagtgggcccaggacacctacagcccagatgagtacctgtgggccaccatccagagaattcctgaggtgcccggcagcctgcctgccagccacaagtatgacctgagtgacatgcaggccgtggccaggtttgtgaagtggcagtactttgaaggagatgtgtccaaaggagccccctacccaccctgtgatggagtgcacgtgcgctctgtgtgcatctttggagctggggacctgaactggatgctgaggaagcaccacctgtttgccaacaagtttgatgtggatgtggacctgtttgccatccagtgcctggatgagcacctgcggcacaaggccctggagaccctgaagcactag

SEQ ID NO: 153841 - DNA, 1287 bp, Artificial Sequence; identical to SEQ ID NO: 153840
  Description of Artificial Sequence: Synthetic coding sequence

SEQ ID NO: 153842 - DNA, 1287 bp, Artificial Sequence; identical to SEQ ID NO: 153840
  Description of Artificial Sequence: Synthetic coding sequence

SEQ ID NO: 153843 - DNA, 1287 bp, Artificial Sequence; identical to SEQ ID NO: 153840
  Description of Artificial Sequence: Synthetic coding sequence

SEQ ID NO: 153844 - DNA, 1209 bp, Artificial Sequence
  Description of Artificial Sequence: Synthetic coding sequence
atgaacttctggagatactgcttctttgccttcaccctgctgtctgtggtgatctttgtgcgcttctacagcagccagctgagcccccccaagagctatgagaagctgaacagcagcagcgagcgctacttcaggaagacagcctgcaaccacgccctggagaagatgcctgtgttcctgtgggagaacatcctgcccagccccctgcggtctgtgccctgcaaggactacctgacccagaaccactacatcaccagccccctgtctgaggaggaggccgccttccccctggcctacgtgatggtgatccacaaggactttgacacctttgagcggctcttccgggccatctacatgccccagaatgtgtactgtgtgcacgtggatgagaaggccccagctgagtacaaggagagcgtgcggcagctgctgagctgcttccagaatgccttcatcgccagcaagacagagagcgtggtgtatgccggcatcagccggctgcaggccgacctgaactgcctgaaggacctggtggccagcgaggtgccctggaagtatgtgatcaacacctgtggccaggacttccccctgaagaccaaccgggagatcgtgcagcacctgaagggcttcaagggcaagaacatcaccccaggagtgctgcccccagaccacgccatcaagaggaccaagtatgtgcaccaggagcacacagacaagggcggcttctttgtgaagaacaccaacatcctgaagaccagccccccccaccagctgaccatctacttcggcacagcctacgtggccctgacccgggactttgtggactttgtgctgcgggaccagagggccatcgacctgctgcagtggagcaaggacacctacagcccagatgagcacttctgggtgaccctgaacagagtgtctggagtgcccggctccatgcccaatgcctcctggacaggcaacctgcgggccatcaagtggagcgacatggaggacagacatggaggctgccacggccactacgtgcacggcatctgcatctatggaaatggagacctgaagtggctggtgaacagccccagcctgtttgccaacaagtttgagctgaacacctaccccctgactgtggagtgcctggagctgcggcaccgggagaggaccctgaaccagagcgagacagccatccagcccagctggtacttctag

SEQ ID NO: 153845 - DNA, 1203 bp, Artificial Sequence
  Description of Artificial Sequence: Synthetic coding sequence
atgcccctgtccatgagatacctgttcatcatctctgtgtcctctgtcatcatcttcatcgtgttttctgtgttcaactttggaggagaccccagcttccagaggctgaacatcagtgaccccctgcggctgacccaggtgtgcaccagcttcatcaatggcaagacccgcttcctgtggaagaacaagctgatgattcatgagaagagcagctgcaaggagtacctgacccagagccactacatcacagcccccctgagcaaggaggaggccgacttccccctggcctacatcatggtgatccaccaccactttgacacctttgcccggctcttccgggccatctacatgccccagaacatctactgtgtgcacgtggatgagaaggccaccacagagttcaaggatgctgtggagcagctgctgagctgcttccccaatgccttcctggccagcaagatggagcctgtggtgtatggaggcatcagccggctgcaggccgacctgaactgcatccgggacctgagcgcctttgaggtgtcctggaagtatgtgatcaacacctgtggccaggacttccccctgaagaccaacaaggagatcgtgcagtacctgaagggcttcaagggcaagaacatcaccccaggagtgctgcccccagcccacgccatcggccgcaccaagtatgtgcaccaggagcacctgggcaaggagctgtcctatgtgatccgcaccacagccctgaagcccccaccaccccacaacctgaccatctacttcggcagcgcctacgtggccctgagccgggagtttgccaactttgtgctgcatgaccccagggctgtggacctgctgcagtggagcaaggacaccttctccccagatgagcacttctgggtgaccctgaaccgcatccctggggtgcccggctccatgcccaatgcctcctggacaggcaacctgcgggccatcaagtggagcgacatggaggacagacatggaggctgccacggccactacgtgcacggcatctgcatctatggaaatggagacctgaagtggctggtgaacagccccagcctgtttgccaacaagtttgagctgaacacctaccccctgactgtggagtgcctggagctgcggcaccgggagaggaccctgaaccagagcgagacagccatccagcccagctggtacttctag

SEQ ID NO: 153846 - DNA, 1209 bp, Artificial Sequence
  Description of Artificial Sequence: Synthetic coding sequence
atgatgggctcctggaagcactgcctcttcagcgccagcctcatcagcgccctgatctttgtgtttgtgtacaacacagagctgtgggagaacaagcgcttcctgcgggccgccctgagcaatgccagcctgctggccgaggcctgccaccagatctttgagggcaaggtgttctaccccacagaaaatgccctgaagaccaccctggatgaggccacctgctatgagtacatggtgcgcagccactacgtgacagagaccctgtctgaggaggaggccggcttccccctggcctacacagtgaccatccacaaggactttggcacctttgagcggctcttccgggccatctacatgccccagaatgtgtactgtgtgcacctggaccagaaggccacagatgccttcaagggagctgtgaagcagctgctgagctgcttccccaatgccttcctggccagcaagaaggagagcgtggtgtatggaggcatcagccggctgcaggccgacctgaactgcctggaggacctggtggccagcgaggtgccctggaagtatgtgatcaacacctgtggccaggacttccccctgaagaccaaccgggagatcgtgcagtacctgaagggcttcaagggcaagaacatcaccccaggagtgctgcccccagaccatgctgtgggccgcaccaagtatgtgcaccaggagctgctgaaccacaagaacagctatgtgatcaagaccaccaagctgaagaccccacctcctcatgacatggtgatctacttcggcacagcctacgtggccctgacccgggactttgccaactttgtgctgcaggaccagctggccctggacctgctgtcctggagcaaggacacctacagcccagatgagcacttctgggtgaccctgaaccgcatccctggggtgcccggctccatgcccaatgcctcctggacaggcaacctgcgggccatcaagtggagcgacatggaggacagacatggaggctgccacggccactacgtgcacggcatctgcatctatggaaatggagacctgaagtggctggtgaacagccccagcctgtttgccaacaagtttgagctgaacacctaccccctgactgtggagtgcctggagctgcggcaccgggagaggaccctgaaccagagcgagacagccatccagcccagctggtacttctag

SEQ ID NO: 153847 - DNA, 1209 bp, Artificial Sequence; identical to SEQ ID NO: 153846
  Description of Artificial Sequence: Synthetic coding sequence

SEQ ID NO: 153848 - DNA, 1317 bp, Artificial Sequence
  Description of Artificial Sequence: Synthetic coding sequence
atggtgcagtggaagaggctgtgccagctgcactacctgtgggccctgggctgctacatgctgctggccaccgtggccctgaagctgtccttccggctgaagtgtgacagcgaccacctgggcctggagagccgggagagccagagccagtactgcaggaacatcctgtacaacttcctgaagctgcctgccaagaggagcatcaactgcagcggcgtgaccaggggggaccaggaggccgtgctgcaggccatcctgaacaacctggaggtgaagaagaagcgggagcccttcacagacacccactacctgagcctgacccgggactgtgagcacttcaaggccgagaggaagttcatccagttccccctgagcaaggaggaggtggagttccccatcgcctacagcatggtgatccacgagaagattgagaactttgagcggctgctgcgggctgtgtatgccccccagaacatctactgtgtgcacgtggatgagaagagccctgagaccttcaaggaggccgtgaaggccatcatcagctgcttccccaacgtgttcatcgccagcaagctggtgcgggtggtgtatgcctcctggagccgggtgcaggccgacctgaactgcatggaggacctgctgcagagctctgtgccctggaagtacttcctgaacacctgtggcacagacttccccatcaagagcaatgctgagatggtgcaggccctgaagatgctgaatggaagaaattccatggagagcgaggtgccccccaagcacaaggagacccgctggaagtaccactttgaggtggtgcgggacaccctgcacctgaccaacaagaagaaggaccccccaccctacaacctgaccatgttcaccggaaatgcctacatcgtggccagccgggactttgtgcagcacgtgctgaagaaccccaagagccagcagctgattgagtgggtgaaggacacctacagcccagatgagcacctgtgggccaccctgcagagggcccgctggatgcctggctctgtgcccaaccaccccaagtatgacatcagtgacatgaccagcatcgcccggctggtgaagtggcagggccatgaaggagacatcgacaagggggccccctatgccccctgcagcggcatccaccagagggccatctgtgtgtatggagctggggacctgaactggatgctgcagaaccaccacctgctggccaacaagtttgaccccaaggtggatgacaatgccctgcagtgcctggaggagtacctgcgctacaaggccatctacggcacagagctgtag

SEQ ID NO: 153849 - DNA, 264 bp, Artificial Sequence
  Description of Artificial Sequence: Synthetic coding sequence
atggtgcagtggaagaggctgtgccagctgcactacctgtgggccctgggctgctacatgctgctggccaccgtggccctgaagctgtccttccggctgaagtgtgacagcgaccacctgggcctggagagccgggagagccagagccagtactgcaggaacatcctgtacaacttcctgaagctgcctgccaagaggagcatcaactgcagcggcgtgaccaggggggaccaggaggccgtgctgcaggccatcctgaactag

SEQ ID NO: 153850 - DNA, 462 bp, Artificial Sequence
  Description of Artificial Sequence: Synthetic coding sequence
atggtgcagtggaagaggctgtgccagctgcactacctgtgggccctgggctgctacatgctgctggccaccgtggccctgaagctgtccttccggctgaagtgtgacagcgaccacctgggcctggagagccgggagagccagagccagtactgcaggaacatcctgtacaacttcctgaagctgcctgccaagaggagcatcaactgcagcggcgtgaccaggggggaccaggaggccgtgctgcaggccatcctgaacaacctggaggtgaagaagaagcgggagcccttcacagacacccactacctgagcctgacccgggactgtgagcacttcaaggccgagaggaagttcatccagttccccctgagcaaggaggaggtggagttccccatcgcctacagcatggtgatccacgagaagattgagaactttgagcggctgctgcgggctgtgtag

SEQ ID NO: 153851 - DNA, 162 bp, Artificial Sequence
  Description of Artificial Sequence: Synthetic coding sequence
atggtgcagtggaagaggctgtgccagctgcactacctgtgggccctgggctgctacatgctgctggccaccgtggccctgaagctgtccttccggctgaagtgtgacagcgaccacctgggcctggagagccgggagagccagagccagtactgcaggtag

SEQ ID NO: 153852 - DNA, 1317 bp, Artificial Sequence; identical to SEQ ID NO: 153848
  Description of Artificial Sequence: Synthetic coding sequence

SEQ ID NO: 153853 - DNA, 1041 bp, Artificial Sequence
  Description of Artificial Sequence: Synthetic coding sequence
atggagagcaccctgggcgccggcatcgtgattgctgaggccctgcagaaccagctggcctggctggagaatgtgtggctgtggatcaccttcctgggggaccccaagatcctcttcctgttctacttccctgctgcctactatgccagcagaagagtgggcattgctgtgctgtggatcagcctcatcacagagtggctgaacctgatcttcaagtggttcctgtttggagaccggcccttctggtgggtgcatgaaagtggctactacagccaggccccagcccaggtgcaccagttccccagcagctgtgagaccggccctggcagccccagcggccactgcatgatcaccggggccgccctgtggcccatcatgacagccctgagcagccaggtggccacccgggcccggagccgctgggtgcgggtgatgcccagcctggcctactgcaccttcctgctggccgtgggcctgagccgcatcttcatcctggcccacttcccccaccaggtgctggccggcctcatcaccggggctgtgctgggctggctgatgaccccccgggtgcccatggagcgggagctgtccttctacggcctgacagccctggccctgatgctgggcaccagcctcatctactggaccctcttcaccctgggcctggacctgtcctggagcatcagcctggccttcaagtggtgtgagaggcctgagtggatccacgtggacagccggccctttgccagcctgagccgggacagcggggccgccctgggcctgggcatcgccctgcacagcccctgctacgcccaggtgcggcgggcccagctgggcaatggccagaagatcgcctgcctggtgctggccatgggcctgctgggccccctggactggctgggccaccccccccagatcagcctcttctacatcttcaacttcctgaagtacaccctgtggccctgcctggtgctggccctggtgccctgggccgtgcacatgttcagcgcccaggaggccccacccatccacagcagctag

SEQ ID NO: 153854 - DNA, 465 bp, Artificial Sequence
  Description of Artificial Sequence: Synthetic coding sequence
atggacttcctgcacagaaatggagtgctgatcatccagcacctgcagaaggactaccgggcctactacaccttcctgaacttcatgagcaatgtgggggaccccaggaacatcttcttcatctacttccccctgtgcttccagttcaaccagacagtgggcaccaagatgatctgggtggccgtgattggagactggctgaacctgatcttcaagtggatcctgtttggccaccggccctactggtgggtgcaggagacccagatctaccccaaccacagcagcccctgcctggagcagttccccaccacctgtgaaacaggccctggcagccccagcggccacgccatgggcgccagctgtgtgtggtacgtgatggtgacagctgccctgagccacacagtgtgtggcatggacaagttcagcatcaccctgcacagacatgctgggggccggggcctgtag

SEQ ID NO: 153855 - DNA, 1068 bp, Artificial Sequence
  Description of Artificial Sequence: Synthetic coding sequence
atggacttcctgcacagaaatggagtgctgatcatccagcacctgcagaaggactaccgggcctactacaccttcctgaacttcatgagcaatgtgggggaccccaggaacatcttcttcatctacttccccctgtgcttccagttcaaccagacagtgggcaccaagatgatctgggtggccgtgattggagactggctgaacctgatcttcaagtggatcctgtttggccaccggccctactggtgggtgcaggagacccagatctaccccaaccacagcagcccctgcctggagcagttccccaccacctgtgaaacaggccctggcagccccagcggccacgccatgggcgccagctgtgtgtggtacgtgatggtgacagctgccctgagccacacagtgtgtggcatggacaagttcagcatcaccctgcaccggctgacctggagcttcctgtggagcgtcttctggctgatccagatctctgtgtgcatcagcagggtcttcatcgccacccacttcccccaccaggtgatcctgggcgtcatcggcggcatgctggtggccgaggcctttgagcacaccccaggcatccagacagccagcctgggcacctacctgaagaccaacctcttcctgttcctgtttgctgtgggcttctacctgctgctgcgggtgctgaacatcgacctgctgtggagcgtgcccatcgccaagaagtggtgtgccaacccagactggatccacatcgacaccaccccatttgctggcctggtgaggaacctgggcgtgctgtttggcctgggctttgccatcaacagcgagatgttcctgctgagctgccggggcggcaacaactacaccctgtccttccggctgctgtgtgccctgaccagcctgaccatcctgcagctgtaccacttcctgcagatccccacccatgaggagcacctgttctacgtgctgtccttctgcaagagcgccagcatccccctgactgtggtggccttcatcccctacagcgtgcacatgctgatgaagcagagcggcaagaagagccagtag

SEQ ID NO: 153856 - DNA, 1677 bp, Artificial Sequence
  Description of Artificial Sequence: Synthetic coding sequence
atggccgccctgacccgggacccccagttccagaagctgcagcagtggtaccgggagcacaggtctgagctgaacctgcggcggctgtttgatgccaacaaggaccgcttcaaccacttcagcctgaccctgaacaccaaccacggccacatcctggtggactacagcaagaacctggtgacagaagatgtgatgaggatgctggtggacctggccaagagccggggcgtggaggccgcccgggagaggatgttcaacggggagaagatcaactacacagagggccgggctgtgctgcacgtggccctgaggaacagaagcaacacccccatcctggtggatggcaaggatgtgatgcctgaggtgaacaaggtgctggacaagatgaagagcttctgccagagggtgcgcagcggggactggaagggctacacaggcaagaccatcacagatgtgatcaacattggaattggaggcagtgacctgggccccctgatggtgacagaggccctgaagccctacagcagcggcggcccccgggtgtggtacgtgagcaacattgatggcacccacatcgccaagaccctggcccagctgaaccctgagagcagcctcttcatcatcgccagcaagaccttcaccacccaggagaccatcaccaatgctgagacagccaaggagtggttcctgcaggccgccaaggaccccagcgctgtggccaagcactttgtggccctgagcaccaacaccaccaaggtgaaggagtttggcatcgacccccagaacatgtttgagttctgggactgggtgggcggccgctacagcctgtggagcgccatcggcctgagcatcgccctgcacgtgggctttgacaactttgagcagctgctgagcggggcccactggatggaccagcacttccgcaccacccccctggagaagaatgcccctgtgctgctggccctgctgggcatctggtacatcaactgcttcggctgtgagacccacgccatgctgccctatgaccagtacctgcacagatttgctgcctacttccagcagggcgacatggagagcaatggcaagtacatcaccaagagcggcaccagggtggaccaccagacaggccccatcgtgtggggcgagcccggcaccaacggccagcacgccttctaccagctgatccaccagggcaccaagatgatcccctgtgacttcctgatccctgtgcagacccagcaccccatcaggaagggcctgcaccacaagatcctgctggccaacttcctggcccagacagaggccctgatgaggggcaagagcacagaggaggccaggaaggagctgcaggccgccggcaagagccctgaggacctggagcggctgctgccccacaaggtgtttgagggcaaccggcccaccaacagcatcgtgttcaccaagctgacccccttcatgctgggcgccctggtggccatgtatgagcacaagatctttgtgcagggcatcatctgggacatcaacagctttgaccagtggggcgtggagctgggcaagcagctggccaagaagattgagcctgagctggatggcagcgcccaggtgaccagccatgatgccagcaccaacggcctcatcaacttcatcaagcagcagcgggaggcccgggtgcagtag

SEQ ID NO: 153857 - DNA, 1563 bp, Artificial Sequence
  Description of Artificial Sequence: Synthetic coding sequence
agcagacatggccgcagccaccctggcccccctgtgcctgaggccgccgccatggtgccccgggcccccctgcgggcagagcccgccccacccctgcgctgccagcagggccccctgcagcccctgcaggtgcgggccggcagaagaagaggcctgcccagggctgcccctggcactggacatgctggcctgggcagcggcggcggcggcagcggggcccggggcccccagagccccaccagccggcccaggactggagcccaggccgagagcgccctgcggccctggagcctgctgggcgtgcgctcctggggcctggccgccagccctggggtgtctgcccctggcctgctgcgctatgaggagaagagggccccaccctggggccacttccccagcagcagcccctgcagcagcggccacctgagccggggcagcttccgcagctgtgaggagcggccctggctgacccagcaggccggcaagggctgccccttccccagcgcccctggccacatgagcctgggcgccagcgctggccgggccgcccgggccggcgtgtttgagggcgccggctggaaggatggagatgtgggccgggacagctgccgccgccacctgtgcaccaccgggaagtgggagggcgtgtttgagcagatcatgggcggcagcgctgccaagggggccctgatcacagacaccggcggcggcggcggcggggagcggctgtggctgcgggcccggcggccagatggccacccctgccacctggatggctgcctgagcaacctgcggcagaaggtggaggccctgggccggggcggcccccccctgcagagcggcctgctgatccagggcctgcctgccagcacagtgtgtgaagatggcttcttcctgtgggccgctgtggccgaccaccctgggggccctgctggggacagacaccaccactgtgccggctggccccggcccctgtggggcgtgggccagggcggctgcttcttctgggagcagctgctgctgcgggcctggctgcctgcccgggagaccagggtgtggagcgctgccagccccagcttctgcagcctgaccctgaacaccaaccacggccacatcctggtggactacagcaagaacctggtgacagaagatgtgatgaggatgctggtggacctggccaagagcagaggagtggaggccgcccgggagaggatgtttaatggagagaagatcaactacacagaggtgtcccggccccacatccccagcggggccagcttcctgcccttcggcgtgtacctgactgtgagccgcatcaccctgtgcctgcaccccttctcctgggccatgctgctgctgaatgaaggacctgagggcctcttccccccagcctgcagccgggccctgggctgtgccttccacaagattggcctggtgagcagcctggagtggttccctgtgtctgcctgggaggagcacatctcctacccccagggcgagttcctgaaggctgacatcttcctggagaagctgaccctcatctacccccagtgcaagttctag

SEQ ID NO: 153858 - DNA, 1710 bp, Artificial Sequence
  Description of Artificial Sequence: Synthetic coding sequence
atggtggccctgtgcagcctgcagcacctgggcagcagtgacccccgggccctgcccaccctgcccacagccaccagcggccagaggcctgccaagagaagaaggaagagccctgccatggccgccctgacccgggacccccagttccagaagctgcagcagtggtaccgggagcacaggtctgagctgaacctgcggcggctgtttgatgccaacaaggaccgcttcaaccacttcagcctgaccctgaacaccaaccacggccacatcctggtggactacagcaagaacctggtgacagaagatgtgatgaggatgctggtggacctggccaagagcagaggagtggaggccgcccgggagaggatgtttaatggagagaagatcaactacacagagggccgggctgtgctgcacgtggccctgaggaacagaagcaacacccccatcctggtggatggcaaggatgtgatgcctgaggtgaacaaggtgctggacaagatgaagagcttctgccagggccccctgatggtgacagaggccctgaagccctacagcagcggcggcccccgggtgtggtacgtgagcaacattgatggcacccacatcgccaagaccctggcccagctgaaccctgagagcagcctcttcatcatcgccagcaagaccttcaccacccaggagaccatcaccaatgctgagacagccaaggagtggttcctgcaggccgccaaggaccccagcgctgtggccaagcactttgtggccctgagcaccaacaccaccaaggtgaaggagtttggaattgacccccagaacatgtttgagttctgggactgggtgggcggccgctacagcctgtggagcgccatcggcctgagcatcgccctgcacgtgggctttgacaactttgagcagctgctgagcggggcccactggatggaccagcacttccgcaccacccccctggagaagaatgcccctgtgctgctggccctgctgggcatctggtacatcaactgcttcggctgtgagacccacgccatgctgccctatgaccagtacctgcacagatttgctgcctacttccagcagggcgacatggagagcaatggcaagtacatcaccaagagcggcaccagggtggaccaccagacaggccccatcgtgtggggcgagcccggcaccaacggccagcacgccttctaccagctgatccaccagggcaccaagatgatcccctgtgacttcctgatccctgtgcagacccagcaccccatcaggaagggcctgcaccacaagatcctgctggccaacttcctggcccagacagaggccctgatgaggggcaagagcacagaggaggccaggaaggagctgcaggccgccggcaagagccctgaggacctggagcggctgctgccccacaaggtgtttgagggcaaccggcccaccaacagcatcgtgttcaccaagctgacccccttcatgctgggcgccctggtggccatgtatgagcacaagatctttgtgcagggcatcatctgggacatcaacagctttgaccagtggggcgtggagctgggcaagcagctggccaagaagattgagcctgagctggatggcagcgcccaggtgaccagccatgatgccagcaccaacggcctcatcaacttcatcaagcagcagcgggaggcccgggtgcagtag

SEQ ID NO: 153859 - DNA, 2901 bp, Artificial Sequence
  Description of Artificial Sequence: Synthetic coding sequence
atggctgctgtggccgctgtggccgccaggagaagaagatcctgggccagcctggtgctggccttcctgggcgtgtgcctgggcatcaccctggccgtggacaggagcaacttcaagacctgtgaggagagcagcttctgcaagaggcagaggagcatccggcccggcctgagcccctaccgggccctgctggacagcctgcagctgggccctgacagcctgactgtgcacctgatccacgaggtgaccaaggtgctgctggtgctggagctgcagggcctgcagaagaacatgacccgcttcagaattgatgagctggagccccggcggccccgctacagagtgcctgatgtgctggtggccgacccccccatcgcccggctgtctgtgtctggaagagatgaaaattctgtggagctgaccatggccgagggcccctacaagatcatcctgacagcccggcccttccggctggacctgctggaggacaggagcctgctgctgtctgtgaatgcccggggcctgctggagtttgagcaccagagggccccccgggtgtccttcagtgacaaggtgaacctgaccctgggcagcatctgggacaagatcaagaacctcttcagccggcagggcagcaaggaccctgcagaaggagatggagcccagcctgaggagaccccaagagatggagacaagccagaggagacccagggcaaggccgagaaggatgagcccggggcctgggaggagaccttcaagacccacagcgacagcaagccctacggccccatgtctgtgggcctggacttcagcctgcccggcatggagcacgtgtatggcatccctgagcacgccgacaacctgcggctgaaggtgacagaaggaggagagccctaccgcctgtacaacctggatgtgttccagtatgagctgtacaaccccatggccctgtatggctctgtgcctgtgctgctggcccacaacccccaccgggacctgggcatcttctggctgaatgctgctgagacctgggtggacatcagcagcaacacagctgggaagaccctgtttgggaagatgatggactacctgcagggcagcggggagaccccccagacagatgtgcgctggatgtctgaaacaggcatcattgatgtgttcctgctgctgggccccagcatcagtgatgtgttccggcagtatgccagcctgaccggcacccaggccctgcccccactcttcagcctgggctaccaccagagccgctggaactacagagatgaagcagatgtgctggaggtggaccagggctttgatgaccacaacctgccctgtgatgtgatctggctggacatcgagcacgcagatggcaagcgctacttcacctgggaccccagccgcttcccccagcccaggaccatgctggagcggctggccagcaagaggaggaagctggtggccatcgtggacccccacatcaaggtggacagcggctacagagtgcatgaggagctgaggaacctgggcctgtatgtgaagaccagagatggcagtgactatgagggctggtgctggccaggcagcgctggctacccagacttcaccaaccccaccatgagggcctggtgggccaacatgttctcctatgacaactatgagggcagcgcccccaacctgtttgtgtggaatgacatgaatgagcccagcgtcttcaacggccctgaggtgaccatgctgaaggatgcccagcactatggaggctgggagcacagagatgtgcacaacatctacggcctgtatgtgcacatggccacagcagatggcctgcggcagaggtctgggggcatggagcggccctttgtgctggcccgggccttctttgctggcagccagagatttggagctgtgtggacaggagacaacacagctgagtgggaccacctgaagatcagcatccccatgtgcctgagcctgggcctggtgggcctgtccttctgtggggctgatgtgggcggcttcttcaagaaccctgagcctgagctgctggtgcgctggtaccagatgggcgcctaccagcccttcttccgggcccacgcccacctggacacaggaagaagagagccctggctgctgcccagccagcacaatgacatcatcagagatgccctgggccagcgctacagcctgctgcccttctggtacaccctgctgtaccaggcccaccgggagggcatccctgtgatgaggcccctgtgggtgcagtacccccaggatgtgaccaccttcaacattgatgaccagtacctgctgggagatgccctgctggtgcaccctgtgtctgacagcggggcccatggagtgcaggtgtacctgcccggccagggcgaggtgtggtatgacatccagagctaccagaagcaccacggcccccagaccctgtacctgcctgtgaccctgagcagcatccctgtgttccagaggggcggcaccatcgtgccccgctggatgagggtgagaagaagcagcgagtgcatgaaggatgaccccatcaccctgtttgtggccctgagcccccagggcacagcccagggcgagctgttcctggatgatggccacaccttcaactaccagacccggcaggagttcctgctgcggcgcttctccttcagcggcaacaccctggtgagcagcagcgctgaccctgagggccactttgagacccccatctggattgagcgggtggtgatcattggagctgggaagccagctgctgtggtgctgcagaccaagggcagccctgagagccggctgtccttccagcacgaccctgagacctctgtgctggtgctgaggaagccaggcatcaacgtggccagtgactggagcatccacctgaggtag

SEQ ID NO: 153860 - DNA, 2835 bp, Artificial Sequence
  Description of Artificial Sequence: Synthetic coding sequence
atggctgctgtggccgctgtggccgccaggagaagaagatcctgggccagcctggtgctggccttcctgggcgtgtgcctgggcatcaccctggccgtggacaggagcaacttcaagacctgtgaggagagcagcttctgcaagaggcagaggagcatccggcccggcctgagcccctaccgggccctgctggacagcctgcagctgggccctgacagcctgactgtgcacctgatccacgaggtgaccaaggtgctgctggtgctggagctgcagggcctgcagaagaacatgacccgcttcagaattgatgagctggagccccggcggccccgctacagagtgcctgatgtgctggtggccgacccccccatcgcccggctgtctgtgtctggaagagatgaaaattctgtggagctgaccatggccgagggcccctacaagatcatcctgacagcccggcccttccggctggacctgctggaggacaggagcctgctgctgtctgtgaatgcccggggcctgctggagtttgagcaccagagggccccccgggtgtcccagggcagcaaggaccctgcagaaggagatggagcccagcctgaggagaccccaagagatggagacaagccagaggagacccagggcaaggccgagaaggatgagcccggggcctgggaggagaccttcaagacccacagcgacagcaagccctacggccccatgtctgtgggcctggacttcagcctgcccggcatggagcacgtgtatggcatccctgagcacgccgacaacctgcggctgaaggtgacagaaggaggagagccctaccgcctgtacaacctggatgtgttccagtatgagctgtacaaccccatggccctgtatggctctgtgcctgtgctgctggcccacaacccccaccgggacctgggcatcttctggctgaatgctgctgagacctgggtggacatcagcagcaacacagctgggaagaccctgtttgggaagatgatggactacctgcagggcagcggggagaccccccagacagatgtgcgctggatgtctgaaacaggcatcattgatgtgttcctgctgctgggccccagcatcagtgatgtgttccggcagtatgccagcctgaccggcacccaggccctgcccccactcttcagcctgggctaccaccagagccgctggaactacagagatgaagcagatgtgctggaggtggaccagggctttgatgaccacaacctgccctgtgatgtgatctggctggacatcgagcacgcagatggcaagcgctacttcacctgggaccccagccgcttcccccagcccaggaccatgctggagcggctggccagcaagaggaggaagctggtggccatcgtggacccccacatcaaggtggacagcggctacagagtgcatgaggagctgaggaacctgggcctgtatgtgaagaccagagatggcagtgactatgagggctggtgctggccaggcagcgctggctacccagacttcaccaaccccaccatgagggcctggtgggccaacatgttctcctatgacaactatgagggcagcgcccccaacctgtttgtgtggaatgacatgaatgagcccagcgtcttcaacggccctgaggtgaccatgctgaaggatgcccagcactatggaggctgggagcacagagatgtgcacaacatctacggcctgtatgtgcacatggccacagcagatggcctgcggcagaggtctgggggcatggagcggccctttgtgctggcccgggccttctttgctggcagccagagatttggagctgtgtggacaggagacaacacagctgagtgggaccacctgaagatcagcatccccatgtgcctgagcctgggcctggtgggcctgtccttctgtggggctgatgtgggcggcttcttcaagaaccctgagcctgagctgctggtgcgctggtaccagatgggcgcctaccagcccttcttccgggcccacgcccacctggacacaggaagaagagagccctggctgctgcccagccagcacaatgacatcatcagagatgccctgggccagcgctacagcctgctgcccttctggtacaccctgctgtaccaggcccaccgggagggcatccctgtgatgaggcccctgtgggtgcagtacccccaggatgtgaccaccttcaacattgatgaccagtacctgctgggagatgccctgctggtgcaccctgtgtctgacagcggggcccatggagtgcaggtgtacctgcccggccagggcgaggtgtggtatgacatccagagctaccagaagcaccacggcccccagaccctgtacctgcctgtgaccctgagcagcatccctgtgttccagaggggcggcaccatcgtgccccgctggatgagggtgagaagaagcagcgagtgcatgaaggatgaccccatcaccctgtttgtggccctgagcccccagggcacagcccagggcgagctgttcctggatgatggccacaccttcaactaccagacccggcaggagttcctgctgcggcgcttctccttcagcggcaacaccctggtgagcagcagcgctgaccctgagggccactttgagacccccatctggattgagcgggtggtgatcattggagctgggaagccagctgctgtggtgctgcagaccaagggcagccctgagagccggctgtccttccagcacgaccctgagacctctgtgctggtgctgaggaagccaggcatcaacgtggccagtgactggagcatccacctgaggtag

SEQ ID NO: 153861 - DNA, 2544 bp, Artificial Sequence
  Description of Artificial Sequence: Synthetic coding sequence
atgacccgcttcagaattgatgagctggagccccggcggccccgctacagagtgcctgatgtgctggtggccgacccccccatcgcccggctgtctgtgtctggaagagatgagaacagcgtggagctgaccatggccgagggcccctacaagatcatcctgacagcccggcccttccggctggacctgctggaggacaggagcctgctgctgtctgtgaatgcccggggcctgctggagtttgagcaccagagggccccccgggtgtcccagggcagcaaggaccctgcagaaggagatggagcccagcctgaggagaccccaagagatggagacaagccagaggagacccagggcaaggccgagaaggatgagcccggggcctgggaggagaccttcaagacccacagcgacagcaagccctacggccccatgtctgtgggcctggacttcagcctgcccggcatggagcacgtgtatggcatccctgagcacgccgacaacctgcggctgaaggtgacagagggcggggagccctaccgcctgtacaacctggatgtgttccagtatgagctgtacaaccccatggccctgtatggctctgtgcctgtgctgctggcccacaacccccaccgggacctgggcatcttctggctgaatgctgctgagacctgggtggacatcagcagcaacacagctgggaagaccctgtttgggaagatgatggactacctgcagggcagcggggagaccccccagacagatgtgcgctggatgtctgagaccggcatcattgatgtgttcctgctgctgggccccagcatcagtgatgtgttccggcagtatgccagcctgaccggcacccaggccctgcccccactcttcagcctgggctaccaccagagccgctggaactacagagatgaagcagatgtgctggaggtggaccagggctttgatgaccacaacctgccctgtgatgtgatctggctggacattgaacatgctgatggcaagcgctacttcacctgggaccccagccgcttcccccagcccaggaccatgctggagcggctggccagcaagaggaggaagctggtggccatcgtggacccccacatcaaggtggacagcggctacagagtgcatgaggagctgaggaacctgggcctgtatgtgaagaccagagatggcagtgactatgagggctggtgctggccaggcagcgctggctacccagacttcaccaaccccaccatgagggcctggtgggccaacatgttctcctatgacaactatgagggcagcgcccccaacctgtttgtgtggaatgacatgaatgagcccagcgtcttcaatggacctgaggtgaccatgctgaaggatgcccagcactacggcggctgggagcacagagatgtgcacaacatctacggcctgtatgtgcacatggccacagcagatggcctgcggcagaggtctgggggcatggagcggccctttgtgctggcccgggccttctttgctggcagccagagatttggagctgtgtggacaggagacaacacagctgagtgggaccacctgaagatcagcatccccatgtgcctgagcctgggcctggtgggcctgtccttctgtggggctgatgtgggcggcttcttcaagaaccctgagcctgagctgctggtgcgctggtaccagatgggcgcctaccagcccttcttccgggcccacgcccacctggacaccggccggcgggagccctggctgctgcccagccagcacaatgacatcatcagagatgccctgggccagcgctacagcctgctgcccttctggtacaccctgctgtaccaggcccaccgggagggcatccctgtgatgaggcccctgtgggtgcagtacccccaggatgtgaccaccttcaacattgatgaccagtacctgctgggagatgccctgctggtgcaccctgtgtctgattctggggcccacggcgtgcaggtgtacctgcccggccagggcgaggtgtggtatgacatccagagctaccagaagcaccacggcccccagaccctgtacctgcctgtgaccctgagcagcatccctgtgttccagagaggaggcaccatcgtgccccgctggatgagggtgcggcgcagcagcgagtgcatgaaggatgaccccatcaccctgtttgtggccctgagcccccagggcacagcccagggcgagctgttcctggatgatggccacaccttcaactaccagacccggcaggagttcctgctgcggcgcttctccttcagcggcaacaccctggtgagcagcagcgctgaccctgagggccactttgagacccccatctggattgaaagagtggtgatcatcggggccggcaagccagctgctgtggtgctgcagaccaagggcagccctgagagccggctgtccttccagcacgaccctgagacctctgtgctggtgctgaggaagccaggcatcaacgtggccagtgactggagcatccacctgaggtag

SEQ ID NO: 153862 - DNA, 2745 bp, Artificial Sequence
  Description of Artificial Sequence: Synthetic coding sequence
atggaggccgctgtgaaggaggagatcagcctggaggatgaagctgtggacaagaacatcttccgggactgcaacaagatcgccttctaccgccggcagaagcagtggctgagcaagaagagcacctaccaggccctgctggacagcgtgaccacagatgaggacagcacccgcttccagatcatcaatgaggccagcaaggtgcccctgctggccgagatctatggaattgagggcaacatcttccggctgaagatcaatgaggagacccccctgaagcccaggtttgaggtgcctgatgtgctgaccagcaagcccagcacagtgcggctcatcagctgcagcggggacaccggcagcctcatcctggctgatggaaaaggagacctgaagtgccacatcacagccaaccccttcaaggtggacctggtgtctgaggaggaggtggtgatcagcatcaacagcctgggccagctgtactttgagcacctgcagatcctgcacaagcagagagctgccaaggaaaatgaggaggagacctctgtggacaccagccaggagaaccaggaggacctgggcctgtgggaggagaagtttgggaagtttgtggacatcaaggccaacggccccagcagcatcggcctggacttcagcctgcacggctttgagcacctgtatggcatcccccagcacgccgagagccaccagctgaagaacacaggagatggagatgcctaccgcctgtacaacctggatgtgtatggctaccagatctatgacaagatgggcatctacggctctgtgccctacctgctggcccacaagctgggccgcaccatcggcatcttctggctgaatgccagcgagaccctggtggagatcaacacagagcctgctgtggagtacaccctgacccagatgggccctgtggccgccaagcagaaggtgcgcagcaggacccacgtgcactggatgtctgagagcggcatcattgatgtgttcctgctgaccggccccacccccagtgatgtgttcaagcagtacagccacctgaccggcacccaggccatgccacccctcttcagcctgggctaccaccagtgccgctggaactatgaagatgagcaggatgtgaaggctgtggatgctggctttgatgaacatgacatcccctatgatgccatgtggctggacatcgagcacacagagggcaagcgctacttcacctgggacaagaaccgcttccccaaccccaagaggatgcaggagctgctgcggagcaagaagaggaagctggtggtgatcagtgacccccacatcaagattgatcctgactacagcgtgtatgtgaaggccaaggaccagggcttctttgtgaagaaccaggagggagaagattttgaaggagtgtgctggccaggcctgagcagctacctggacttcaccaaccccaaggtgcgggagtggtacagcagcctgtttgccttccctgtgtaccagggcagcacagacatcctcttcctgtggaatgacatgaatgagcccagcgtcttccggggccctgagcagaccatgcagaagaatgccatccaccacggcaactgggagcaccgggagctgcacaacatctacggcttctaccaccagatggccacagctgagggcctcatcaagaggagcaagggcaaggagcggccctttgtgctgaccaggagcttctttgctggcagccagaagtacggggctgtgtggacaggagacaacacagctgagtggagcaacctgaagatcagcatccccatgctgctgaccctgagcatcaccggcatctccttctgtggggctgacattggaggcttcatcggcaaccctgagacagagctgctggtgcgctggtaccaggccggggcctaccagcccttcttccggggccacgccaccatgaacaccaagaggcgggagccctggctgtttggagaggagcacaccaggctcatccgggaggccatccgggagagatatggcctgctgccctactggtacagcctcttctaccacgcccacgtggccagccagcctgtgatgaggcccctgtgggtggagttcccagatgagctgaagacctttgacatggaggatgagtacatgctgggcagcgccctgctggtgcaccctgtgacagagcccaaggccaccaccgtggatgtgttcctgcccggcagcaatgaggtgtggtatgactacaagacctttgcccactgggagggcggctgcaccgtgaagatccctgtggccctggacaccatccctgtgttccagagaggaggcagcgtcatccccatcaagaccaccgtgggcaagagcacaggctggatgacagagagcagctatggcctgcgggtggccctgagcaccaagggcagctctgtgggggagctgtacctggatgatggccacagcttccagtacctgcaccagaagcagttcctgcacaggaagttctccttctgcagctctgtgctgatcaacagctttgctgaccagaggggccactaccccagcaaatgtgtggtggagaagatcctggtgctgggcttcaggaaggagcccagctctgtgaccacccacagcagtgatggcaaggaccagcctgtggccttcacctactgtgccaagaccagcatcctgagcctggagaagctgagcctgaacatcgccacagactgggaggtgcgcatcatctag

SEQ ID NO: 153863 - DNA, 849 bp, Artificial Sequence
  Description of Artificial Sequence: Synthetic coding sequence
atggaggccgctgtgaaggaggagatcagcctggaggatgaagctgtggacaagaacatcttccgggactgcaacaagatcgccttctaccgccggcagaagcagtggctgagcaagaagagcacctaccaggccctgctggacagcgtgaccacagatgaggacagcacccgcttccagatcatcaatgaggccagcaaggtgcgctgccaggaccagagccccaccaccctggatgccttcaagggcaaggagaccaccgtgcaggaggagacccaggacctgagcacccggcagcacctggcccagaaggaggccgaggagccagacaagcagggccagatcacctgggacatcagcaatgtggcccccaagacagaaaattttgaggacctgctggagcagaccccctgcagcgcctgcctgcagggcttcacccgggacaacaccagcagcagcttctctgaagatgctggcatcagcctgagcacctctgtgaagctgcccctggccagcagcagcaagcccaatgaaaatgaggccctgcccaaccagccccccagccagcagatccgccacaactaccgcctgctggccagcacagtgtctgctgagatggccaggaaccggcagctgatctgggagctggcccggcagagcgaggcccacctggacaggcctgtggtgctgggggagcaggccagcgcccagcgggaggtggccagcatcctgtgcaggaagtctgtgctggccatcaaccagctggccgccaccgtggagggcaccatctctgtgctgcagcagttcaatgagctgctggaccaccccctggaccccggccgctcctag

SEQ ID NO: 153864 - DNA, 1230 bp, Artificial Sequence
  Description of Artificial Sequence: Synthetic coding sequence
atgaggcgctacctgcgggtggtggtgctgtgtgtggcctgtggcttctgcagcctgctgtatgccttcagccagctggccgtgtccctggaggagggcaccggcggcggcggcggcaagccccaggccgctgtggcctcctggctggccggcggcggccgcggggctgtgcggggggccggcgtggccggccctgctgcccaccctggggtgtctgaccgctacagcctgaagatccagcctgtggagaagatgcacctggccgtggtggcctgtggggagcggctggaggagaccatgaccatgctgaagagcgccatcatcttcagcatcaagcccctgcagttccacatctttgctgaggaccagctgcaccacagcttcaagggccgcctggacaactggagcttcctgcagaccttcaactacaccctgtaccccatcaccttccccagtgaaaatgctgctgagtggaagaagctgttcaagccctgtgccagccagaggctcttcctgcccctcatcctgaaggaggtggacagcctgctgtatgtggacacagacatcctcttcctgcggcctgtggatgacatctggagcctgctgaagaagttcaacagcacccagattgctgccatggcccctgagcacgaggagccccgcatcggctggtacaacagatttgcccggcacccctactacggcaagacaggagtgaacagcggcgtgatgctgatgaacatgaccaggatgaggaggaagtacttcaagaatgacatgaccaccgtgcggctgcagtggggagacatcctgatgcccctgctgaagaagtacaagctgaacatcacctggggagaccaggacctgctgaacatcgtgttcttccacaaccctgagagcctgtttgtgttcccctgccagtggaactacagaccagaccactgcatctacggcagcaactgccaggaggccgaggagggcggcatcttcatcctgcacggcaacagaggagtgtaccatgatgacaagcagcctgccttccgggctgtgtatgaggccctgaggaactgcagctttgaagatgacaacatccgcagcctgctgaagcccctggagctggagctgcagaagacagtgcacacctactgcggcaagatctacaagatcttcatcaagcagctggccaagtctgtgcgggacagatatgcccggagccccaaggagaagtag

SEQ ID NO: 153865 - DNA, 1323 bp, Artificial Sequence
  Description of Artificial Sequence: Synthetic coding sequence
atgaggcgctacctgcgggtggtggtgctgtgtgtggcctgtggcttctgcagcctgctgtatgccttcagccagctggccgtgtccctggaggagggcaccggcggcggcggcggcaagccccaggccgctgtggcctcctggctggccggcggcggccgcggggctgtgcggggggccggcgtggccggccctgctgcccaccctggggtgtctgaccgctgcaaggacttcagcctgtgctactggaacccctactggatgctgcccagtgatgtgtgtggcatgaactgcttctgggaggccgccttccgctacagcctgaagatccagcctgtggagaagatgcacctggccgtggtggcctgtggggagcggctggaggagaccatgaccatgctgaagagcgccatcatcttcagcatcaagcccctgcagttccacatctttgctgaggaccagctgcaccacagcttcaagggccgcctggacaactggagcttcctgcagaccttcaactacaccctgtaccccatcaccttccccagtgaaaatgctgctgagtggaagaagctgttcaagccctgtgccagccagaggctcttcctgcccctcatcctgaaggaggtggacagcctgctgtatgtggacacagacatcctcttcctgcggcctgtggatgacatctggagcctgctgaagaagttcaacagcacccagattgctgccatggcccctgagcacgaggagcccagaattggctggtacaacagatttgcccggcacccctactacggcaagacaggagtgaacagcggcgtgatgctgatgaacatgaccaggatgaggaggaagtacttcaagaatgacatgaccaccgtgcggctgcagtggggagacatcctgatgcccctgctgaagaagtacaagctgaacatcacctggggagaccaggacctgctgaacatcgtgttcttccacaaccctgagagcctgtttgtgttcccctgccagtggaactacagaccagaccactgcatctacggcagcaactgccaggaggccgaggagggcggcatcttcatcctgcacggcaacagaggagtgtaccatgatgacaagcagcctgccttccgggctgtgtatgaggccctgaggaactgcagctttgaagatgacaacatccgcagcctgctgaagcccctggagctggagctgcagaagacagtgcacacctactgtgggaagatctacaagatcttcatcaagcagctggccaagtctgtgcgggacagatatgcccggagccccaaggagaagtag

SEQ ID NO: 153866 - DNA, 1332 bp, Artificial Sequence
  Description of Artificial Sequence: Synthetic coding sequence
atgaagctgcggagcaaggccgccgccctgctgctgctggccctggccgccctgctgctggccctgctgagcctgcgggccggccgggcagagcccccagccctgcctgcccggcctgccagcgccccccagaggcacccagcccctgtgcctgcccgctggccaggccctggggccctgcccggggccagccctggggtgagaagaagaagaccaccccggccccggcccagggctggaagaagaggagctgcccggctggagaagctggcccggcggcctggagagcccaggagcttccaggccgtgctgcccccagagctgtggatccacctggccgtggtggcctgtggcaaccggctggaggagaccctggtgatgctgaagtctgctgtgctcttcagccacaggaagatccagttccacatcttcacagaggacagcctgaagccagagtttgacaagcagctgcggcagtggccagacagctacaccaagaagtttgagcaccgcatctaccccatcaccttctctgtgggcaacccccaggagtggaagaagctgttcaagccctgtgccgcccagaggctcttcctgcccgtcatcctgaaggatgtggacagcctgctgtatgtggacacagatgtgctcttcctgcggcctgtggatgacatctggaagctgctgcggctcttcaacagcacccagctggccgccatggcccctgagcacgagatccccaagattggctggtacagcagatttgcccggcaccccttctacggcagcgctggggtgaacagcggcgtgatgctgatgaacctgacccgcatccgcagcacccagttcaagaacagcatgatccccaccggcctggcctgggaggacatgctgtaccccctgtaccagaagtacaagaatgccatcacctggggagaccaggacctgctgaacatcatcttctacttcaaccctgagtgcctgtatgtgttcccctgccagtggaactacagaccagaccactgcatgtatggcagcaactgccgggaggccgagcatgaaggagtgtctgtgctgcacggcaacagaggagtgtaccatgatgacaagcagcccaccttccgggccctgtatgaggccatccgggacttccccttccaggacaacctcttccagagcatgtactaccccctgcagctgaagttcctggagaccgtgcacaccctgtgtggccgcatcccccaggtgttcctgaagcagatcgagaagaccatgaagagggcctatgagaagcacgtgatcatccacgtgggccccaaccagatgcactag

SEQ ID NO: 153867 - DNA, 1854 bp, Artificial Sequence
  Description of Artificial Sequence: Synthetic coding sequence
atgcgctgcctggccgcccgggtgaactacaagaccctcatcatcatctgtgccctcttcaccctggtgacagtgctgctgtggaacaagtgcagcagtgacaaggccatccagttccccaggaggagcagcagcggcttccgggtggatggctttgagaagagagctgctgccagcgagagcaacaactacatgaaccacgtggccaagcagcagagcgaggaggccttcccccaggagcagcagaaggcccctcctgtggtgggcggcttcaacagcaatgtgggcagcaaggtgctgggcctgaagtatgaggagattgactgcctgatcaatgatgagcacaccatcaagggccggcgggagggcaatgaggtgttcctgcccttcacctgggtggagaagtactttgatgtgtatggcaaggtggtgcagtatgatggctatgacagatttgagttcagccacagctacagcaaggtgtatgcccagagggccccctaccacccagatggagtcttcatgagctttgagggctacaacgtggaggtgcgggacagagtgaagtgcatcagcggcgtggagggcgtgcccctgagcacccagtggggcccccagggctacttctaccccatccagatcgcccagtatggcctgagccactacagcaagaacctgacagagaagccaccccacatcgaggtgtatgaaacagctgaggaccgggacaagaacaagcccaatgactggacagtgcccaagggctgcttcatggccaacgtggccgacaagagccgcttcaccaacgtgaagcagttcatcgcccctgagaccagcgagggcgtgtccctgcagctgggcaacaccaaggacttcatcatcagctttgacctgaagttcctgaccaatggatctgtgtctgtggtgctggagaccacagagaagaaccagctgttcaccatccactacgtgtccaatgcccagctgattgccttcaaggagcgggacatctactatggaattggccccaggacctcctggagcacagtgacccgggacctggtgacagacctgaggaagggcgtgggcctgagcaacaccaaggctgtgaagcccaccaagatcatgcccaagaaggtggtgcggctcatcgccaagggcaagggcttcctggacaacatcaccatcagcaccacagcccacatggccgccttctttgctgccagtgactggctggtgaggaaccaggatgagaagggcggctggcccatcatggtgaccaggaagctgggggagggcttcaagagcctggagcccggctggtacagcgccatggcccagggccaggccatcagcaccctggtgcgggcctacctgctgaccaaggaccacatcttcctgaacagcgccctgcgggccacagccccctacaagttcctgtctgagcagcacggcgtgaaggctgtgttcatgaacaagcatgactggtatgaggagtaccccaccacccccagcagctttgtgctgaatggcttcatgtacagcctgattggcctgtatgacctgaaggagacagctggggagaagctgggcaaggaggcccggagcctgtatgaaagaggcatggagagcctgaaggccatgctgcccctgtatgacaccggcagcggcaccatctatgacctgcggcacttcatgctgggcatcgcccccaacctggcccgctgggactaccacaccacccacatcaaccagctgcagctgctgagcaccattgatgagagccctgtgttcaaggagtttgtgaagcgctggaagagctacctgaagggcagccgggccaagcacaactag

SEQ ID NO: 153868 - DNA, 1662 bp, Artificial Sequence
  Description of Artificial Sequence: Synthetic coding sequence
atgaaccacgtggccaagcagcagagcgaggaggccttcccccaggagcagcagaaggcccctcctgtggtgggcggcttcaacagcaatgtgggcagcaaggtgctgggcctgaagtatgaggagattgactgcctgatcaatgatgagcacaccatcaagggccggcgggagggcaatgaggtgttcctgcccttcacctgggtggagaagtactttgatgtgtatggcaaggtggtgcagtatgatggctatgacagatttgagttcagccacagctacagcaaggtgtatgcccagagggccccctaccacccagatggagtcttcatgagctttgagggctacaacgtggaggtgcgggacagagtgaagtgcatcagcggcgtggagggcgtgcccctgagcacccagtggggcccccagggctacttctaccccatccagatcgcccagtatggcctgagccactacagcaagaacctgacagagaagccaccccacatcgaggtgtatgaaacagctgaggaccgggacaagaacaagcccaatgactggacagtgcccaagggctgcttcatggccaacgtggccgacaagagccgcttcaccaacgtgaagcagttcatcgcccctgagaccagcgagggcgtgtccctgcagctgggcaacaccaaggacttcatcatcagctttgacctgaagttcctgaccaatggatctgtgtctgtggtgctggagaccacagagaagaaccagctgttcaccatccactacgtgtccaatgcccagctgattgccttcaaggagcgggacatctactatggaattggccccaggacctcctggagcacagtgacccgggacctggtgacagacctgaggaagggcgtgggcctgagcaacaccaaggctgtgaagcccaccaagatcatgcccaagaaggtggtgcggctcatcgccaagggcaagggcttcctggacaacatcaccatcagcaccacagcccacatggccgccttctttgctgccagtgactggctggtgaggaaccaggatgagaagggcggctggcccatcatggtgaccaggaagctgggggagggcttcaagagcctggagcccggctggtacagcgccatggcccagggccaggccatcagcaccctggtgcgggcctacctgctgaccaaggaccacatcttcctgaacagcgccctgcgggccacagccccctacaagttcctgtctgagcagcacggcgtgaaggctgtgttcatgaacaagcatgactggtatgaggagtaccccaccacccccagcagctttgtgctgaatggcttcatgtacagcctgattggcctgtatgacctgaaggagacagctggggagaagctgggcaaggaggcccggagcctgtatgaaagaggcatggagagcctgaaggccatgctgcccctgtatgacaccggcagcggcaccatctatgacctgcggcacttcatgctgggcatcgcccccaacctggcccgctgggactaccacaccacccacatcaaccagctgcagctgctgagcaccattgatgagagccctgtgttcaaggagtttgtgaagcgctggaagagctacctgaagggcagccgggccaagcacaactag

SEQ ID NO: 153869 - DNA, 1956 bp, Artificial Sequence
  Description of Artificial Sequence: Synthetic coding sequence
atggcccggggcagcgctgtggcctgggccgccctgggccccctgctgtggggctgtgccctgggcctgcagggcggcatgctgtacccccaggagagccccagccgggagtgcaaggagctggatggcctgtggagcttccgggctgacttcagtgacaacagaagaagaggatttgaggagcagtggtacagaagacccctgtgggagagcggccccaccgtggacatgcctgtgcccagcagcttcaatgacatcagccaggactggaggctgcggcactttgtgggctgggtgtggtatgagcgggaggtgatcctgcctgagcgctggacccaggacctgcggaccagggtggtgctgagaattggcagcgcccacagctatgccatcgtgtgggtgaatggagtggacaccctggagcacgagggcggctacctgccctttgaagctgacatcagcaacctggtgcaggtgggccccctgcccagccggctgcgcatcaccatcgccatcaacaacaccctgacccccaccaccctgcccccaggcaccatccagtacctgacagacaccagcaagtaccccaagggctactttgtgcagaacacctactttgacttcttcaactatgccggcctgcagaggtctgtgctgctgtacaccacccccaccacctacattgatgacatcaccgtgaccacctctgtggagcaggacagcggcctggtgaactaccagatctctgtgaagggcagcaacctcttcaagctggaggtgcggctgctggatgctgagaacaaggtggtggccaacggcaccggcacccagggccagctgaaggtgcctggggtgtccctgtggtggccctacctgatgcatgagaggcctgcctacctgtacagcctggaggtgcagctgacagcccagaccagcctgggccctgtgtctgacttctacaccctgcctgtgggcatcagaacagtggccgtgaccaagagccagttcctgatcaatggcaagcccttctacttccacggcgtgaacaagcatgaagatgctgacatccggggcaaaggatttgactggcccctgctggtgaaggacttcaacctgctgcgctggctgggcgccaatgccttccgcaccagccactacccctatgcagaggaggtgatgcagatgtgtgacagatatggaattgtggtgattgatgagtgccctggggtgggcctggccctgccccagttcttcaacaacgtgtccctgcaccaccacatgcaggtgatggaggaggtggtgagaagagacaagaaccaccctgctgtggtgatgtggagcgtggccaatgagcccgccagccacctggagagcgctggctactacctgaagatggtgattgcccacaccaagagcctggaccccagcaggcctgtgacctttgtgagcaacagcaactatgctgctgacaagggggccccctacgtggatgtgatctgcctgaacagctactacagctggtaccatgactatggccacctggagctgatccagctgcagctggccacccagtttgagaactggtacaagaagtaccagaagcccatcatccagagtgaatatggagctgagaccatcgccggcttccaccaggacccccccctgatgttcacagaggagtaccagaagagcctgctggagcagtaccacctgggcctggaccagaagaggaggaaatatgtggtgggggagctgatctggaactttgctgacttcatgacagagcagagccccaccagggtgctgggcaacaagaagggcatcttcacccggcagaggcagcccaagtctgctgccttcctgctgcgggagcgctactggaagatcgccaatgagacccgctacccccacagcgtggccaagagccagtgcctggagaacagcctcttcacctag

SEQ ID NO: 153870 - DNA, 1803 bp, Artificial Sequence
  Description of Artificial Sequence: Synthetic coding sequence
atggcccggggcagcgctgtggcctgggccgccctgggccccctgctgtggggctgtgccctgggcctgcagggcggcatgctgtacccccaggagagccccagccgggagtgcaaggagctggatggcctgtggagcttccgggctgacttcagtgacaacagaagaagaggatttgaggagcagtggtacagaagacccctgtgggagagcggccccaccgtggacatgcctgtgcccagcagcttcaatgacatcagccaggactggaggctgcggcactttgtgggctgggtgtggtatgagcgggaggtgatcctgcctgagcgctggacccaggacctgcggaccagggtggtgctgagaattggcagcgcccacagctatgccatcgtgtgggtgaatggagtggacaccctggagcacgagggcggctacctgccctttgaagctgacatcagcaacctggtgcaggtgggccccctgcccagccggctgcgcatcaccatcgccatcaacaacaccctgacccccaccaccctgcccccaggcaccatccagtacctgacagacaccagcaagtaccccaagggctactttgtgcagaacacctactttgacttcttcaactatgccggcctgcagaggtctgtgctgctgtacaccacccccaccacctacattgatgacatcaccgtgaccacctctgtggagcaggacagcggcctggtgaactaccagatctctgtgaagggcagcaacctcttcaagctggaggtgcggctgctggatgctgagaacaaggtggtggccaacggcaccggcacccagggccagctgaaggtgcctggggtgtccctgtggtggccctacctgatgcatgagaggcctgcctacctgtacagcctggagatccggggcaagggctttgactggcccctgctggtgaaggacttcaacctgctgcgctggctgggcgccaatgccttccgcaccagccactacccctatgcagaggaggtgatgcagatgtgtgacagatatggcatcgtggtgattgatgaatgtcctggggtgggcctggccctgccccagttcttcaacaacgtgtccctgcaccaccacatgcaggtgatggaggaggtggtgcggcgggacaagaaccaccctgctgtggtgatgtggagcgtggccaatgaaccagccagccacctggagagcgctggctactacctgaagatggtgattgcccacaccaagagcctggaccccagcaggcctgtgacctttgtgagcaacagcaactatgctgctgacaagggggccccctacgtggatgtgatctgcctgaacagctactacagctggtaccatgactatggccacctggagctgatccagctgcagctggccacccagtttgagaactggtacaagaagtaccagaagcccatcatccagagtgaatatggagctgagaccatcgccggcttccaccaggacccccccctgatgttcacagaggagtaccagaagagcctgctggagcagtaccacctgggcctggaccagaagaggaggaaatatgtggtgggggagctgatctggaactttgctgacttcatgacagagcagagccccaccagggtgctgggcaacaagaagggcatcttcacccggcagaggcagcccaagtctgctgccttcctgctgcgggagcgctactggaagatcgccaatgagacccgctacccccacagcgtggccaagagccagtgcctggagaacagcctcttcacctag

SEQ ID NO: 153871 - DNA, 675 bp, Artificial Sequence
  Description of Artificial Sequence: Synthetic coding sequence
atggccagcagcacccccagcagcagcgccaccagcagcaatgctggagctgaccccaacaccaccaacctgcggcccaccacctatgacacctggtgtggggtggcccacggctgcaccaggaagctgggcctgaagatctgtggcttcctgcagaggaccaacagcctggaggagaagagccggctggtgtctgccttcaaggagcggcagagcagcaagaacctgctgagctgtgagaacagcgacagagatgcccgcttcagaagaacagaaacagacttcagcaacctgtttgcccgggacctgctgcctgccaagaatggagaggagcagacagtgcagttcctgctggaggtggtggacatcctgctgaactacgtgaggaagacctttgacaggagcaccaaggtgctggacttccaccacccccaccagctgctggagggcatggagggcttcaacctggagctgagtgaccaccctgagagcctggagcagatcctggtggactgccgggacaccctgaagtatggagtgaggacaggccacccccgcttcttcaaccagctgagcacaggcctggacatcatcggcctggccggggagtggctgaccagcacagccaacaccaacatgcccagcgacatgagggagtgctggctgctgaggtag

SEQ ID NO: 153872 - DNA, 1785 bp, Artificial Sequence
  Description of Artificial Sequence: Synthetic coding sequence
atggccagcagcacccccagcagcagcgccaccagcagcaatgctggagctgaccccaacaccaccaacctgcggcccaccacctatgacacctggtgtggggtggcccacggctgcaccaggaagctgggcctgaagatctgtggcttcctgcagaggaccaacagcctggaggagaagagccggctggtgtctgccttcaaggagcggcagagcagcaagaacctgctgagctgtgagaacagcgacagagatgcccgcttcagaagaacagaaacagacttcagcaacctgtttgcccgggacctgctgcctgccaagaatggagaggagcagacagtgcagttcctgctggaggtggtggacatcctgctgaactacgtgaggaagacctttgacaggagcaccaaggtgctggacttccaccacccccaccagctgctggagggcatggagggcttcaacctggagctgagtgaccaccctgagagcctggagcagatcctggtggactgccgggacaccctgaagtatggagtgaggacaggccacccccgcttcttcaaccagctgagcacaggcctggacatcatcggcctggccggggagtggctgaccagcacagccaacaccaacatgttcacctatgagatcgcccctgtgtttgtgctgatggagcagatcaccctgaagaagatgagggagatcgtgggctggagcagcaaggatggagatggcatcttcagccctgggggcgccatcagcaacatgtacagcatcatggccgcccgctacaagtacttccctgaggtgaagaccaagggcatggctgctgtgcccaagctggtgctcttcaccagcgagcagagccactacagcatcaagaaggccggggccgccctgggctttggaacagacaacgtcatcctgatcaagtgcaatgaaagaggcaagatcatcccagctgactttgaggccaagatcctggaggccaagcagaagggctacgtgcccttctacgtgaatgccacagctggcaccaccgtgtatggagcctttgaccccatccaggagattgctgacatctgtgagaagtacaacctgtggctgcacgtggatgctgcctggggcggcggcctgctgatgagcaggaagcaccgccacaagctgaatggaattgagcgggccaacagcgtgacctggaacccccacaagatgatgggcgtgctgctgcagtgcagcgccatcctggtgaaggagaagggcatcctgcagggctgcaaccagatgtgtgccggctacctgttccagcctgacaagcagtatgatgtgtcctatgacaccggggacaaggccatccagtgtggccgccacgtggacatcttcaagttctggctgatgtggaaggccaagggcaccgtgggctttgagaaccagatcaacaagtgcctggagctggccgagtacctgtatgccaagatcaagaaccgggaggagtttgagatggtgttcaatggagagcctgagcacaccaacgtgtgcttctggtacatcccccagagcctgcggggcgtgcctgacagcccccagaggcgggagaagctgcacaaggtggcccccaagatcaaggccctgatgatggagagcggcaccaccatggtgggctaccagccccagggcgacaaggccaacttcttcaggatggtgatcagcaacccagctgccacccagagcgacatcgacttcctgattgaggagattgagcggctgggccaggacctgtag

SEQ ID NO: 153873 - DNA, 675 bp, Artificial Sequence; identical to SEQ ID NO: 153871
  Description of Artificial Sequence: Synthetic coding sequence

SEQ ID NO: 153874 - DNA, 114 bp, Artificial Sequence
  Description of Artificial Sequence: Synthetic coding sequence
atggccagcagcacccccagcagcagcgccaccagcagcaatgctggagctgaccccaacaccaccaacctgcggcccaccacctatgacacctggtgtggggtggcccactag

SEQ ID NO: 153875 - DNA, 258 bp, Artificial Sequence
  Description of Artificial Sequence: Synthetic coding sequence
atggccagcagcacccccagcagcagcgccaccagcagcaatgctggagctgaccccaacaccaccaacctgcggcccaccacctatgacacctggtgtggggtggcccacggctgcaccaggaagctgggcctgaagatctgtggcttcctgcagaggaccaacagcctggaggagaagagccggctggtgtctgccttcaaggagcggcagagcagcaagaacctgctgagctgtgagaacagcgaccgggactag

SEQ ID NO: 153876 - DNA, 348 bp, Artificial Sequence
  Description of Artificial Sequence: Synthetic coding sequence
atggccagcagcacccccagcagcagcgccaccagcagcaatgctggagctgaccccaacaccaccaacctgcggcccaccacctatgacacctggtgtggggtggcccacggctgcaccaggaagctgggcctgaagatctgtggcttcctgcagaggaccaacagcctggaggagaagagccggctggtgtctgccttcaaggagcggcagagcagcaagaacctgctgagctgtgagaacagcgacagagatgcccgcttcagaagaacagaaacagacttcagcaacctgtttgcccgggacctgctgcctgccaagaatggagaggagcagacagtgcagtag

SEQ ID NO: 153877 - DNA, 366 bp, Artificial Sequence
  Description of Artificial Sequence: Synthetic coding sequence
atggccagcagcacccccagcagcagcgccaccagcagcaatgctggagctgaccccaacaccaccaacctgcggcccaccacctatgacacctggtgtggggtggcccacggctgcaccaggaagctgggcctgaagatctgtggcttcctgcagaggaccaacagcctggaggagaagagccggctggtgtctgccttcaaggagcggcagagcagcaagaacctgctgagctgtgagaacagcgacagagatgcccgcttcagaagaacagaaacagacttcagcaacctgtttgcccgggacctgctgcctgccaagaatggagaggagcagacagtgcagttcctgctggaggtggtgtag

SEQ ID NO: 153878 - DNA, 1758 bp, Artificial Sequence
  Description of Artificial Sequence: Synthetic coding sequence
atggccagccctggcagcggcttctggagctttggaagtgaagatggcagcggggacagtgaaaatcctggaacagcccgggcctggtgccaggtggcccagaagttcaccggcggcatcggcaacaagctgtgtgccctgctgtatggagatgctgagaagccagctgagagcggcggcagccagccccccagggctgctgccaggaaggccgcctgtgcctgtgaccagaagccctgcagctgcagcaaggtggatgtgaactatgccttcctgcacgccacagacctgctgcctgcctgtgatggagagcggcccaccctggccttcctgcaggatgtgatgaacatcctgctgcagtatgtggtgaagagctttgacaggagcaccaaggtgattgacttccactacccaaatgagctgctgcaggagtacaactgggagctggccgaccagccccagaacctggaggagatcctgatgcactgccagaccaccctgaagtatgccatcaagacaggccacccccgctacttcaaccagctgagcacaggcctggacatggtgggcctggccgctgactggctgaccagcacagccaacaccaacatgttcacctatgaaattgcccctgtgtttgtgctgctggagtatgtgaccctgaagaagatgagggagatcatcggctggccaggcggcagcggagatggcatcttcagccctggaggagccatcagcaacatgtatgccatgatgattgcccgcttcaagatgtttcctgaggtgaaggagaagggcatggccgccctgcccaggctcatcgccttcaccagcgagcacagccacttcagcctgaagaagggagctgctgccctgggcatcggcacagacagcgtcatcctgatcaagtgtgatgagcggggcaagatgatccccagcgacctggagcggcgcatcctggaggccaagcagaagggctttgtgcccttcctggtgtctgccacagctggcaccaccgtgtatggagcctttgaccccctgctggccgtggccgacatctgcaagaagtacaagatctggatgcacgtggatgctgcctggggcggcggcctgctgatgagcaggaagcacaagtggaagctgagcggcgtggagcgggccaacagcgtgacctggaacccccacaagatgatgggcgtgcccctgcagtgcagcgccctgctggtgcgggaggagggcctgatgcagaactgcaaccagatgcacgccagctacctgttccagcaggacaagcactatgacctgtcctatgacacaggagacaaggccctgcagtgtggcagacatgtggatgtgttcaagctgtggctgatgtggagggccaagggcaccactggatttgaggcccacgtggacaagtgcctggagctggccgagtacctgtacaacatcatcaagaaccgggagggctatgagatggtgtttgatggcaagccccagcacaccaacgtgtgcttctggtacatcccccccagcctgcggaccctggaggacaatgaggagaggatgagccggctgagcaaggtggcccctgtgatcaaggccaggatgatggagtatggcaccaccatggtgtcctaccagcccctgggggacaaggtgaacttcttcaggatggtgatcagcaacccagctgccacccaccaggacatcgacttcctgattgaggagattgaaaggctgggccaggacctgtag

SEQ ID NO: 153879 - DNA, 390 bp, Artificial Sequence
  Description of Artificial Sequence: Synthetic coding sequence
atgaacatcctgctgcagtatgtggtgaagagctttgacaggagcaccaaggtgattgacttccactacccaaatgagctgctgcaggagtacaactgggagctggccgaccagccccagaacctggaggagatcctgatgcactgccagaccaccctgaagtatgccatcaagacaggccacccccgctacttcaaccagctgagcacaggcctggacatggtgggcctggccgctgactggctgaccagcacagccaacaccaacatgttcacctatgaaattgcccctgtgtttgtgctgctggagtatgtgaccctgaagaagatgagggagatcatcggctggccaggcggcagcggagatggcatcttcagccctggcacctag

SEQ ID NO: 153880 - DNA, 1758 bp, Artificial Sequence; identical to SEQ ID NO: 153878
  Description of Artificial Sequence: Synthetic coding sequence

SEQ ID NO: 153881 - DNA, 567 bp, Artificial Sequence
  Description of Artificial Sequence: Synthetic coding sequence
atggccagccctggcagcggcttctggagctttggaagtgaagatggcagcggggacagtgaaaatcctggaacagcccgggcctggtgccaggtggcccagaagttcaccggcggcatcggcaacaagctgtgtgccctgctgtatggagatgctgagaagccagctgagagcggcggcagccagccccccagggctgctgccaggaaggccgcctgtgcctgtgaccagaagccctgcagctgcagcaaggtggatgtgaactatgccttcctgcacgccacagacctgctgcctgcctgtgatggagagcggcccaccctggccttcctgcaggatgtgatgaacatcctgctgcagtatgtggtgaagagctttgacaggagcaccaaggtgattgacttccactacccaaatgagctgctgcaggagtacaactgggagctggccgaccagccccagaacctggaggagatcctgatgcactgccagaccaccctgaagtatgccatcaagacaggaattgtgagcagcaagatcatcaagctgttcttccggctgcagtag

SEQ ID NO: 153882 - DNA, 1677 bp, Artificial Sequence
  Description of Artificial Sequence: Synthetic coding sequence
atgtaccgctacctgggggaggccctgctgctgagccgggccggccctgctgccctgggcagcgccagcgctgacagcgctgccctgctgggctgggcccggggccagcctgctgctgccccccagcccggcctggccctggccgcccggcggcactacagcgaggccgtggccgacagagaagatgaccccaacttcttcaagatggtggagggcttctttgacagaggagccagcatcgtggaggacaagctggtggaggacctgcggacccgggagagcgaggagcagaagaggaacagagtgcggggcatcctgcgcatcatcaagccctgcaaccacgtgctgagcctgtccttccccatcagaagagatgatggctcctgggaggtgattgagggctaccgggcccagcacagccagcacaggaccccctgcaagggcggcatccgctacagcacagatgtgtctgtggatgaggtgaaggccctggccagcctgatgacctacaagtgtgctgtggtggatgtgccctttggaggagccaaggccggcgtgaagatcaaccccaagaactacacagacaatgagctggagaagatcacccggcgcttcaccatggagctggccaagaagggcttcatcggccctggcattgatgtgcctgccccagacatgagcactggagagcgggagatgtcctggattgctgacacctacgccagcaccatcggccactatgacatcaatgcccacgcctgtgtgacaggcaagcccatcagccagggcggcatccacggccgcatcagcgccaccggccggggcgtcttccacggcatcgagaacttcatcaatgaggccagctacatgagcatcctgggcatgaccccaggctttggagacaagacctttgtggtgcagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggccgactgtgacatcctgatcccagctgccagcgagaagcagctgaccaagagcaatgccccccgggtgaaggccaagatcatcgccgagggcgccaacggccccaccaccccagaggccgacaagatcttcctggagaggaacatcatggtgatcccagacctgtacctgaatgctgggggcgtgacagtgtcctactttgagtggctgaagaacctgaaccacgtgtcctatggccgcctgaccttcaagtatgaaagagacagcaactaccacctgctgatgtctgtgcaggagagcctggagaggaagtttgggaagcatggaggcaccatccccatcgtgcccacagctgagttccaggaccgcatcagcggggccagcgagaaggacatcgtgcacagcggcctggcctacaccatggagaggtctgcccggcagatcatgaggacagccatgaagtacaacctgggcctggacctgaggacagctgcctacgtgaatgccatcgagaaggtgttcaaggtgtacaatgaagctggggtgaccttcacctag

SEQ ID NO: 153883 - DNA, 1548 bp, Artificial Sequence
  Description of Artificial Sequence: Synthetic coding sequence
atgtaccgctacctgggccctggaacagcccggcggcggcctgctgctggggccggcatcggccgcccagcccccctgcagagaggaggcggccggccccggggccggccccagctgctgcaggacggcggcggcctgctgcggagccggcggcagcacagaggaggccaggccggcggcggcccagaagatcctggagagagaggagctgaggccgagcccggggcccggcaccctgctgaccaccaggccctgcagccctgtgccgagagcctgctgccccagcacagccagcacaggaccccctgcaagggcggcatccgctacagcacagatgtgtctgtggatgaggtgaaggccctggccagcctgatgacctacaagtgtgctgtggtggatgtgccctttggaggagccaaggccggcgtgaagatcaaccccaagaactacacagacaatgagctggagaagatcacccggcgcttcaccatggagctggccaagaagggcttcatcggccctggcattgatgtgcctgccccagacatgagcactggagagcgggagatgtcctggattgctgacacctacgccagcaccatcggccactatgacatcaatgcccacgcctgtgtgacaggcaagcccatcagccagggcggcatccacggccgcatcagcgccaccggccggggcgtcttccatggaattgagaacttcatcaatgaggccagctacatgagcatcctgggcatgaccccaggctttggagacaagacctttgtggtgcagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggccgactgtgacatcctgatcccagctgccagcgagaagcagctgaccaagagcaatgccccccgggtgaaggccaagatcatcgccgagggcgccaacggccccaccaccccagaggccgacaagatcttcctggagaggaacatcatggtgatcccagacctgtacctgaatgctgggggcgtgacagtgtcctactttgagtggctgaagaacctgaaccacgtgtcctatggccgcctgaccttcaagtatgagcgggacagcaactaccacctgctgatgtctgtgcaggagagcctggagaggaagtttgggaagcacggcggcaccatccccatcgtgcccacagctgagttccaggaccgcatcagcggggccagcgagaaggacatcgtgcacagcggcctggcctacaccatggagaggtctgcccggcagatcatgaggacagccatgaagtacaacctgggcctggacctgaggacagctgcctacgtgaatgccatcgagaaggtgttcaaggtgtacaatgaggccggcgtgaccttcacctag

SEQ ID NO: 153884 - DNA, 1473 bp, Artificial Sequence
  Description of Artificial Sequence: Synthetic coding sequence
atggtggagggcttctttgacagaggagccagcatcgtggaggacaagctggtggaggacctgcggacccgggagagcgaggagcagaagaggaacagagtgcggggcatcctgcgcatcatcaagccctgcaaccacgtgctgagcctgtccttccccatcagaagagatgatggctcctgggaggtgattgagggctaccgggcccagcacagccagcacaggaccccctgcaagggcggcatccgctacagcacagatgtgtctgtggatgaggtgaaggccctggccagcctgatgacctacaagtgtgctgtggtggatgtgccctttggaggagccaaggccggcgtgaagatcaaccccaagaactacacagacaatgagctggagaagatcacccggcgcttcaccatggagctggccaagaagggcttcatcggccctggcattgatgtgcctgccccagacatgagcactggagagcgggagatgtcctggattgctgacacctacgccagcaccatcggccactatgacatcaatgcccacgcctgtgtgacaggcaagcccatcagccagggcggcatccacggccgcatcagcgccaccggccggggcgtcttccacggcatcgagaacttcatcaatgaggccagctacatgagcatcctgggcatgaccccaggctttggagacaagacctttgtggtgcagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggccgactgtgacatcctgatcccagctgccagcgagaagcagctgaccaagagcaatgccccccgggtgaaggccaagatcatcgccgagggcgccaacggccccaccaccccagaggccgacaagatcttcctggagaggaacatcatggtgatcccagacctgtacctgaatgctgggggcgtgacagtgtcctactttgagtggctgaagaacctgaaccacgtgtcctatggccgcctgaccttcaagtatgaaagagacagcaactaccacctgctgatgtctgtgcaggagagcctggagaggaagtttgggaagcatggaggcaccatccccatcgtgcccacagctgagttccaggaccgcatcagcggggccagcgagaaggacatcgtgcacagcggcctggcctacaccatggagaggtctgcccggcagatcatgaggacagccatgaagtacaacctgggcctggacctgaggacagctgcctacgtgaatgccatcgagaaggtgttcaaggtgtacaatgaagctggggtgaccttcacctag

SEQ ID NO: 153885 - DNA, 774 bp, Artificial Sequence
  Description of Artificial Sequence: Synthetic coding sequence
gaaaacttcatcgtggagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggccgactgtgacatcctgatcccagctgccagcgagaagcagctgaccaagagcaatgccccccgggtgaaggccaagatcatcgccgagggcgccaacggccccaccaccccagaggccgacaagatcttcctggagaggaacatcatggtgatcccagacctgtacctgaatgctgggggcgtgacagtgtcctactttgagtggctgaagaacctgaaccacgtgtcctatggccgcctgaccttcaagtatgagcgggacagcaactaccacctgctgatgtctgtgcaggagagcctggagaggaagtttgggaagcacggcggcaccatccccatcgtgcccacagctgagttccaggaccgcatcagcggggccagcgagaaggacatcgtgcacagcggcctggcctacaccatggagaggtctgcccggcagatcatgaggacagccatgaagtacaacctgggcctggacctgaggacagctgcctacgtgaatgccatcgagaaggtgttcaaggtgtacaatgaggccggcgtgaccttcacctag

SEQ ID NO: 153886 - DNA, 1176 bp, Artificial Sequence
  Description of Artificial Sequence: Synthetic coding sequence
atgacctacaagtgtgctgtggtggatgtgccctttggaggagccaaggccggcgtgaagatcaaccccaagaactacacagacaatgagctggagaagatcacccggcgcttcaccatggagctggccaagaagggcttcatcggccctggcattgatgtgcctgccccagacatgagcactggagagcgggagatgtcctggattgctgacacctacgccagcaccatcggccactatgacatcaatgcccacgcctgtgtgacaggcaagcccatcagccagggcggcatccacggccgcatcagcgccaccggccggggcgtcttccatggaattgagaacttcatcaatgaggccagctacatgagcatcctgggcatgaccccaggctttggagacaagacctttgtggtgcagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggccgactgtgacatcctgatcccagctgccagcgagaagcagctgaccaagagcaatgccccccgggtgaaggccaagatcatcgccgagggcgccaacggccccaccaccccagaggccgacaagatcttcctggagaggaacatcatggtgatcccagacctgtacctgaatgctgggggcgtgacagtgtcctactttgagtggctgaagaacctgaaccacgtgtcctatggccgcctgaccttcaagtatgagcgggacagcaactaccacctgctgatgtctgtgcaggagagcctggagaggaagtttgggaagcacggcggcaccatccccatcgtgcccacagctgagttccaggaccgcatcagcggggccagcgagaaggacatcgtgcacagcggcctggcctacaccatggagaggtctgcccggcagatcatgaggacagccatgaagtacaacctgggcctggacctgaggacagctgcctacgtgaatgccatcgagaaggtgttcaaggtgtacaatgaggccggcgtgaccttcacctag

SEQ ID NO: 153887 - DNA, 1278 bp, Artificial Sequence
  Description of Artificial Sequence: Synthetic coding sequence
atgacctgcccctgtgacaatgccagcagcgtcttcctgggcttctgcatccgctacagcacagatgtgtctgtggatgaggtgaaggccctggccagcctgatgacctacaagtgtgctgtggtggatgtgccctttggaggagccaaggccggcgtgaagatcaaccccaagaactacacagacaatgagctggagaagatcacccggcgcttcaccatggagctggccaagaagggcttcatcggccctggcattgatgtgcctgccccagacatgagcactggagagcgggagatgtcctggattgctgacacctacgccagcaccatcggccactatgacatcaatgcccacgcctgtgtgacaggcaagcccatcagccagggcggcatccacggccgcatcagcgccaccggccggggcgtcttccatggaattgagaacttcatcaatgaggccagctacatgagcatcctgggcatgaccccaggctttggagacaagacctttgtggtgcagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggccgactgtgacatcctgatcccagctgccagcgagaagcagctgaccaagagcaatgccccccgggtgaaggccaagatcatcgccgagggcgccaacggccccaccaccccagaggccgacaagatcttcctggagaggaacatcatggtgatcccagacctgtacctgaatgctgggggcgtgacagtgtcctactttgagtggctgaagaacctgaaccacgtgtcctatggccgcctgaccttcaagtatgagcgggacagcaactaccacctgctgatgtctgtgcaggagagcctggagaggaagtttgggaagcacggcggcaccatccccatcgtgcccacagctgagttccaggaccgcatcagcggggccagcgagaaggacatcgtgcacagcggcctggcctacaccatggagaggtctgcccggcagatcatgaggacagccatgaagtacaacctgggcctggacctgaggacagctgcctacgtgaatgccatcgagaaggtgttcaaggtgtacaatgaggccggcgtgaccttcacctag

SEQ ID NO: 153888 - DNA, 1677 bp, Artificial Sequence
  Description of Artificial Sequence: Synthetic coding sequence
atgtaccgctacctggccaaggccctgctgcccagccgggccggccctgctgccctgggcagcgctgccaaccacagcgctgccctgctgggccggggccggggccagcctgctgctgccagccagcccggcctggccctggccgcccggcggcactacagcgagctggtggccgacagagaagatgaccccaacttcttcaagatggtggagggcttctttgacagaggagccagcatcgtggaggacaagctggtgaaggacctgcggacccaggagagcgaggagcagaagaggaacagagtgcggggcatcctgcgcatcatcaagccctgcaaccacgtgctgagcctgtccttccccatcagaagagatgatggctcctgggaggtgattgagggctaccgggcccagcacagccagcacaggaccccctgcaagggcggcatccgctacagcacagatgtgtctgtggatgaggtgaaggccctggccagcctgatgacctacaagtgtgctgtggtggatgtgccctttggaggagccaaggccggcgtgaagatcaaccccaagaactacacagaaaatgagctggagaagatcacccggcgcttcaccatggagctggccaagaagggcttcatcggccctggggtggatgtgcctgccccagacatgaacacaggagagcgggagatgtcctggattgctgacacctacgccagcaccatcggccactatgacatcaatgcccacgcctgtgtgacaggcaagcccatcagccagggcggcatccacggccgcatcagcgccaccggccggggcgtcttccacggcatcgagaacttcatcaatgaggccagctacatgagcatcctgggcatgaccccaggcttccgggacaagacctttgtggtgcagggctttggaaatgtgggcctgcacagcatgagatacctgcacagatttggagccaagtgcatcgctgtgggggagagtgatggcagcatctggaacccagatggcatcgaccccaaggagctggaggacttcaagctgcagcacggcagcatcctgggcttccccaaggccaagccctatgagggcagcatcctggaggtggactgtgacatcctgatcccagctgccacagagaagcagctgaccaagagcaatgccccccgggtgaaggccaagatcatcgccgagggcgccaacggccccaccaccccagaggccgacaagatcttcctggagaggaacatcctggtgatcccagacctgtacctgaatgctgggggcgtgacagtgtcctactttgagtggctgaagaacctgaaccacgtgtcctatggccgcctgaccttcaagtatgaaagagacagcaactaccacctgctgctgtctgtgcaggagagcctggagaggaagtttgggaagcatggaggcaccatccccatcgtgcccacagctgagttccaggacagcatcagcggggccagcgagaaggacatcgtgcacagcgccctggcctacaccatggagaggtctgcccggcagatcatgcacacagccatgaagtacaacctgggcctggacctgaggacagctgcctacgtgaatgccatcgagaaggtgttcaaggtgtacagcgaggccggcgtgaccttcacctag

SEQ ID NO: 153889 - DNA, 3342 bp, Artificial Sequence
  Description of Artificial Sequence: Synthetic coding sequence
atgattgctgtgtccttcaagtgccgctgccagatcctgcggcggctgaccaaggatgagagcccctacaccaagagcgccagccagaccaagcccccagatggagccctggccgtgcggcggcagagcatccctgaggagttcaagggcagcacagtggtggagctgatgaagaaggagggcaccaccctgggcctgactgtgtctgggggcatcgacaaggatggcaagccccgggtgagcaacctgcggcagggcggcattgctgcccggagtgaccagctggatgtgggggactacatcaaggctgtgaatggcatcaacctggccaagttcagacatgatgagatcatcagcctgctgaagaatgtgggggagcgggtggtgctggaggtggagtatgagctgccccctgtgtctgtgcagggcagcagcgtcatcttcagaacagtggaggtgaccctgcacaaggagggcaacaccttcggcttcgtcatccggggcggggcccatgatgacaggaacaagagcaggcctgtggtgatcacctgtgtgcggcctgggggccctgctgaccgggagggcaccatcaagccaggggaccggctgctgtctgtggatggcatccggctgctgggcaccacccatgctgaggccatgagcatcctgaagcagtgtggccaggaggccgccctgctgattgaatatgatgtgtctgtgatggattctgtggccacagccagcggccccctgctggtggaggtggccaagacccctggggccagcctgggcgtggccctgaccacctccatgtgctgcaacaagcaggtgattgtcatcgacaagatcaagagcgccagcattgctgacagatgtggggccctgcacgtgggggaccacatcctgagcattgatggcacctccatggagtactgcaccctggccgaggccacccagttcctggccaacaccacagaccaggtgaagctggagatcctgccccaccaccagacccggctggccctgaagggccctgaccacgtgaagatccagaggagtgaccggcagctgacctgggacagctgggccagcaaccacagcagcctgcacaccaaccaccactacaacacctaccacccagaccactgccgggtgcctgccctgaccttccccaaggcccccccacccaacagccccccagccctggtgagcagcagcttcagccccacctccatgtctgcctacagcctgagcagcctgaacatgggcaccctgcccaggagcctgtacagcaccagcccccggggcaccatgatgagaagaaggctgaagaagaaggacttcaagagcagcctgagcctggccagcagcacagtgggcctggccggccaggtggtgcacacagagaccacagaggtggtgctgacagctgaccctgtgactggatttggcatccagctgcagggctctgtgtttgccacagagaccctgagcagccccccactcatctcctacatcgaggccgacagccctgctgagcgctgtggggtgctgcagatcggggacagagtgatggccatcaatggcatccccacagaggacagcacctttgaggaggccagccagctgctgcgggacagcagcatcaccagcaaggtgaccctggagattgaatttgatgtggccgagagcgtcatccccagcagcggcaccttccacgtgaagctgcccaagaagcacaacgtggagctgggcatcaccatcagcagccccagcagcaggaagccaggggaccccctggtgatcagtgacatcaagaagggctctgtggcccacaggacaggcaccctggagctgggggacaagctgctggccatcgacaacatccggctggacaactgcagcatggaggatgctgtgcagatcctgcagcagtgtgaggacctggtgaagctgaagatcaggaaggatgaggacaacagtgatgagcaggagagcagcggggccatcatctacacagtggagctgaagagatatggaggccccctgggcatcaccatcagcggcacagaggagccctttgaccccatcatcatcagcagcctgaccaagggcggcctggccgagaggactggagccatccacatcggggaccgcatcctggccatcaacagcagcagcctgaagggcaagcccctgtctgaggccatccacctgctgcagatggccggggagaccgtgaccctgaagatcaagaagcagacagatgcccagagcgccagcagccccaagaagttccccatcagcagccacctgagtgacctgggagatgtggaggaggacagcagccctgcccagaagccaggcaagctgagtgacatgtaccccagcacagtgcccagcgtggacagcgctgtggacagctgggatggcagcgccatcgacaccagctatggcacccagggcaccagcttccaggccagcggctacaacttcaacacctatgactggaggagccccaagcagaggggcagcctgagccctgtgaccaagcccaggagccagacctacccagatgtgggcctgtcctatgaggactgggacaggagcacagccagcggctttgctggagctgctgacagcgctgagacagagcaggaggagaacttctggagccaggccctggaggacctggagacctgtggccagagcggcatcctgcgggagctggaggccaccatcatgagcggcagcaccatgagcctgaaccacgaggcccccacccccaggagccagctgggccggcaggccagcttccaggagaggagcagcagccggccccactacagccagaccaccaggagcaacaccctgcccagtgatgtgggcaggaagtctgtgaccctgaggaagatgaagcaggagatcaaggagatcatgagccccacccctgtggagctgcacaaggtgaccctgtacaaggacagcgacatggaggactttggcttctctgtggctgatggcctgctggagaagggcgtgtatgtgaagaacatccggcctgctggccctggggacctgggcggcctgaagccctatgaccggctgctgcaggtgaaccacgtgaggacccgggactttgactgctgcctggtggtgcccctgattgctgagagcggcaacaagctggacctggtgatcagcaggaaccccctggccagccagaagagcattgaccagcagagcctgcccggggactggagcgagcagaacagcgccttcttccagcagcccagccacggcggcaacctggagacccgggagcccaccaacaccctgtag

SEQ ID NO: 153890 - DNA, 3387 bp, Artificial Sequence
  Description of Artificial Sequence: Synthetic coding sequence
atgattgctgtgtccttcaagtgccgctgccagatcctgcggcggctgaccaaggatgagagcccctacaccaagagcgccagccagaccaagcccccagatggagccctggccgtgcggcggcagagcatccctgaggagttcaagggcagcacagtggtggagctgatgaagaaggagggcaccaccctgggcctgactgtgtctgggggcatcgacaaggatggcaagccccgggtgagcaacctgcggcagggcggcattgctgcccggagtgaccagctggatgtgggggactacatcaaggctgtgaatggcatcaacctggccaagttcagacatgatgagatcatcagcctgctgaagaatgtgggggagcgggtggtgctggaggtggagtatgagctgccccctgtgtctgtgcagggcagcagcgtcatcttcagaacagtggaggtgaccctgcacaaggagggcaacaccttcggcttcgtcatccggggcggggcccatgatgacaggaacaagagcaggcctgtggtgatcacctgtgtgcggcctgggggccctgctgaccgggagggcaccatcaagccaggggaccggctgctgtctgtggatggcatccggctgctgggcaccacccatgctgaggccatgagcatcctgaagcagtgtggccaggaggccgccctgctgattgaatatgatgtgtctgtgatggattctgtggccacagccagcggccccctgctggtggaggtggccaagacccctggggccagcctgggcgtggccctgaccacctccatgtgctgcaacaagcaggtgattgtcatcgacaagatcaagagcgccagcattgctgacagatgtggggccctgcacgtgggggaccacatcctgagcattgatggcacctccatggagtactgcaccctggccgaggccacccagttcctggccaacaccacagaccaggtgaagctggagatcctgccccaccaccagacccggctggccctgaagggccctgaccacgtgaagatccagaggagtgaccggcagctgacctgggacagctgggccagcaaccacagcagcctgcacaccaaccaccactacaacacctaccacccagaccactgccgggtgcctgccctgaccttccccaaggcccccccacccaacagccccccagccctggtgagcagcagcttcagccccacctccatgtctgcctacagcctgagcagcctgaacatgggcaccctgcccaggagcctgtacagcaccagcccccggggcaccatgatgagaagaaggctgaagaagaaggacttcaagagcagcctgagcctggccagcagcacagtgggcctggccggccaggtggtgcacacagagaccacagaggtggtgctgacagctgaccctgtgactggatttggcatccagctgcagggctctgtgtttgccacagagaccctgagcagccccccactcatctcctacatcgaggccgacagccctgctgagcgctgtggggtgctgcagatcggggacagagtgatggccatcaatggcatccccacagaggacagcacctttgaggaggccagccagctgctgcgggacagcagcatcaccagcaaggtgaccctggagattgaatttgatgtggccgagagcgtcatccccagcagcggcaccttccacgtgaagctgcccaagaagcacaacgtggagctgggcatcaccatcagcagccccagcagcaggaagccaggggaccccctggtgatcagtgacatcaagaagggctctgtggcccacaggacaggcaccctggagctgggggacaagctgctggccatcgacaacatccggctggacaactgcagcatggaggatgctgtgcagatcctgcagcagtgtgaggacctggtgaagctgaagatcaggaaggatgaggacaacagtgatgagcaggagagcagcggggccatcatctacacagtggagctgaagagatatggaggccccctgggcatcaccatcagcggcacagaggagccctttgaccccatcatcatcagcagcctgaccaagggcggcctggccgagaggactggagccatccacatcggggaccgcatcctggccatcaacagcagcagcctgaagggcaagcccctgtctgaggccatccacctgctgcagatggccggggagaccgtgaccctgaagatcaagaagcagacagatgcccagagcgccagcagccccaagaagttccccatcagcagccacctgagtgacctgggagatgtggaggaggacagcagccctgcccagaagccaggcaagctgagtgacatgtaccccagcacagtgcccagcgtggacagcgctgtggacagctgggatggcagcgccatcgacaccagctatggcacccagggcaccagcttccaggccagcggctacaacttcaacacctatgactggaggagccccaagcagaggggcagcctgagccctgtgaccaagcccaggagccagacctacccagatgtgggcctgtcctatgaggactgggacaggagcacagccagcggctttgctggagctgctgacagcgctgagacagagcaggaggagaacttctggagccaggccctggaggacctggagacctgtggccagagcggcatcctgcgggagctggaggagaaggctgaccggcgggtgtccctgaggaacatgaccctgctggccaccatcatgagcggcagcaccatgagcctgaaccacgaggcccccacccccaggagccagctgggccggcaggccagcttccaggagaggagcagcagccggccccactacagccagaccaccaggagcaacaccctgcccagtgatgtgggcaggaagtctgtgaccctgaggaagatgaagcaggagatcaaggagatcatgagccccacccctgtggagctgcacaaggtgaccctgtacaaggacagcgacatggaggactttggcttctctgtggctgatggcctgctggagaagggcgtgtatgtgaagaacatccggcctgctggccctggggacctgggcggcctgaagccctatgaccggctgctgcaggtgaaccacgtgaggacccgggactttgactgctgcctggtggtgcccctgattgctgagagcggcaacaagctggacctggtgatcagcaggaaccccctggccagccagaagagcattgaccagcagagcctgcccggggactggagcgagcagaacagcgccttcttccagcagcccagccatggaggcaacctggagacccgggagcccaccaacaccctgtag

SEQ ID NO: 153891 - DNA, 3231 bp, Artificial Sequence
  Description of Artificial Sequence: Synthetic coding sequence
atgattgctgtgtccttcaagtgccgctgccagatcctgcggcggctgaccaaggatgagagcccctacaccaagagcgccagccagaccaagcccccagatggagccctggccgtgcggcggcagagcatccctgaggagttcaagggcagcacagtggtggagctgatgaagaaggagggcaccaccctgggcctgactgtgtctgggggcatcgacaaggatggcaagccccgggtgagcaacctgcggcagggcggcattgctgcccggagtgaccagctggatgtgggggactacatcaaggctgtgaatggcatcaacctggccaagttcagacatgatgagatcatcagcctgctgaagaatgtgggggagcgggtggtgctggaggtggagtatgagctgccccctgtgtctgtgcagggcagcagcgtcatcttcagaacagtggaggtgaccctgcacaaggagggcaacaccttcggcttcgtcatccggggcggggcccatgatgacaggaacaagagcaggcctgtggtgatcacctgtgtgcggcctgggggccctgctgaccgggagggcaccatcaagccaggggaccggctgctgtctgtggatggcatccggctgctgggcaccacccatgctgaggccatgagcatcctgaagcagtgtggccaggaggccgccctgctgattgaatatgatgtgtctgtgatggattctgtggccacagccagcggccccctgctggtggaggtggccaagacccctggggccagcctgggcgtggccctgaccacctccatgtgctgcaacaagcaggtgattgtcatcgacaagatcaagagcgccagcattgctgacagatgtggggccctgcacgtgggggaccacatcctgagcattgatggcacctccatggagtactgcaccctggccgaggccacccagttcctggccaacaccacagaccaggtgaagctggagatcctgccccaccaccagacccggctggccctgaagggccctgaccacgccgccctggtgagcagcagcttcagccccacctccatgtctgcctacagcctgagcagcctgaacatgggcaccctgcccaggagcctgtacagcaccagcccccggggcaccatgatgagaagaaggctgaagaagaaggacttcaagagcagcctgagcctggccagcagcacagtgggcctggccggccaggtggtgcacacagagaccacagaggtggtgctgacagctgaccctgtgactggatttggcatccagctgcagggctctgtgtttgccacagagaccctgagcagccccccactcatctcctacatcgaggccgacagccctgctgagcgctgtggggtgctgcagatcggggacagagtgatggccatcaatggcatccccacagaggacagcacctttgaggaggccagccagctgctgcgggacagcagcatcaccagcaaggtgaccctggagattgaatttgatgtggccgagagcgtcatccccagcagcggcaccttccacgtgaagctgcccaagaagcacaacgtggagctgggcatcaccatcagcagccccagcagcaggaagccaggggaccccctggtgatcagtgacatcaagaagggctctgtggcccacaggacaggcaccctggagctgggggacaagctgctggccatcgacaacatccggctggacaactgcagcatggaggatgctgtgcagatcctgcagcagtgtgaggacctggtgaagctgaagatcaggaaggatgaggacaacagtgatgagcaggagagcagcggggccatcatctacacagtggagctgaagagatatggaggccccctgggcatcaccatcagcggcacagaggagccctttgaccccatcatcatcagcagcctgaccaagggcggcctggccgagaggactggagccatccacatcggggaccgcatcctggccatcaacagcagcagcctgaagggcaagcccctgtctgaggccatccacctgctgcagatggccggggagaccgtgaccctgaagatcaagaagcagacagatgcccagagcgccagcagccccaagaagttccccatcagcagccacctgagtgacctgggagatgtggaggaggacagcagccctgcccagaagccaggcaagctgagtgacatgtaccccagcacagtgcccagcgtggacagcgctgtggacagctgggatggcagcgccatcgacaccagctatggcacccagggcaccagcttccaggccagcggctacaacttcaacacctatgactggaggagccccaagcagaggggcagcctgagccctgtgaccaagcccaggagccagacctacccagatgtgggcctgtcctatgaggactgggacaggagcacagccagcggctttgctggagctgctgacagcgctgagacagagcaggaggagaacttctggagccaggccctggaggacctggagacctgtggccagagcggcatcctgcgggagctggaggagaaggctgaccggcgggtgtccctgaggaacatgaccctgctggccaccatcatgagcggcagcaccatgagcctgaaccacgaggcccccacccccaggagccagctgggccggcaggccagcttccaggagaggagcagcagccggccccactacagccagaccaccaggagcaacaccctgcccagtgatgtgggcaggaagtctgtgaccctgaggaagatgaagcaggagatcaaggagatcatgagccccacccctgtggagctgcacaaggtgaccctgtacaaggacagcgacatggaggactttggcttctctgtggctgatggcctgctggagaagggcgtgtatgtgaagaacatccggcctgctggccctggggacctgggcggcctgaagccctatgaccggctgctgcaggtgaaccacgtgaggacccgggactttgactgctgcctggtggtgcccctgattgctgagagcggcaacaagctggacctggtgatcagcaggaaccccctggccagccagaagagcattgaccagcagagcctgcccggggactggagcgagcagaacagcgccttcttccagcagcccagccatggaggcaacctggagacccgggagcccaccaacaccctgtag

SEQ ID NO: 153892 - DNA, 2511 bp, Artificial Sequence
  Description of Artificial Sequence: Synthetic coding sequence
atggtgcagttcagcaccagcgagttccggctgaccccccacatcgacaacctggaggtggccaacagctttgctgtgaccaatgccttctgcagccagttcagcagaggagtgtatgccatcttcggcttctatgacaagaagtctgtgaacaccatcaccagcttctgtggcaccctgcacgtgtccttcatcacccccagcttccccacagatggcacccacccctttgtgatccagatgaggccagacctgaagggggccctgctgagcctgattgagtactaccagtgggacaagtttgcctacctgtatgacagcgaccggggcctgagcaccctgcaggccgtgctggacagcgctgctgagaagaagtggcaggtgacagccatcaacgtgggcaacatcaacaatgacaagaaggatgagatgtaccgcagcctcttccaggacctggagctgaagaaggagcggcgggtcatcctggactgtgagcgggacaaggtgaatgacatcgtggaccaggtgatcaccatcggcaagcacgtgaagggctaccactacatcatcgccaacctgggcttcacagatggagacctgctgaagatccagtttggaggagccaacgtgtctggcttccagatcgtggactatgatgacagcctggtgtccaagttcatcgagcgctggagcaccctggaggagaaggagtacccaggggcccacaccaccaccatcaagtacaccagcgccctgacctatgatgctgtgcaggtgatgacagaggccttcaggaacctgaggaagcagagaattgagatcagcagaagaggaaatgctggggactgcctggccaacccagctgtgccctggggccagggcgtggagattgagcgggccctgaagcaggtgcaggtggagggcctgagcggcaacatcaagtttgaccagaatggcaagaggatcaactacaccatcaacatcatggagctgaagaccaacggccccaggaagattggctactggagcgaggtggacaagatggtggtgaccctgacagagctgcccagcggaaatgacaccagcggcctggagaacaagacagtggtggtgaccaccatcctggagagcccctacgtgatgatgaagaagaaccacgagatgctggagggcaatgaaagatatgagggctactgtgtggacctggccgctgagatcgccaagcactgcggcttcaagtacaagctgaccatcgtgggagatggcaagtacggggccagagatgctgacaccaagatctggaatggcatggtgggggagctggtgtatggcaaggctgacatcgccatcgcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacacagaggagtttgaagatggccgggagacccagagcagcgagagcaccaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctgagcaagcagacagaaattgcctacggcaccctggacagcggcagcaccaaggagttcttccgccgcagcaagattgctgtgtttgacaagatgtggacctacatgaggtctgctgagcccagcgtgtttgtgaggaccacagctgagggcgtggcccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcagcctgcggacccctgtgaacctggccgtgctgaagctgtctgagcagggcgtgctggacaagctgaagaacaagtggtggtatgacaagggggagtgtggggccaaggacagcggcagcaaggagaagaccagcgccctgagcctgagcaatgtggccggggtcttctacatcctggtgggcggcctgggcctggccatgctggtggccctgattgagttctgctacaagagcagagctgaggccaagaggatgaaggtggccaagaatgcccagaacatcaaccccagcagcagccagaacagccagaactttgccacctacaaggagggctacaacgtgtatggaattgaatctgtgaagatctag

SEQ ID NO: 153893 - DNA, 2706 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaaggccgagaaggtgctgcagtttgatcctggcaccaagaatgtgacagccctgctgatggaggccaaggagctggaggcccgggtcatcatcctgagcgcctctgaagatgatgctgccaccgtgtacagagctgctgccatgctgaacatgactggaagtggctacgtgtggctggtgggggagcgggagatctctggaaatgccctgcgctatgccccagatggcatcctgggcctgcagctgatcaatggcaagaatgaaagtgcccacatcagtgatgctgtgggcgtggtggcccaggccgtgcatgagctgctggagaaggagaacatcacagaccccccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcattggagagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgaatctgctgctgaggccatccaggccgtgcgggacaacaagctgcacgccttcatctgggacagcgctgtgctggagtttgaggccagccagaagtgtgacctggtgaccactggagagctgttcttccgcagcggcttcggcatcggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcattgaaattgcctacaagaggcacaaggatgcccggaggaagcagatgcagctggcctttgctgctgtgaatgtgtggaggaagaacctgcagagcactggaggcggccgcggggccctgcagaaccagaaggacacagtgctgccccggcgggccatcgagcgggaggagggccagctgcagctgtgcagccgccaccgggagagctag

SEQ ID NO: 153894 - DNA, 2658 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaaggccgagaaggtgctgcagtttgatcctggcaccaagaatgtgacagccctgctgatggaggccaaggagctggaggcccgggtcatcatcctgagcgcctctgaagatgatgctgccaccgtgtacagagctgctgccatgctgaacatgactggaagtggctacgtgtggctggtgggggagcgggagatctctggaaatgccctgcgctatgccccagatggcatcctgggcctgcagctgatcaatggcaagaatgaaagtgcccacatcagtgatgctgtgggcgtggtggcccaggccgtgcatgagctgctggagaaggagaacatcacagaccccccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcattggagagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgaatctgctgctgaggccatccaggccgtgcgggacaacaagctgcacgccttcatctgggacagcgctgtgctggagtttgaggccagccagaagtgtgacctggtgaccactggagagctgttcttccgcagcggcttcggcatcggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcattgaaattgcctacaagaggcacaaggatgcccggaggaagcagatgcagctggcctttgctgctgtgaatgtgtggaggaagaacctgcagcagtaccaccccacagacatcaccggccccctgaacctgagtgaccccagcgtgtccacagtggtgtag

SEQ ID NO: 153895 - DNA, 2769 bp, Artificial Sequence
  Description of Artificial Sequence: Synthetic coding sequence
atggtgcagctgaggaagctgctgcgggtgctgaccctgatgaagttcccctgctgcgtgctggaggtgctgctgtgtgccctggccgctgctgcccggggccaggagatgtatgccccccacagcatcagaattgaaggagatgtgaccctgggcggcctcttccctgtgcacgccaagggccccagcggcgtgccctgtggggacatcaagagagaaaatggcatccaccggctggaggccatgctgtatgccctggaccagatcaacagcgaccccaacctgctgcccaacgtgaccctgggcgcccgcatcctggacacctgcagccgggacacctacgccctggagcagagcctgacctttgtgcaggccctgatccagaaggacaccagtgatgtgcgctgcaccaacggggagccccctgtgtttgtgaagccagagaaggtggtgggcgtcatcggggccagcggcagctctgtgtccatcatggtggccaacatcctgcggctcttccagatcccccagatctcctatgccagcacagcccctgagctgagtgatgaccggcgctatgacttcttcagccgggtggtgcccccagacagcttccaggcccaggccatggtggacatcgtgaaggccctgggctggaactacgtgtccaccctggccagcgagggcagctatggagagaagggcgtggagagcttcacccagatcagcaaggaggccggcggcctgtgcatcgcccagagcgtgcgcatcccccaggagaggaaggacaggaccatcgactttgaccgcatcatcaagcagctgctggacacccccaacagcagagctgtggtgatctttgccaatgatgaggacatcaagcagatcctggccgccgccaagagagctgaccaggtgggccacttcctgtgggtgggcagtgacagctggggcagcaagatcaaccccctgcaccagcatgaagatattgctgagggcgccatcaccatccagcccaagagggccaccgtggagggctttgatgcctacttcaccagcaggaccctggagaacaacagaagaaatgtgtggtttgctgagtactgggaggagaacttcaactgcaagctgaccatcagcggcagcaagaaggaggacacagacagaaaatgtacaggccaggagcgcatcggcaaggacagcaactatgagcaggagggcaaggtgcagtttgtgattgatgctgtgtatgccatggcccacgccctgcaccacatgaacaaggacctgtgtgccgactacagaggagtgtgcccagagatggagcaggccggcggcaagaagctgctgaagtacatcagaaatgtgaacttcaacggcagcgctggcacccctgtgatgttcaacaagaatggagatgcccctggccgctatgacatcttccagtaccagaccaccaacaccagcaaccctggctaccgcctgattggccagtggacagatgagctgcagctgaacatcgaggacatgcagtggggcaaaggagtgcgggagatcccagcctctgtgtgcaccctgccctgcaagccaggccagaggaagaagacccagaagggcaccccctgctgctggacctgtgagccctgtgatggctaccagtaccagtttgatgagatgacctgccagcactgcccctatgaccagaggcccaatgaaaatagaacaggctgccaggacatccccatcatcaagctggagtggcacagcccctgggccgtcatccctgtgttcctggccatgctgggcatcatcgccaccatctttgtgatggccaccttcatccgctacaatgacacccccatcgtgcgggccagcggccgggagctgtcctatgtgctgctgaccggcatcttcctgtgctacatcatcaccttcctgatgattgccaagccagatgtggccgtgtgcagcttccggcgggtcttcctgggcctgggcatgtgcatctcctatgctgccctgctgaccaagaccaaccgcatctaccgcatctttgagcagggcaagaagtctgtgacagcccccaggctcatcagccccaccagccagctggccatcaccagcagcctcatctctgtgcagctgctgggcgtcttcatctggtttggagtggacccccccaacatcatcatcgactatgatgagcacaagaccatgaaccctgagcaggcccggggcgtgctgaagtgtgacatcacagacctgcagatcatctgcagcctgggctacagcatcctgctgatggtgacctgcaccgtgtatgccatcaagacccggggcgtgcctgagaacttcaatgaggccaagcccatcggcttcaccatgtacaccacctgcatcgtgtggctggccttcatccccatcttctttggaacagcccagagcgctgagaagctgtacatccagaccaccaccctgaccatctccatgaacctgagcgcctctgtggccctgggcatgctgtacatgcccaaggtgtacatcatcatcttccaccctgagctgaatgtgcagaagaggaagaggagcttcaaggctgtggtgacagctgccaccatgagcagccggctgagccacaagcccagcgaccggcccaatggagaggccaagacagagctgtgtgaaaatgtggaccccaacaactgcatcccccctgtgaggaagtctgtgcagaagtctgtgacctggtacaccatccccccaacagtgtag

SEQ ID NO: 153896 - DNA, 2685 bp, Artificial Sequence
  Description of Artificial Sequence: Synthetic coding sequence
atggcccggcagaagaagatgggccagagcgtgctgcgggctgtgttcttcctggtgctgggcctgctgggccacagccatggaggcttccccaacaccatcagcatcggcggcctcttcatgaggaacacagtgcaggagcacagcgccttccgctttgctgtgcagctgtacaacaccaaccagaacaccacagagaagcccttccacctgaactaccacgtggaccacctggacagcagcaacagcttctctgtgaccaatgccttctgcagccagttcagcagaggagtgtatgccatcttcggcttctatgaccagatgtccatgaacaccctgaccagcttctgtggggccctgcacaccagctttgtgacccccagcttccccacagatgctgatgtgcagtttgtgatccagatgaggcctgccctgaagggggccatcctgagcctgctgggccactacaagtgggagaagtttgtgtacctgtatgacacagagcggggcttcagcatcctgcaggccatcatggaggccgctgtgcagaacaactggcaggtgacagcccggtctgtgggcaacatcaaggatgtgcaggagttccgccgcatcatcgaggagatggaccggcggcaggagaagcgctacctgattgactgtgaggtggagcgcatcaacaccatcctggagcaggtggtgatcctgggcaagcacagccggggctaccactacatgctggccaacctgggcttcacagacatcctgctggagcgggtgatgcacggcggggccaacatcaccggcttccagatcgtgaacaatgaaaaccccatggtgcagcagttcatccagcgctgggtgcggctggatgagcgggagttccctgaggccaagaatgcccccctgaagtacaccagcgccctgacccatgatgccatcctggtgattgctgaggccttccgctacctgcggcggcagagggtggatgtgtccagaagaggcagcgctggggactgcctggccaacccagctgtgccctggagccagggcatcgacatcgagcgggccctgaagatggtgcaggtgcagggcatgactggaaacatccagtttgacacctatggaagaaggaccaactacaccattgatgtgtatgagatgaaggtgtctggcagcaggaaggccggctactggaatgaatatgaaagatttgtgcccttcagtgaccagcagatcagcaatgattctgccagcagtgaaaatagaaccatcgtggtgaccaccatcctggagagcccctacgtgatgtacaagaagaaccacgagcagctggagggcaatgaaagatatgagggctactgtgtggacctggcctatgagatcgccaagcacgtgcgcatcaagtacaagctgagcatcgtgggagatggcaagtacggggcccgggaccctgagaccaagatctggaatggcatggtgggggagctggtgtatggccgggctgacattgctgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacctggaggacaacaatgaggagccccgggacccccagagccccccagaccccccaaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggacagcggcagcaccaaggagttcttccgccgcagcaagattgctgtgtatgagaagatgtggagctacatgaagtctgctgagcccagcgtcttcaccaagaccacagcagatggagtggcccgggtgaggaagagcaagggcaagtttgccttcctgctggagagcaccatgaatgagtacatcgagcagaggaagccctgtgacaccatgaaggtgggcggcaacctggacagcaagggctacggcgtggccacccccaagggcagcgccctgagaaatgctgtgaacctggccgtgctgaagctgaatgagcagggcctgctggacaagctgaagaacaagtggtggtatgacaagggggagtgtggcagcggcggcggggacagcaaggacaagaccagcgccctgagcctgagcaatgtggccggggtcttctacatcctggtgggcggcctgggcctggccatgatggtggccctgattgagttctgctacaagagcagagctgagagcaagaggatgaagctgaccaagaacacccagaacttcaagccagccccagccaccaacacccagaactatgccacctaccgggagggctacaacgtgtatggaacagaatctgtgaagatctag

SEQ ID NO: 153897 - DNA, 432 bp, Artificial Sequence
  Description of Artificial Sequence: Synthetic coding sequence
atggcccggcagaagaagatgggccagagcgtgctgcgggctgtgttcttcctggtgctgggcctgctgggccacagccatggaggcttccccaacaccatcagcatcggcggcctcttcatgaggaacacagtgcaggagcacagcgccttccgctttgctgtgcagctgtacaacaccaaccagaacaccacagagaagcccttccacctgaactaccacgtggaccacctggacagcagcaacagcttctctgtgaccaatgcctgcccagctgagcgggactacctgccctggccaggcagcatccgggagaacaactggacagccctgccctgctgcaaggaccacggcctgctgcacctgaagtgcagccctgggggccggcagaactgggcctactgcatctggggcgtgactggagagctgtag

SEQ ID NO: 153898 - DNA, 2685 bp, Artificial Sequence; identical to SEQ ID NO: 153896
  Description of Artificial Sequence: Synthetic coding sequence

SEQ ID NO: 153899 - DNA, 2685 bp, Artificial Sequence
  Description of Artificial Sequence: Synthetic coding sequence
atggcccggcagaagaagatgggccagagcgtgctgcgggctgtgttcttcctggtgctgggcctgctgggccacagccatggaggcttccccaacaccatcagcatcggcggcctcttcatgaggaacacagtgcaggagcacagcgccttccgctttgctgtgcagctgtacaacaccaaccagaacaccacagagaagcccttccacctgaactaccacgtggaccacctggacagcagcaacagcttctctgtgaccaatgccttctgcagccagttcagcagaggagtgtatgccatcttcggcttctatgaccagatgtccatgaacaccctgaccagcttctgtggggccctgcacaccagctttgtgacccccagcttccccacagatgctgatgtgcagtttgtgatccagatgaggcctgccctgaagggggccatcctgagcctgctgggccactacaagtgggagaagtttgtgtacctgtatgacacagagcggggcttcagcatcctgcaggccatcatggaggccgctgtgcagaacaactggcaggtgacagcccggtctgtgggcaacatcaaggatgtgcaggagttccgccgcatcatcgaggagatggaccggcggcaggagaagcgctacctgattgactgtgaggtggagcgcatcaacaccatcctggagcaggtggtgatcctgggcaagcacagccggggctaccactacatgctggccaacctgggcttcacagacatcctgctggagcgggtgatgcacggcggggccaacatcaccggcttccagatcgtgaacaatgaaaaccccatggtgcagcagttcatccagcgctgggtgcggctggatgagcgggagttccctgaggccaagaatgcccccctgaagtacaccagcgccctgacccatgatgccatcctggtgattgctgaggccttccgctacctgcggcggcagagggtggatgtgtccagaagaggcagcgctggggactgcctggccaacccagctgtgccctggagccagggcatcgacatcgagcgggccctgaagatggtgcaggtgcagggcatgactggaaacatccagtttgacacctatggaagaaggaccaactacaccattgatgtgtatgagatgaaggtgtctggcagcaggaaggccggctactggaatgaatatgaaagatttgtgcccttcagtgaccagcagatcagcaatgattctgccagcagtgaaaatagaaccatcgtggtgaccaccatcctggagagcccctacgtgatgtacaagaagaaccacgagcagctggagggcaatgaaagatatgagggctactgtgtggacctggcctatgagatcgccaagcacgtgcgcatcaagtacaagctgagcatcgtgggagatggcaagtacggggcccgggaccctgagaccaagatctggaatggcatggtgggggagctggtgtatggccgggctgacattgctgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacctggaggacaacaatgaggagccccgggacccccagagccccccagaccccccaaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggacagcggcagcaccaaggagttcttccgccgcagcaagattgctgtgtatgagaagatgtggagctacatgaagtctgctgagcccagcgtcttcaccaagaccacagcagatggagtggcccgggtgaggaagagcaagggcaagtttgccttcctgctggagagcaccatgaatgagtacatcgagcagaggaagccctgtgacaccatgaaggtgggcggcaacctggacagcaagggctacggcgtggccacccccaagggcagcgccctgcggacccctgtgaacctggccgtgctgaagctgtctgagcagggcatcctggacaagctgaagaacaagtggtggtatgacaagggggagtgtggggccaaggacagcggcagcaaggacaagaccagcgccctgagcctgagcaatgtggccggggtcttctacatcctggtgggcggcctgggcctggccatgatggtggccctgattgagttctgctacaagagcagagctgagagcaagaggatgaagctgaccaagaacacccagaacttcaagccagccccagccaccaacacccagaactatgccacctaccgggagggctacaacgtgtatggaacagaatctgtgaagatctag

SEQ ID NO: 153900 - DNA, 495 bp, Artificial Sequence
  Description of Artificial Sequence: Synthetic coding sequence
atggcccggcagaagaagatgggccagagcgtgctgcgggctgtgttcttcctggtgctgggcctgctgggccacagccatggaggcttccccaacaccatcagcatcggcggcctcttcatgaggaacacagtgcaggagcacagcgccttccgctttgctgtgcagctgtacaacaccaaccagaacaccacagagaagcccttccacctgaactaccacgtggaccacctggacagcagcaacagcttctctgtgaccaatgcctgcccagctgagcgggactacctgccctggccaggcagcatccgggagaacaactggacagccctgccctgctgcaaggaccacggcctgctgcacctgaagtgcagccctgggggccctgccaagacaggccccatcgtgtctggggccctgcaggtgaactgcaagatgaggaccaggagccaggtgtccaccaccagcagcctgctggagttcagcacagaatag

SEQ ID NO: 153901 - DNA, 495 bp, Artificial Sequence; identical to SEQ ID NO: 153900
  Description of Artificial Sequence: Synthetic coding sequence

SEQ ID NO: 153902 - DNA, 1989 bp, Artificial Sequence
  Description of Artificial Sequence: Synthetic coding sequence
atgctgcagggcggggaggagagccggctgtttggcagcctgctgtggaccctgccctggaggggcctcttcatgaggaacacagtgcaggagcacagcgccttccgctttgctgtgcagctgtacaacaccaaccagaacaccacagagaagcccttccacctgaactaccacgtggaccacctggacagcagcaacagcttctctgtgaccaatgccttctgcagccagttcagcagaggagtgtatgccatcttcggcttctatgaccagatgtccatgaacaccctgaccagcttctgtggggccctgcacaccagctttgtgacccccagcttccccacagatgctgatgtgcagtttgtgatccagatgaggcctgccctgaagggggccatcctgagcctgctgggccactacaagtgggagaagtttgtgtacctgtatgacacagagcggggcttcagcatcctgcaggccatcatggaggccgctgtgcagaacaactggcaggtgacagcccggtctgtgggcaacatcaaggatgtgcaggagttccgccgcatcatcgaggagatggaccggcggcaggagaagcgctacctgattgactgtgaggtggagcgcatcaacaccatcctggagcaggtggtgatcctgggcaagcacagccggggctaccactacatgctggccaacctgggcttcacagacatcctgctggagcgggtgatgcacggcggggccaacatcaccggcttccagatcgtgaacaatgaaaaccccatggtgcagcagttcatccagcgctgggtgcggctggatgagcgggagttccctgaggccaagaatgcccccctgaagtacaccagcgccctgacccatgatgccatcctggtgattgctgaggccttccgctacctgcggcggcagagggtggatgtgtccagaagaggcagcgctggggactgcctggccaacccagctgtgccctggagccagggcatcgacatcgagcgggccctgaagatggtgcaggtgcagggcatgactggaaacatccagtttgacacctatggaagaaggaccaactacaccattgatgtgtatgagatgaaggtgtctggcagcaggaaggccggctactggaatgaatatgaaagatttgtgcccttcagtgaccagcagatcagcaatgattctgccagcagtgaaaatagaaccatcgtggtgaccaccatcctggagagcccctacgtgatgtacaagaagaaccacgagcagctggagggcaatgaaagatatgagggctactgtgtggacctggcctatgagatcgccaagcacgtgcgcatcaagtacaagctgagcatcgtgggagatggcaagtacggggcccgggaccctgagaccaagatctggaatggcatggtgggggagctggtgtatggccgggctgacattgctgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacctggaggacaacaatgaggagccccgggacccccagagccccccagaccccccaaatgaatttggcatcttcaacagcctgtggttcagcctgggcgccttcatgcagcagggctgtgacatcagccccaggtttgtgtttgtggcctacagcatgccccactgcatcctgtggagctacagcatccacgtgcacatggtgttcatccacctgaacagccgcttcttctccttcaacatccccagcaatgaccggctgagcagcagccactgtgtgtgcctgtgcccctag

SEQ ID NO: 153903 - DNA, 2475 bp, Artificial Sequence
  Description of Artificial Sequence: Synthetic coding sequence
atggcccggcagaagaagatgggccagagcgtgctgcgggctgtgttcttcctggtgctgggcctgctgggccacagccatggaggcttccccaacaccatcagcatcggcggcctcttcatgaggaacacagtgcaggagcacagcgccttccgctttgctgtgcagctgtacaacaccaaccagaacaccacagagaagcccttccacctgaactaccacgtggaccacctggacagcagcaacagcttctctgtgaccaatgccttctgcagccagttcagcagaggagtgtatgccatcttcggcttctatgaccagatgtccatgaacaccctgaccagcttctgtggggccctgcacaccagctttgtgacccccagcttccccacagatgctgatgtgcagtttgtgatccagatgaggcctgccctgaagggggccatcctgagcctgctgggccactacaagtgggagaagtttgtgtacctgtatgacacagagcggggcttcagcatcctgcaggccatcatggaggccgctgtgcagaacaactggcaggtgacagcccggtctgtgggcaacatcaaggatgtgcaggagttccgccgcatcatcgaggagatggaccggcggcaggagaagcgctacctgattgactgtgaggtggagcgcatcaacaccatcctggagcaggtggtgatcctgggcaagcacagccggggctaccactacatgctggccaacctgggcttcacagacatcctgctggagcgggtgatgcacggcggggccaacatcaccggcttccagatcgtgaacaatgaaaaccccatggtgcagcagttcatccagcgctgggtgcggctggatgagcgggagttccctgaggccaagaatgcccccctgaagtacaccagcgccctgacccatgatgccatcctggtgattgctgaggccttccgctacctgcggcggcagagggtggatgtgtccagaagaggcagcgctggggactgcctggccaacccagctgtgccctggagccagggcatcgacatcgagcgggccctgaagatggtgcaggtgcagggcatgactggaaacatccagtttgacacctatggaagaaggaccaactacaccattgatgtgtatgagatgaaggtgtctggcagcaggaaggccggctactggaatgaatatgaaagatttgtgcccttcagtgaccagcagatcagcaatgattctgccagcagtgaaaatagaaccatcgtggtgaccaccatcctggagagcccctacgtgatgtacaagaagaaccacgagcagctggagggcaatgaaagatatgagggctactgtgtggacctggcctatgagatcgccaagcacgtgcgcatcaagtacaagctgagcatcgtgggagatggcaagtacggggcccgggaccctgagaccaagatctggaatggcatggtgggggagctggtgtatggccgggctgacattgctgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacctggaggacaacaatgaggagccccgggacccccagagccccccagaccccccaaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggacagcggcagcaccaaggagttcttccgccgcagcaagattgctgtgtatgagaagatgtggagctacatgaagtctgctgagcccagcgtcttcaccaagaccacagcagatggagtggcccgggtgaggaagagcaagggcaagtttgccttcctgctggagagcaccatgaatgagtacatcgagcagaggaagccctgtgacaccatgaaggtgggcggcaacctggacagcaagggctacggcgtggccacccccaagggcagcgccctgagaaatgctgtgaacctggccgtgctgaagctgaatgagcagggcctgctggacaagctgaagaacaagtggtggtatgacaagggggagtgtggcagcggcggcggggacagcaagaatgcctgcaagccctgcagcattgagacccagtag

SEQ ID NO: 153904 - DNA, 2709 bp, Artificial Sequence
  Description of Artificial Sequence: Synthetic coding sequence
atgaggatcatcagccggcagatcgtgctgctcttcagcggcttctggggcctggccatgggcgccttccccagctctgtgcagattggaggcctcttcatccggaacacagaccaggagtacacagccttccggctggccatcttcctgcacaacaccagccccaatgccagcgaggcccccttcaacctggtgccccacgtggacaacattgaaacagccaacagctttgctgtgaccaatgccttctgcagccagtacagccggggcgtgtttgccatcttcggcctgtatgacaagaggtctgtgcacaccctgaccagcttctgcagcgccctgcacatcagcctcatcacccccagcttccccacagaaggagagagccagtttgtgctgcagctgcggcccagcctgcggggggccctgctgagcctgctggaccactatgagtggaactgctttgtgttcctgtatgacacagaccggggctacagcatcctgcaggccatcatggagaaggccggccagaatggctggcacgtgtctgccatctgtgtggagaacttcaatgatgtgtcctaccggcagctgctggaggagctggaccggcggcaggagaagaagtttgtgattgactgtgaaattgagcggctgcagaacatcctggagcagatcgtgtctgtgggcaagcacgtgaagggctaccactacatcatcgccaacctgggcttcaaggacatcagcctggagcgcttcatccacggcggggccaacgtgacaggcttccagctggtggacttcaacacccccatggtgatcaagctgatggaccgctggaagaagctggaccagcgggagtacccaggcagcgagaccccacccaagtacaccagcgccctgacctatgatggagtgctggtgatggccgagaccttccgcagcctgcggcggcagaagattgacatcagcagaagaggaaatgctggggactgcctggccaacccagctgccccctggggccagggcatcgacatggagaggaccctgaagcaggtgcgcatccagggcctgactggaaatgtgcagtttgaccactacggccggcgggtgaactacaccatggatgtgtttgagctgaagagcacaggccccaggaaggtgggctactggaatgacatggacaagctggtgctgatccaggatgtgcccaccctgggcaatgacacagctgccattgaaaatagaacagtggtggtgaccaccatcatggagagcccctacgtgatgtacaagaagaaccacgagatgtttgagggcaatgacaagtatgagggctactgtgtggacctggccagcgagatcgccaagcacatcggcatcaagtacaagatcgccatcgtgcctgatggcaagtacggggccagagatgctgacaccaagatctggaatggcatggtgggggagctggtgtatggcaaggccgagatcgccatcgcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacacagaggagccagaagatggcaaggagggccccagcgaccagcccccaaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggacagcggcagcaccaaggagttcttccgccgcagcaagattgctgtgtatgagaagatgtggacctacatgaggtctgctgagcccagcgtcttcaccaggaccacagctgagggcgtggcccgggtgaggaagagcaagggcaagtttgccttcctgctggagagcaccatgaatgagtacatcgagcagaggaagccctgtgacaccatgaaggtgggcggcaacctggacagcaagggctacggcgtggccacccccaagggcagcagcctgcggacccctgtgaacctggccgtgctgaagctgtctgaggccggcgtgctggacaagctgaagaacaagtggtggtatgacaagggggagtgtggccccaaggacagcggcagcaaggacaagaccagcgccctgagcctgagcaatgtggccggggtcttctacatcctggtgggcggcctgggcctggccatgctggtggccctgattgagttctgctacaagagcagagctgaggccaagaggatgaagctgaccttcagcgaggccatccggaacaaggcccggctgagcatcaccggctctgtgggagaaaatggccgggtgctgaccccagactgccccaaggctgtgcacactggaacagccatccggcagagcagcggcctggccgtgattgccagtgacctgccctag

SEQ ID NO: 153905 - DNA, 1302 bp, Artificial Sequence
  Description of Artificial Sequence: Synthetic coding sequence
atgaggatcatcagccggcagatcgtgctgctcttcagcggcttctggggcctggccatgggcgccttccccagctctgtgcagattggaggcctcttcatccggaacacagaccaggagtacacagccttccggctggccatcttcctgcacaacaccagccccaatgccagcgaggcccccttcaacctggtgccccacgtggacaacattgaaacagccaacagctttgctgtgaccaatgccttctgcagccagtacagccggggcgtgtttgccatcttcggcctgtatgacaagaggtctgtgcacaccctgaccagcttctgcagcgccctgcacatcagcctcatcacccccagcttccccacagaaggagagagccagtttgtgctgcagctgcggcccagcctgcggggggccctgctgagcctgctggaccactatgagtggaactgctttgtgttcctgtatgacacagaccggggctacagcatcctgcaggccatcatggagaaggccggccagaatggctggcacgtgtctgccatctgtgtggagaacttcaatgatgtgtcctaccggcagctgctggaggagctggaccggcggcaggagaagaagtttgtgattgactgtgaaattgagcggctgcagaacatcctggagcagatcgtgtctgtgggcaagcacgtgaagggctaccactacatcatcgccaacctgggcttcaaggacatcagcctggagcgcttcatccacggcggggccaacgtgacaggcttccagctggtggacttcaacacccccatggtgatcaagctgatggaccgctggaagaagctggaccagcgggagtacccaggcagcgagaccccacccaagtacaccagcgccctgacctatgatggagtgctggtgatggccgagaccttccgcagcctgcggcggcagaagattgacatcagcagaagaggaaatgctggggactgcctggccaacccagctgccccctggggccagggcatcgacatggagaggaccctgaagcaggtgcgcatccagggcctgactggaaatgtgcagtttgaccactacggccggcgggtgaactacaccatggatgtgtttgagctgaagagcacaggccccaggaaggtgggctactggaatgacatggacaagctggtgctgatccaggatgtgcccaccctgggcaatgacacagctgccattgaaaatagaacagtggtggtgaccaccatcatgcccctgatgaagaaccccatcctgaggaactag

SEQ ID NO: 153906 - DNA, 2655 bp, Artificial Sequence
  Description of Artificial Sequence: Synthetic coding sequence
atgaggatcatcagccggcagatcgtgctgctcttcagcggcttctggggcctggccatgggcgccttccccagctctgtgcagattggaggcctcttcatccggaacacagaccaggagtacacagccttccggctggccatcttcctgcacaacaccagccccaatgccagcgaggcccccttcaacctggtgccccacgtggacaacattgaaacagccaacagctttgctgtgaccaatgccttctgcagccagtacagccggggcgtgtttgccatcttcggcctgtatgacaagaggtctgtgcacaccctgaccagcttctgcagcgccctgcacatcagcctcatcacccccagcttccccacagaaggagagagccagtttgtgctgcagctgcggcccagcctgcggggggccctgctgagcctgctggaccactatgagtggaactgctttgtgttcctgtatgacacagaccggggctacagcatcctgcaggccatcatggagaaggccggccagaatggctggcacgtgtctgccatctgtgtggagaacttcaatgatgtgtcctaccggcagctgctggaggagctggaccggcggcaggagaagaagtttgtgattgactgtgaaattgagcggctgcagaacatcctggagcagatcgtgtctgtgggcaagcacgtgaagggctaccactacatcatcgccaacctgggcttcaaggacatcagcctggagcgcttcatccacggcggggccaacgtgacaggcttccagctggtggacttcaacacccccatggtgatcaagctgatggaccgctggaagaagctggaccagcgggagtacccaggcagcgagaccccacccaagtacaccagcgccctgacctatgatggagtgctggtgatggccgagaccttccgcagcctgcggcggcagaagattgacatcagcagaagaggaaatgctggggactgcctggccaacccagctgccccctggggccagggcatcgacatggagaggaccctgaagcaggtgcgcatccagggcctgactggaaatgtgcagtttgaccactacggccggcgggtgaactacaccatggatgtgtttgagctgaagagcacaggccccaggaaggtgggctactggaatgacatggacaagctggtgctgatccaggatgtgcccaccctgggcaatgacacagctgccattgaaaatagaacagtggtggtgaccaccatcatggagagcccctacgtgatgtacaagaagaaccacgagatgtttgagggcaatgacaagtatgagggctactgtgtggacctggccagcgagatcgccaagcacatcggcatcaagtacaagatcgccatcgtgcctgatggcaagtacggggccagagatgctgacaccaagatctggaatggcatggtgggggagctggtgtatggcaaggccgagatcgccatcgcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacacagaggagccagaagatggcaaggagggccccagcgaccagcccccaaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggacagcggcagcaccaaggagttcttccgccgcagcaagattgctgtgtatgagaagatgtggacctacatgaggtctgctgagcccagcgtcttcaccaggaccacagctgagggcgtggcccgggtgaggaagagcaagggcaagtttgccttcctgctggagagcaccatgaatgagtacatcgagcagaggaagccctgtgacaccatgaaggtgggcggcaacctggacagcaagggctacggcgtggccacccccaagggcagcagcctgagaaatgctgtgaacctggccgtgctgaagctgaatgagcagggcctgctggacaagctgaagaacaagtggtggtatgacaagggggagtgtggcagcggcggcggggacagcaaggacaagaccagcgccctgagcctgagcaatgtggccggggtcttctacatcctggtgggcggcctgggcctggccatgctggtggccctgattgagttctgctacaagagcagagctgaggccaagaggatgaaggtggccaagagcgcccagaccttcaaccccaccagcagccagaacacccagaacctggccacctaccgggagggctacaacgtgtatggaacagagagcatcaagatctag

SEQ ID NO: 153907 - DNA, 1302 bp, Artificial Sequence; identical to SEQ ID NO: 153905
  Description of Artificial Sequence: Synthetic coding sequence

SEQ ID NO: 153908 - DNA, 2655 bp, Artificial Sequence; identical to SEQ ID NO: 153906
  Description of Artificial Sequence: Synthetic coding sequence

SEQ ID NO: 153909 - DNA, 249 bp, Artificial Sequence
  Description of Artificial Sequence: Synthetic coding sequence
atgaggatcatcagccggcagatcgtgctgctcttcagcggcttctggggcctggccatgggcgccttccccagctctgtgcagattggaggcctcttcatccggaacacagaccaggagtacacagccttccggctggccatcttcctgcacaacaccagccccaatgccagcgaggcccccttcaacctggtgccccacgtggacaacattgaaacagccaacagctttgctgtgaccaatgcctag

SEQ ID NO: 153910 - DNA, 249 bp, Artificial Sequence; identical to SEQ ID NO: 153909
  Description of Artificial Sequence: Synthetic coding sequence

SEQ ID NO: 153911 - DNA, 2709 bp, Artificial Sequence; identical to SEQ ID NO: 153904
  Description of Artificial Sequence: Synthetic coding sequence

SEQ ID NO: 153912 - DNA, 360 bp, Artificial Sequence
  Description of Artificial Sequence: Synthetic coding sequence
atgaggtctgctgagcccagcgtcttcaccaggaccacagctgagggcgtggcccgggtgaggaagagcaagggcaagtttgccttcctgctggagagcaccatgaatgagtacatcgagcagaggaagccctgtgacaccatgaaggtgggcggcaacctggacagcaagggctatggagtggccacccccaagggcagcagcctgagaaatgctgtgaacctggccgtgctgaagctgaatgagcagggcctgctggacaagctgaagaacaagtggtggtatgacaagggagaatgtggcagcggcggcggggacagcaagaacagctgcaagccctgccgctttgagacccagtag

SEQ ID NO: 153913 - DNA, 2721 bp, Artificial Sequence
  Description of Artificial Sequence: Synthetic coding sequence
atgcagcacatctttgccttcttctgcaccggcttcctgggcgctgtggtgggcgccaacttccccaacaacatccagattggaggcctcttccccaaccagcagagccaggagcacgccgccttccgctttgccctgagccagctgacagagccccccaagctgctgccccagattgatattgtgaacatcagtgacagctttgagatgacctaccgcttctgcagccagttcagcaagggcgtgtatgccatcttcggcttctatgaaagaagaacagtgaacatgctgaccagcttctgtggggccctgcacgtgtgcttcatcacccccagcttccctgtggacaccagcaaccagtttgtgctgcagctgcggcctgagctgcaggatgccctgatcagcatcatcgaccactacaagtggcagaagtttgtgtacatctatgatgctgaccggggcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggcatcggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgagaagggccgccgcaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtacggggcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggaggccggcagcaccaaggagttcttccgccgcagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcgccctgagaaatcctgtgaacctggccgtgctgaagctgaatgagcagggcctgctggacaagctgaagaacaagtggtggtatgacaagggggagtgtggcagcggcggcggggacagcaaggacaagaccagcgccctgagcctgagcaatgtggccggggtcttctacatcctgattggaggcctgggcctggccatgctggtggccctgattgagttctgctacaagagccgctctgagagcaagaggatgaagggcttctgcctgatcccccagcagagcatcaatgaggccatccgcaccagcaccctgcccagaaattctggagctggggccagcagcggcggcagcggggagaatggccgggtggtgtcccatgacttccccaagtccatgcagagcatcccctgcatgagccacagcagcggcatgcccctgggcgccaccggcctgtag

SEQ ID NO: 153914 - DNA, 2721 bp, Artificial Sequence
  Description of Artificial Sequence: Synthetic coding sequence
atgcagcacatctttgccttcttctgcaccggcttcctgggcgctgtggtgggcgccaacttccccaacaacatccagattggaggcctcttccccaaccagcagagccaggagcacgccgccttccgctttgccctgagccagctgacagagccccccaagctgctgccccagattgatattgtgaacatcagtgacagctttgagatgacctaccgcttctgcagccagttcagcaagggcgtgtatgccatcttcggcttctatgaaagaagaacagtgaacatgctgaccagcttctgtggggccctgcacgtgtgcttcatcacccccagcttccctgtggacaccagcaaccagtttgtgctgcagctgcggcctgagctgcaggatgccctgatcagcatcatcgaccactacaagtggcagaagtttgtgtacatctatgatgctgaccggggcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggcatcggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgagaagggccgccgcaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtacggggcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggaggccggcagcaccaaggagttcttccgccgcagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcgccctgcggggccctgtgaacctggccgtgctgaagctgtctgagcagggcgtgctggacaagctgaagagcaagtggtggtatgacaagggggagtgtggcagcaaggacagcggcagcaaggacaagaccagcgccctgagcctgagcaatgtggccggggtcttctacatcctgattggaggcctgggcctggccatgctggtggccctgattgagttctgctacaagagccgctctgagagcaagaggatgaagggcttctgcctgatcccccagcagagcatcaatgaggccatccgcaccagcaccctgcccagaaattctggagctggggccagcagcggcggcagcggggagaatggccgggtggtgtcccatgacttccccaagtccatgcagagcatcccctgcatgagccacagcagcggcatgcccctgggcgccaccggcctgtag

SEQ ID NO: 153915 - DNA, 2751 bp, Artificial Sequence
  Description of Artificial Sequence: Synthetic coding sequence
atgtgctgcagcacccacctgttccagcccctgcagctggccggcggcctggagtggccctggagcaacctgctgtgcttcctgacccctgtgaagctgcaccctgaggtgtggggcctcttccccaaccagcagagccaggagcacgccgccttccgctttgccctgagccagctgacagagccccccaagctgctgccccagattgatattgtgaacatcagtgacagctttgagatgacctaccgcttctgcagccagttcagcaagggcgtgtatgccatcttcggcttctatgaaagaagaacagtgaacatgctgaccagcttctgtggggccctgcacgtgtgcttcatcacccccagcttccctgtggacaccagcaaccagtttgtgctgcagctgcggcctgagctgcaggatgccctgatcagcatcatcgaccactacaagtggcagaagtttgtgtacatctatgatgctgaccggggcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggcatcggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgagaagggccgccgcaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtacggggcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggaggccggcagcaccaaggagttcttccgccgcagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcgccctgcggggccctgtgaacctggccgtgctgaagctgtctgagcagggcgtgctggacaagctgaagagcaagtggtggtatgacaagggggagtgtggcagcaaggacagcggcagcaaggacaagaccagcgccctgagcctgagcaatgtggccggggtcttctacatcctgattggaggcctgggcctggccatgctggtggccctgattgagttctgctacaagagccgctctgagagcaagaggatgaagggcttctgcctgatcccccagcagagcatcaatgaggccatccgcaccagcaccctgcccagaaattctggagctggggccagcagcggcggcagcggggagaatggccgggtggtgtcccatgacttccccaagtccatgcagagcatcccctgcatgagccacagcagcggcatgcccctgggcgccaccggcctgtag

SEQ ID NO: 153916 - DNA, 2481 bp, Artificial Sequence
  Description of Artificial Sequence: Synthetic coding sequence
atgcagcacatctttgccttcttctgcaccggcttcctgggcgctgtggtgggcgccaacttccccaacaacatccagattggaggcctcttccccaaccagcagagccaggagcacgccgccttccgctttgccctgagccagctgacagagccccccaagctgctgccccagattgatattgtgaacatcagtgacagctttgagatgacctaccgctgcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggcatcggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgagaagggccgccgcaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtacggggcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggaggccggcagcaccaaggagttcttccgccgcagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcgccctgagaaatcctgtgaacctggccgtgctgaagctgaatgagcagggcctgctggacaagctgaagaacaagtggtggtatgacaagggggagtgtggcagcggcggcggggacagcaaggacaagaccagcgccctgagcctgagcaatgtggccggggtcttctacatcctgattggaggcctgggcctggccatgctggtggccctgattgagttctgctacaagagccgctctgagagcaagaggatgaagggcttctgcctgatcccccagcagagcatcaatgaggccatccgcaccagcaccctgcccagaaattctggagctggggccagcagcggcggcagcggggagaatggccgggtggtgtcccatgacttccccaagtccatgcagagcatcccctgcatgagccacagcagcggcatgcccctgggcgccaccggcctgtag

SEQ ID NO: 153917 - DNA, 2751 bp, Artificial Sequence
  Description of Artificial Sequence: Synthetic coding sequence
atgtgctgcagcacccacctgttccagcccctgcagctggccggcggcctggagtggccctggagcaacctgctgtgcttcctgacccctgtgaagctgcaccctgaggtgtggggcctcttccccaaccagcagagccaggagcacgccgccttccgctttgccctgagccagctgacagagccccccaagctgctgccccagattgatattgtgaacatcagtgacagctttgagatgacctaccgcttctgcagccagttcagcaagggcgtgtatgccatcttcggcttctatgaaagaagaacagtgaacatgctgaccagcttctgtggggccctgcacgtgtgcttcatcacccccagcttccctgtggacaccagcaaccagtttgtgctgcagctgcggcctgagctgcaggatgccctgatcagcatcatcgaccactacaagtggcagaagtttgtgtacatctatgatgctgaccggggcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggcatcggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgagaagggccgccgcaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtacggggcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggaggccggcagcaccaaggagttcttccgccgcagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcgccctgagaaatcctgtgaacctggccgtgctgaagctgaatgagcagggcctgctggacaagctgaagaacaagtggtggtatgacaagggggagtgtggcagcggcggcggggacagcaaggacaagaccagcgccctgagcctgagcaatgtggccggggtcttctacatcctgattggaggcctgggcctggccatgctggtggccctgattgagttctgctacaagagccgctctgagagcaagaggatgaagggcttctgcctgatcccccagcagagcatcaatgaggccatccgcaccagcaccctgcccagaaattctggagctggggccagcagcggcggcagcggggagaatggccgggtggtgtcccatgacttccccaagtccatgcagagcatcccctgcatgagccacagcagcggcatgcccctgggcgccaccggcctgtag

SEQ ID NO: 153918 - DNA, 2151 bp, Artificial Sequence
  Description of Artificial Sequence: Synthetic coding sequence
atgcagcacatctttgccttcttctgcaccggcttcctgggcgctgtggtgggcgccaacttccccaacaacatccagatcgtgtgcagccagttcagcaagggcgtgtatgccatcttcggcttctatgaaagaagaacagtgaacatgctgaccagcttctgtggggccctgcacgtgtgcttcatcacccccagcttccctgtggacaccagcaaccagtttgtgctgcagctgcggcctgagctgcaggatgccctgatcagcatcatcgaccactacaagtggcagaagtttgtgtacatctatgatgctgaccggggcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggcatcggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgagaagggccgccgcaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtacggggcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctggccaagcagacagaaattgcctacggcaccctggaggccggcagcaccaaggagttcttccgccgcagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcgccctgcggacccggcaggccctgtag

SEQ ID NO: 153919 - DNA, 2721 bp, Artificial Sequence; identical to SEQ ID NO: 153914
  Description of Artificial Sequence: Synthetic coding sequence

SEQ ID NO: 153920 - DNA, 2514 bp, Artificial Sequence
  Description of Artificial Sequence: Synthetic coding sequence
atgacctaccgcttctgcagccagttcagcaaaggagtgtatgccatcttcggcttctatgaaagaagaacagtgaacatgctgaccagcttctgtggggccctgcacgtgtgcttcatcacccccagcttccctgtggacaccagcaaccagtttgtgctgcagctgcggcctgagctgcaggatgccctgatcagcatcatcgaccactacaagtggcagaagtttgtgtacatctatgatgctgaccggggcctgtctgtgctgcagaaggtgctggacacagctgctgagaagaactggcaggtgacagctgtgaacatcctgaccaccacagaggagggctacaggatgctgttccaggacctggagaagaagaaggagcggctggtggtggtggactgtgagagcgagcggctgaatgccatcctgggccagatcatcaagctggagaagaatggaattggctaccactacatcctggccaacctgggcttcatggacatcgacctgaacaagttcaaggagagcggggccaacgtgacaggcttccagctggtgaactacacagacaccatcccagccaagatcatgcagcagtggaagaacagtgatgcccgggaccacaccagggtggactggaagaggcccaagtacaccagcgccctgacctatgatggagtgaaggtgatggccgaggccttccagagcctgcggcggcagagaattgacatcagcagaagaggaaatgctggggactgcctggccaacccagctgtgccctggggccagggcatcgacatccagagggccctgcagcaggtgcgctttgagggcctgactggaaatgtgcagttcaatgaaaaaggaagaaggaccaactacaccctgcacgtgattgagatgaagcatgatggcatcaggaagattggctactggaatgaagatgacaagtttgtgcctgctgccacagatgcccaggccggcggggacaacagctctgtgcagaacagaacctacatcgtgaccaccatcctggaggacccctacgtgatgctgaagaagaatgccaaccagtttgagggcaatgacagatatgagggctactgtgtggagctggccgctgagatcgccaagcacgtgggctacagctaccgcctggagatcgtgtctgatggcaagtatggagcccgggaccctgacaccaaggcctggaatggcatggtgggggagctggtgtatggccgggcagatgtggccgtggcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacagcgaggagtttgaggagggccgggaccagaccaccagtgaccagagcaatgaatttggcatcttcaacagcctgtggttcagcctgggcgccttcatgcagcagggctgtgacatcagccccaggagcctgagcggcagaattgtgggcggcgtgtggtggttcttcaccctcatcatcatcagcagctacacagccaacctggccgccttcctgactgtggagaggatggtgagccccatcgagagcgctgaggacctggccaagcagacagagatcgcctacggcaccctggaggccggcagcaccaaggagttcttcagaagaagcaagattgctgtgtttgagaagatgtggacctacatgaagtctgctgagcccagcgtgtttgtgaggaccacagaggagggcatgatccgggtgaggaagagcaagggcaagtatgcctacctgctggagagcaccatgaatgagtacatcgagcagaggaagccctgtgacaccatgaaggtgggcggcaacctggacagcaagggctatggaattgccacccccaagggcagcgccctgaggaaccctgtgaacctggccgtgctgaagctgaatgagcagggcctgctggacaagctgaagaacaagtggtggtatgacaagggagaatgtggcagcggcggcggggacagcaaggacaagaccagcgccctgagcctgagcaatgtggccggggtcttctacatcctgattggaggcctgggcctggccatgctggtggccctgattgagttctgctacaagagccgctctgagagcaagaggatgaagggcttctgcctgatcccccagcagagcatcaatgaggccatccgcaccagcaccctgcccaggaacagcggggccggggccagcagcggcggcagcggagaaaatggccgggtggtgtcccatgacttccccaagtccatgcagagcatcccctgcatgagccacagcagcggcatgcccctgggcgccaccggcctgtag

SEQ ID NO: 153921 - DNA, 2652 bp, Artificial Sequence
  Description of Artificial Sequence: Synthetic coding sequence
atgcagaagatcatgcacatctctgtgctgctgagccctgtgctgtggggcctcatcttcggcgtgagcagcaacagcatccagattggaggcctcttccccagaggagctgaccaggagtacagcgccttccgggtgggcatggtgcagttcagcaccagcgagttccggctgaccccccacatcgacaacctggaggtggccaacagctttgctgtgaccaatgccttctgcagccagttcagccggggcgtgtatgccatcttcggcttctatgacaagaagtctgtgaacaccatcaccagcttctgtggcaccctgcacgtgtccttcatcacccccagcttccccacagatggcacccaccccttcgtcatccagatgaggccagacctgaagggggccctgctgagcctcatcgagtactaccagtgggacaagtttgcctacctgtatgacagcgaccggggcctgagcaccctgcaggccgtgctggacagcgctgctgagaagaagtggcaggtgacagccatcaacgtgggcaacatcaacaatgacaagaaggatgagatgtaccgcagcctcttccaggacctggagctgaagaaggagaggagggtcatcctggactgtgagcgggacaaggtgaatgacatcgtggaccaggtgatcaccatcggcaagcacgtgaagggctaccactacatcatcgccaacctgggcttcacagatggagacctgctgaagatccagtttggaggagccaacgtgtctggcttccagatcgtggactatgatgacagcctggtgtccaagttcatcgagcgctggagcaccctggaggagaaggagtacccaggggcccacaccaccaccatcaagtacaccagcgccctgacctatgatgctgtgcaggtgatgacagaggccttcaggaacctgaggaagcagagaattgagatcagcagaagaggaaatgctggggactgcctggccaacccagctgtgccctggggccagggcgtggagattgaaagagccctgaagcaggtgcaggtggagggcctgagcggcaacatcaagtttgaccagaatggcaagaggatcaactacaccatcaacatcatggagctgaagaccaacggccccaggaagattggctactggagcgaggtggacaagatggtggtgaccctgacagagctgcccagcggaaatgacaccagcggcctggagaacaagacagtggtggtgaccaccatcctggagagcccctacgtgatgatgaagaagaaccacgagatgctggagggcaatgaaagatatgagggctactgtgtggacctggccgctgagatcgccaagcactgcggcttcaagtacaagctgaccatcgtgggagatggcaagtatggagccagagatgctgacaccaagatctggaatggcatggtgggggagctggtgtatggcaaggctgacatcgccatcgcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacacagaggagtttgaagatggccgggagacccagagcagcgagagcaccaatgaatttggcatcttcaacagcctgtggttcagcctgggcgccttcatgcagcagggctgtgacatcagccccaggagcctgagcggcagaattgtgggcggcgtgtggtggttcttcaccctcatcatcatcagcagctacacagccaacctggccgccttcctgactgtggagaggatggtgagccccatcgagagcgctgaggacctgagcaagcagacagagatcgcctacggcaccctggacagcggcagcaccaaggagttcttcagaagaagcaagattgctgtgtttgacaagatgtggacctacatgaggtctgctgagcccagcgtgtttgtgaggaccacagctgagggcgtggcccgggtgaggaagagcaagggcaagtatgcctacctgctggagagcaccatgaatgagtacatcgagcagaggaagccctgtgacaccatgaaggtgggcggcaacctggacagcaagggctatggaattgccacccccaagggcagcagcctgagaaatgctgtgaacctggccgtgctgaagctgaatgagcagggcctgctggacaagctgaagaacaagtggtggtatgacaagggagaatgtggcagcggcggcggggacagcaaggagaagaccagcgccctgagcctgagcaatgtggccggggtcttctacatcctggtgggcggcctgggcctggccatgctggtggccctgattgagttctgctacaagagcagagctgaggccaagaggatgaaggtggccaagaatgcccagaacatcaaccccagcagcagccagaacagccagaactttgccacctacaaggagggctacaacgtgtatggcatcgagagcgtgaagatctag

SEQ ID NO: 153922 - DNA, 2652 bp, Artificial Sequence
  Description of Artificial Sequence: Synthetic coding sequence
atgcagaagatcatgcacatctctgtgctgctgagccctgtgctgtggggcctcatcttcggcgtgagcagcaacagcatccagattggaggcctcttccccagaggagctgaccaggagtacagcgccttccgggtgggcatggtgcagttcagcaccagcgagttccggctgaccccccacatcgacaacctggaggtggccaacagctttgctgtgaccaatgccttctgcagccagttcagccggggcgtgtatgccatcttcggcttctatgacaagaagtctgtgaacaccatcaccagcttctgtggcaccctgcacgtgtccttcatcacccccagcttccccacagatggcacccaccccttcgtcatccagatgaggccagacctgaagggggccctgctgagcctcatcgagtactaccagtgggacaagtttgcctacctgtatgacagcgaccggggcctgagcaccctgcaggccgtgctggacagcgctgctgagaagaagtggcaggtgacagccatcaacgtgggcaacatcaacaatgacaagaaggatgagatgtaccgcagcctcttccaggacctggagctgaagaaggagaggagggtcatcctggactgtgagcgggacaaggtgaatgacatcgtggaccaggtgatcaccatcggcaagcacgtgaagggctaccactacatcatcgccaacctgggcttcacagatggagacctgctgaagatccagtttggaggagccaacgtgtctggcttccagatcgtggactatgatgacagcctggtgtccaagttcatcgagcgctggagcaccctggaggagaaggagtacccaggggcccacaccaccaccatcaagtacaccagcgccctgacctatgatgctgtgcaggtgatgacagaggccttcaggaacctgaggaagcagagaattgagatcagcagaagaggaaatgctggggactgcctggccaacccagctgtgccctggggccagggcgtggagattgaaagagccctgaagcaggtgcaggtggagggcctgagcggcaacatcaagtttgaccagaatggcaagaggatcaactacaccatcaacatcatggagctgaagaccaacggccccaggaagattggctactggagcgaggtggacaagatggtggtgaccctgacagagctgcccagcggaaatgacaccagcggcctggagaacaagacagtggtggtgaccaccatcctggagagcccctacgtgatgatgaagaagaaccacgagatgctggagggcaatgaaagatatgagggctactgtgtggacctggccgctgagatcgccaagcactgcggcttcaagtacaagctgaccatcgtgggagatggcaagtatggagccagagatgctgacaccaagatctggaatggcatggtgggggagctggtgtatggcaaggctgacatcgccatcgcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacacagaggagtttgaagatggccgggagacccagagcagcgagagcaccaatgaatttggcatcttcaacagcctgtggttcagcctgggcgccttcatgcagcagggctgtgacatcagccccaggagcctgagcggcagaattgtgggcggcgtgtggtggttcttcaccctcatcatcatcagcagctacacagccaacctggccgccttcctgactgtggagaggatggtgagccccatcgagagcgctgaggacctgagcaagcagacagagatcgcctacggcaccctggacagcggcagcaccaaggagttcttcagaagaagcaagattgctgtgtttgacaagatgtggacctacatgaggtctgctgagcccagcgtgtttgtgaggaccacagctgagggcgtggcccgggtgaggaagagcaagggcaagtatgcctacctgctggagagcaccatgaatgagtacatcgagcagaggaagccctgtgacaccatgaaggtgggcggcaacctggacagcaagggctatggaattgccacccccaagggcagcagcctgcggacccctgtgaacctggccgtgctgaagctgtctgagcagggcgtgctggacaagctgaagaacaagtggtggtatgacaagggagaatgtggggccaaggacagcggcagcaaggagaagaccagcgccctgagcctgagcaatgtggccggggtcttctacatcctggtgggcggcctgggcctggccatgctggtggccctgattgagttctgctacaagagcagagctgaggccaagaggatgaaggtggccaagaatgcccagaacatcaaccccagcagcagccagaacagccagaactttgccacctacaaggagggctacaacgtgtatggcatcgagagcgtgaagatctag

SEQ ID NO: 153923 - DNA, 2193 bp, Artificial Sequence
  Description of Artificial Sequence: Synthetic coding sequence
atggtgcagttcagcaccagcgagttccggctgaccccccacatcgacaacctggaggtggccaacagctttgctgtgaccaatgccttctgcagccagttcagcagaggagtgtatgccatcttcggcttctatgacaagaagtctgtgaacaccatcaccagcttctgtggcaccctgcacgtgtccttcatcacccccagcttccccacagatggcacccacccctttgtgatccagatgaggccagacctgaagggggccctgctgagcctgattgagtactaccagtgggacaagtttgcctacctgtatgacagcgaccggggcctgagcaccctgcaggccgtgctggacagcgctgctgagaagaagtggcaggtgacagccatcaacgtgggcaacatcaacaatgacaagaaggatgagatgtaccgcagcctcttccaggacctggagctgaagaaggagcggcgggtcatcctggactgtgagcgggacaaggtgaatgacatcgtggaccaggtgatcaccatcggcaagcacgtgaagggctaccactacatcatcgccaacctgggcttcacagatggagacctgctgaagatccagtttggaggagccaacgtgtctggcttccagatcgtggactatgatgacagcctggtgtccaagttcatcgagcgctggagcaccctggaggagaaggagtacccaggggcccacaccaccaccatcaagtacaccagcgccctgacctatgatgctgtgcaggtgatgacagaggccttcaggaacctgaggaagcagagaattgagatcagcagaagaggaaatgctggggactgcctggccaacccagctgtgccctggggccagggcgtggagattgagcgggccctgaagcaggtgcaggtggagggcctgagcggcaacatcaagtttgaccagaatggcaagaggatcaactacaccatcaacatcatggagctgaagaccaacggccccaggaagattggctactggagcgaggtggacaagatggtggtgaccctgacagagctgcccagcggaaatgacaccagcggcctggagaacaagacagtggtggtgaccaccatcctggagagcccctacgtgatgatgaagaagaaccacgagatgctggagggcaatgaaagatatgagggctactgtgtggacctggccgctgagatcgccaagcactgcggcttcaagtacaagctgaccatcgtgggagatggcaagtacggggccagagatgctgacaccaagatctggaatggcatggtgggggagctggtgtatggcaaggctgacatcgccatcgcccccctgaccatcaccctggtgcgggaggaggtgattgacttcagcaagcccttcatgagcctgggcatcagcatcatgatcaagaagccccagaagagcaagccaggagtcttctccttcctggaccccctggcctatgagatctggatgtgcatcgtgtttgcctacatcggcgtgtctgtggtgctcttcctggtgagccgcttcagcccctatgagtggcacacagaggagtttgaagatggccgggagacccagagcagcgagagcaccaatgaatttggcatcttcaacagcctgtggttcagcctgggcgccttcatgcagcagggctgtgacatcagccccaggagcctgagcggccgcatcgtgggcggcgtgtggtggttcttcaccctcatcatcatcagcagctacacagccaacctggccgccttcctgactgtggagaggatggtgagccccattgaatctgctgaggacctgagcaagcagacagaaattgcctacggcaccctggacagcggcagcaccaaggagttcttccgccgcagcaagattgctgtgtttgacaagatgtggacctacatgaggtctgctgagcccagcgtgtttgtgaggaccacagctgagggcgtggcccgggtgaggaagagcaagggcaagtatgcctacctgctggagagcaccatgaatgagtacatcgagcagaggaagccctgtgacaccatgaaggtgggcggcaacctggacagcaagggctacggcatcgccacccccaagggcagcagcctgtctggagtgaccttcaagaccctgctgtttgtgtgctgcggctag

SEQ ID NO: 153924 - DNA, 297 bp, Artificial Sequence
  Description of Artificial Sequence: Synthetic coding sequence
atgaatgagtacatcgagcagaggaagccctgtgacaccatgaaggtgggcggcaacctggacagcaagggctatggaattgccacccccaagggcagcagcctgagcggcgtgaccttcaagaccctcatctgcctgctgtggatcaatgctgtgaacctggccgtgctgaagctgaatgagcagggcctgctggacaagctgaagaacaagtggtggtatgacaagggggagtgtggcagcggcggcggggacagcaagaaccccagcaagagctgcagcattgagacccagtag

SEQ ID NO: 153925 - DNA, 2511 bp, Artificial Sequence; identical to SEQ ID NO: 153892
  Description of Artificial Sequence: Synthetic coding sequence

SEQ ID NO: 153926 - DNA, 438 bp, Artificial Sequence
  Description of Artificial Sequence: Synthetic coding sequence
atggtgcagttcagcaccagcgagttccggctgaccccccacatcgacaacctggaggtggccaacagctttgctgtgaccaatgccttctgcagccagttcagcagaggagtgtatgccatcttcggcttctatgacaagaagtctgtgaacaccatcaccagcttctgtggcaccctgcacgtgtccttcatcacccccagcttccccacagatggcacccacccctttgtgatccagatgaggccagacctgaagggggccctgctgagcctgattgagtactaccagtgggacaagtttgcctacctgtatgacagcgaccggggcctgagcaccctgcaggccgtgctggacagcgctgctgagaagaagtggcaggtgacagccatcaacgtgggcaacatcaacaatgacaagaaggatgagatgtactag

SEQ ID NO: 153927 - DNA, 174 bp, Artificial Sequence
  Description of Artificial Sequence: Synthetic coding sequence
atggtgcagttcagcaccagcgagttccggctgaccccccacatcgacaacctggaggtggccaacagctttgctgtgaccaatgccttctgcagccagttcagcagaggagtgtatgccatcttcggcttctatgacaagaagtctgtgaacaccatcaccagcttctgctag

SEQ ID NO: 153928 - DNA, 2511 bp, Artificial Sequence; identical to SEQ ID NO: 153892
  Description of Artificial Sequence: Synthetic coding sequence

SEQ ID NO: 153929 - DNA, 378 bp, Artificial Sequence
  Description of Artificial Sequence: Synthetic coding sequence
atgcagaagatcatgcacatctctgtgctgctgagccctgtgctgtggggcctcatcttcggcgtgagcagcaacagcatccagattggaggcctcttccccagaggagctgaccaggagtacagcgccttccgggtgggcatggtgcagttcagcaccagcgagttccggctgaccccccacatcgacaacctggaggtggccaacagctttgctgtgaccaatgccttctgcagccagttcagccggggcgtgtatgccatcttcggcttctatgacaagaagtctgtgaacaccatcaccagcttctgtggcaccctgcacgtgtccttcatcacccccagcttccccacagatggcacccacccctttgtgtag

SEQ ID NO: 153930 - DNA, 147 bp, Artificial Sequence
  Description of Artificial Sequence: Synthetic coding sequence
atgcagaagatcatgcacatctctgtgctgctgagccctgtgctgtggggcctcatcttcggcgtgagcagcaacagcatccagattggaggcctcttccccagaggagctgaccaggagtacagcgccttccgggtgggcatgtag

SEQ ID NO: 153931 - DNA, 3030 bp, Artificial Sequence
  Description of Artificial Sequence: Synthetic coding sequence
atggaggccctgaccctgtggctgctgccctggatctgccagtgtgtgtctgtgcgggctgacagcatcatccacatcggggccatctttgaggagaatgctgccaaggatgacagagtcttccagctggccgtgtctgacctgagcctgaatgatgacatcctgcagagcgagaagatcacctacagcatcaaggtgattgaggccaacaaccccttccaggccgtgcaggaggcctgtgacctgatgacccagggcatcctggccctggtgaccagcacaggctgtgccagcgccaatgccctgcagagcctgacagatgccatgcacatcccccacctgtttgtgcagaggaaccctgggggcagccccaggacagcctgccacctgaaccccagcccagatggagaggcctacaccctggccagcaggcctcctgtgcggctgaatgatgtgatgctgcggctggtgacagagctgcgctggcagaagtttgtgatgttttatgattctgaatatgacatccggggcctgcagagcttcctggaccaggccagccggctgggcctggatgtgtccctgcagaaggtggacaagaacatcagccacgtgttcaccagcctcttcaccaccatgaagacagaggagctgaaccgctacagagacaccctgcggcgggccatcctgctgctgagcccccagggcgcccacagcttcatcaatgaagctgtggagaccaacctggccagcaaggacagccactgggtgtttgtgaatgaggagatcagtgaccctgagatcctggacctggtgcacagcgccctgggccgcatgacagtggtgcggcagatcttccccagcgccaaggacaaccagaagtgcaccaggaacaaccaccgcatcagcagcctgctgtgtgacccccaggagggctacctgcagatgctgcagatcagcaacctgtacctgtatgacagcgtgctgatgctggccaatgccttccacaggaagctggaggacaggaagtggcacagcatggccagcctgaactgcatcaggaagagcaccaagccctggaatggaggccgctccatgctggacaccatcaagaagggccacatcaccggcctgactggagtgatggagttccgggaggacagcagcaacccctacgtgcagtttgagatcctgggcaccacctacagcgagaccttcggcaaggacatgaggaagctggccacctgggacagcgagaagggcctgaatggcagcctgcaggagcggcccatgggcagccggctgcagggcctgaccctgaaggtggtgacagtgctggaggagccctttgtgatggtggccgagaacatcctgggccagcccaagcgctacaagggcttcagcattgatgtgctggatgccctggccaaggccctgggcttcaagtatgagatctaccaggccccagatggccgctatggccaccagctgcacaacacctcctggaatggcatgattggagagctgatcagcaagagagctgacctggccatcagcgccatcaccatcaccccagagcgggagagcgtggtggacttcagcaagcgctacatggactacagcgtgggcatcctgatcaagaagccagaggagaagatcagcatcttcagcctgtttgccccctttgattttgctgtgtgggcctgcatcgctgctgccatccctgtggtgggcgtgctgatctttgtgctgaaccgcatccaggccgtgcgggcccagagcgctgcccagccccggcccagcgccagcgccaccctgcacagcgccatctggatcgtgtatggagcctttgtgcagcagggcggggagagctctgtgaacagcatggccatgagaattgtgatgggctcctggtggctgttcaccctgattgtgtgcagcagctacacagccaacctggccgccttcctgactgtgtccaggatggacaaccccatccgcaccttccaggacctgagcaagcaggtggagatgtcctatggaacagtgcgggacagcgctgtgtatgagtacttccgggccaagggcaccaaccccctggagcaggacagcacctttgctgagctgtggaggaccatcagcaagaatggaggagctgacaactgtgtgagcagccccagcgagggcatcaggaaggccaagaagggcaactatgccttcctgtgggatgtggccgtggtggagtatgctgccctgacagatgatgactgcagcgtgacagtgattggcaacagcatcagcagcaagggctacggcatcgccctgcagcacggcagcccctacagagacctcttcagccagaggatcctggagctgcaggacaccggggacctggatgtgctgaagcagaagtggtggccccacatgggccgctgtgacctgaccagccacgccagcgcccaggctgatggcaagagcctgaagctgcacagctttgctggggtcttctgcatcctggccatcggcctgctgctggcctgcctggtggccgccctggagctgtggtggaacagcaaccgctgccaccaggagacccccaaggaggacaaggaggtgaacctggagcaggtgcacaggaggatgaacagcctgatggatgaggacatcgcccacaagcagatcagccctgccagcattgagctgagcgccctggagatgggcggcctggcccccacccagaccctggagcccacccgggagtaccagaacacccagctgtctgtgtccaccttcctgcctgagcagagcagccacggcaccagcaggaccctgagcagcggccccagcagcaacctgcccctgcccctgagcagcagcgccaccatgcccagcatgcagtgcaagcacaggagccccaacggcggcctcttccggcagagccctgtgaagacccccatccccatgtccttccagcctgtgcctggaggagtgctgcctgaggccctggacaccagccacggcaccagcatctag

SEQ ID NO: 153932 - DNA, 1743 bp, Artificial Sequence
  Description of Artificial Sequence: Synthetic coding sequence
atgggcagccggctgcagggcctgaccctgaaggtggtgacagtgctggaggagccctttgtgatggtggccgagaacatcctgggccagcccaagcgctacaagggcttcagcattgatgtgctggatgccctggccaaggccctgggcttcaagtatgagatctaccaggccccagatggccgctatggccaccagctgcacaacacctcctggaatggcatgattggagagctgatcagcaagagagctgacctggccatcagcgccatcaccatcaccccagagcgggagagcgtggtggacttcagcaagcgctacatggactacagcgtgggcatcctgatcaagaagccagaggagaagatcagcatcttcagcctgtttgccccctttgattttgctgtgtgggcctgcatcgccgccgccatccctgtggtgggcgtgctgatctttgtgctgaaccgcatccaggccgtgcgggcccagagcgctgcccagccccggcccagcgccagcgccaccctgcacagcgccatctggatcgtgtatggagcctttgtgcagcagggcggggagagctctgtgaacagcatggccatgagaattgtgatgggctcctggtggctgttcaccctcatcgtgtgcagcagctacacagccaacctggccgccttcctgactgtgtccaggatggacaaccccatccgcaccttccaggacctgagcaagcaggtggagatgtcctatggcaccgtgcgggacagcgctgtgtatgagtacttccgggccaagggcaccaaccccctggagcaggacagcacctttgctgagctgtggaggaccatcagcaagaatggaggagctgacaactgtgtgagcagccccagcgagggcatcaggaaggccaagaagggcaactatgccttcctgtgggatgtggccgtggtggagtatgctgccctgacagatgatgactgcagcgtgaccgtcatcggcaacagcatcagcagcaagggctatggaattgccctgcagcacggcagcccctacagagacctcttcagccagaggatcctggagctgcaggacacaggagacctggatgtgctgaagcagaagtggtggccccacatgggccgctgtgacctgaccagccacgccagcgcccaggctgatggcaagagcctgaagctgcacagctttgctggggtcttctgcatcctggccatcggcctgctgctggcctgcctggtggccgccctggagctgtggtggaacagcaaccgctgccaccaggagacccccaaggaggacaaggaggtgaacctggagcaggtgcacaggaggatgaacagcctgatggatgaagatattgcccacaagcagatcagccctgccagcattgagctgagcgccctggagatgggcggcctggcccccacccagaccctggagcccacccgggagtaccagaacacccagctgtctgtgtccaccttcctgcctgagcagagcagccacggcaccagcaggaccctgagcagcggccccagcagcaacctgcccctgcccctgagcagcagcgccaccatgcccagcatgcagtgcaagcacaggagccccaatggaggcctcttccggcagagccctgtgaagacccccatccccatgtccttccagcctgtgcctgggggcgtgctgcctgaggccctggacaccagccacggcaccagcatctag

SEQ ID NO: 153933 - DNA, 3024 bp, Artificial Sequence
  Description of Artificial Sequence: Synthetic coding sequence
atggaggtgttccccttcctgctggtgctgtctgtgtggtggagcaggacctgggacagcgccaatgctgacagcatcatccacatcggggccatctttgatgagagcgccaagaaggatgatgaggtgttcagaacagctgtgggggacctgaaccagaatgaggagatcctgcagacagagaagatcaccttctctgtgacctttgtggatggcaacaaccccttccaggccgtgcaggaggcctgtgagctgatgaaccagggcatcctggccctggtgagcagcatcggctgcaccagcgctggcagcctgcagagcctggctgatgccatgcacatcccccacctgttcatccagaggagcacagctggcacccccaggagcggctgcggcctgaccaggagcaacagaaatgatgactacaccctgtctgtgcggccccctgtgtacctgcatgatgtgatcctgcgggtggtgacagaatatgcctggcagaagttcatcatcttctatgacagtgaatatgacatccggggcatccaggagttcctggacaaggtgtcccagcagggcatggatgtggccctgcagaaggtggagaacaacatcaacaagatgatcaccaccctgtttgacaccatgagaattgaggagctgaaccgctacagagacaccctgcggcgggccatcctggtgatgaacccagccacagccaagagcttcatcacagaggtggtggagaccaacctggtggcctttgactgccactggatcatcatcaatgaggagatcaatgatgtggatgtgcaggagctggtgagaagaagcatcggccgcctgaccatcatccggcagaccttccctgtgccccagaacatcagccagcgctgcttccggggcaaccaccgcatcagcagcaccctgtgtgaccccaaggacccctttgcccagaacatggagatcagcaacctgtacatctatgacacagtgctgctgctggccaatgccttccacaagaagctggaggacaggaagtggcacagcatggccagcctgagctgcatcaggaagaacagcaagccctggcagggcggccgctccatgctggagaccatcaagaagggcggcgtgtctggcctgaccggggagctggagtttggagaaaatggaggcaaccccaacgtgcactttgagatcctgggcaccaactatggagaggagctgggccggggcgtgaggaagctgggctgctggaaccctgtgacaggcctgaatggcagcctgacagacaagaagctggagaacaacatgaggggcgtggtgctgcgggtggtgacagtgctggaggagccctttgtgatggtgtctgaaaatgtgctgggcaagcccaagaagtaccagggcttcagcattgatgtgctggatgccctgagcaactacctgggcttcaactatgagatctacgtggccccagaccacaagtatggcagcccccaggaggatggcacctggaatggcctggtgggggagctggtgttcaagagagctgacatcggcatcagcgccctgaccatcaccccagacagagaaaatgtggtggacttcaccacccgctacatggactacagcgtgggcgtgctgctgcggcgggcagagaagacagtggacatgtttgcctgcctggccccctttgacctgagcctgtgggcctgcatcgccggcaccgtgctgctggtgggcctgctggtgtacctgctgaactggctgaaccccccccggctgcagatgggctccatgaccagcaccaccctgtacaacagcatgtggtttgtgtatggcagctttgtgcagcagggcggggaggtgccctacaccaccctggccaccaggatgatgatgggcgcctggtggctgtttgccctgattgtcatcagcagctacacagccaacctggccgccttcctgaccatcaccagaattgagagcagcatccagagcctgcaggacctgagcaagcagacagagatcccctatggaacagtgctggacagcgctgtgtatgagcacgtgaggatgaagggcctgaacccctttgagcgggacagcatgtacagccagatgtggaggatgatcaacagaagcaatggaagtgaaaataatgtgctggagagccaggccggcatccagaaggtgaagtatggcaactatgcctttgtgtgggatgctgctgtgctggagtatgtggccatcaatgaccctgactgcagcttctacaccatcggcaacacagtggccgaccggggctacggcatcgccctgcagcacggcagcccctacagagatgtgttcagccagaggatcctggagctgcagcagaatggagacatggacatcctgaagcacaagtggtggcccaagaatggccagtgtgacctgtacagctctgtggacaccaagcagaagggcggggccctggacatcaagagctttgctggggtcttctgcatcctggccgccggcatcgtgctgagctgcttcatcgccatgctggagacctggtggaacaagaggaagggcagccgggtgcccagcaaagaagatgacaaggagattgacctggagcacctgcacagaagagtgaacagcctgtgcacagatgatgacagcccccacaagcagttcagcaccagcagcattgacctgacccccctggacatcgacaccctgcccacccggcaggccctggagcagatcagtgacttcaggaacacccacatcaccaccaccaccttcatccctgagcagatccagaccctgagcaggaccctgagcgccaaggccgccagcggcttcacctttggaaatgtgcctgagcacaggacaggccccttccgccaccgggccccaaatggaggcttcttccgcagccccatcaagaccatgagcagcatcccctaccagcccacccccaccctgggcctgaacctgggcaatgaccctgaccggggcaccagcatctag

SEQ ID NO: 153934 - DNA, 2739 bp, Artificial Sequence
  Description of Artificial Sequence: Synthetic coding sequence
atggaggtgttccccttcctgctggtgctgtctgtgtggtggagcaggacctgggacagcgccaatgctgacagcatcatccacatcggggccatctttgatgagagcgccaagaaggatgatgaggtgttcagaacagctgtgggggacctgaaccagaatgaggagatcctgcagacagagaagatcaccttctctgtgacctttgtggatggcaacaaccccttccaggccgtgcaggaggacatccggggcatccaggagttcctggacaaggtgtcccagcagggcatggatgtggccctgcagaaggtggagaacaacatcaacaagatgatcaccaccctgtttgacaccatgagaattgaggagctgaaccgctacagagacaccctgcggcgggccatcctggtgatgaacccagccacagccaagagcttcatcacagaggtggtggagaccaacctggtggcctttgactgccactggatcatcatcaatgaggagatcaatgatgtggatgtgcaggagctggtgcggcgcagcatcggccgcctgaccatcatccggcagaccttccctgtgccccagaacatcagccagcgctgcttccggggcaaccaccgcatcagcagcaccctgtgtgaccccaaggacccctttgcccagaacatggagatcagcaacctgtacatctatgacacagtgctgctgctggccaatgccttccacaagaagctggaggacaggaagtggcacagcatggccagcctgagctgcatcaggaagaacagcaagccctggcagggcggccgctccatgctggagaccatcaagaagggcggcgtgtctggcctgactggagagctggagtttggagaaaatggaggcaaccccaacgtgcactttgagatcctgggcaccaactacggggaggagctgggccggggcgtgaggaagctgggctgctggaaccctgtgacaggcctgaatggcagcctgacagacaagaagctggagaacaacatgagaggagtggtgctgcgggtggtgacagtgctggaggagccctttgtgatggtgtctgaaaatgtgctgggcaagcccaagaagtaccagggcttcagcattgatgtgctggatgccctgagcaactacctgggcttcaactatgagatctacgtggccccagaccacaagtatggcagcccccaggaggatggcacctggaatggcctggtgggggagctggtgttcaagagagctgacatcggcatcagcgccctgaccatcaccccagaccgggagaatgtggtggacttcaccacccgctacatggactacagcgtgggcgtgctgctgcggcgggcagagaagacagtggacatgtttgcctgcctggccccctttgacctgagcctgtgggcctgcatcgccggcaccgtgctgctggtgggcctgctggtgtacctgctgaactggctgaaccccccccggctgcagatgggctccatgaccagcaccaccctgtacaacagcatgtggtttgtgtatggcagctttgtgcagcagggcggggaggtgccctacaccaccctggccaccaggatgatgatgggcgcctggtggctgtttgccctgattgtcatcagcagctacacagccaacctggccgccttcctgaccatcacccgcatcgagagcagcatccagagcctgcaggacctgagcaagcagacagagatcccctacggcaccgtgctggacagcgctgtgtatgaacatgtgaggatgaagggcctgaacccctttgagcgggacagcatgtacagccagatgtggaggatgatcaacagaagcaatggaagtgagaacaacgtgctggagagccaggccggcatccagaaggtgaagtatggcaactatgcctttgtgtgggatgctgctgtgctggagtatgtggccatcaatgaccctgactgcagcttctacaccatcggcaacacagtggccgaccggggctatggaattgccctgcagcacggcagcccctacagagatgtgttcagccagaggatcctggagctgcagcagaatggagacatggacatcctgaagcacaagtggtggcccaagaatggccagtgtgacctgtacagctctgtggacaccaagcagaagggcggggccctggacatcaagagctttgctggggtcttctgcatcctggccgccggcatcgtgctgagctgcttcatcgccatgctggagacctggtggaacaagaggaagggcagccgggtgcccagcaaggaggatgacaaggagattgacctggagcacctgcaccggcgggtgaacagcctgtgcacagatgatgacagcccccacaagcagttcagcaccagcagcattgacctgacccccctggacatcgacaccctgcccacccggcaggccctggagcagatcagtgacttcaggaacacccacatcaccaccaccaccttcatccctgagcagatccagaccctgagcaggaccctgagcgccaaggccgccagcggcttcacctttggaaatgtgcctgagcacaggacaggccccttccgccaccgggcccccaacggcggcttcttccgcagccccatcaagaccatgagcagcatcccctaccagcccacccccaccctgggcctgaacctgggcaatgaccctgaccggggcaccagcatctag

SEQ ID NO: 153935 - DNA, 2763 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggccacagcccgctgggatggcctgaccggccacatcaccttcaacaagaccaacggcctgaggaaggactttgacctggacatcatcagcctgaaggaggagggcacagagaaggccgccggggaggtgtccaagcacctgtacaaggtgtggaagaagattggcatctggaacagcaacagcggcctgaacatgacagacagcaacaaggacaagagcagcaacatcacagacagcctggccaacagaaccctcatcgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtacggggcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctcttcgtcatcgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagatcggcggcctgattgacagcaagggctatggagtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacattggaggcatcttcatcgtgctggccgccggcctggtgctgtctgtgtttgtggccatcggggagttcatctacaagagcaggaagaacaatgacatcgagcaggccttctgcttcttctacggcctgcagtgcaagcagacccaccccaccaacagcaccagcggcaccaccctgagcacagacctggagtgtgggaagctgatccgggaggagcggggcatcaggaagcagagctctgtgcacacagtgtag

SEQ ID NO: 153936 - DNA, 2850 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaaggccgccggggaggtgtccaagcacctgtacaaggtgtggaagaagattggcatctggaacagcaacagcggcctgaacatgacagacagcaacaaggacaagagcagcaacatcacagacagcctggccaacagaaccctcatcgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtacggggcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctcttcgtcatcgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagatcggcggcctgattgacagcaagggctatggagtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacattggaggcatcttcatcgtgctggccgccggcctggtgctgtctgtgtttgtggccatcggggagttcatctacaagagcaggaagaacaatgacatcgagcagaagggcaagagcagccgcatccgcttctacttcaggaacaaggtgcgcttccacggcaggaagaagcagagcctgggcgtggagaagtgcctgtccttcaatgccatcatggaggagctgggcatcagcctgaagaaccagaagaagatcaagaagaagagcaggaccaagggcaagagcagcttcaccagcatcctgacctgccaccagaggaggacccagaggaaggagaccgtggcctag

SEQ ID NO: 153937 - DNA, 2616 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaaggccgccggggaggtgtccaagcacctgtacaaggtgtggaagaagattggcatctggaacagcaacagcggcctgaacatgacagacagcaacaaggacaagagcagcaacatcacagacagcctggccaacagaaccctcatcgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtacggggcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctcttcgtcatcgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagatcggcggcctgattgacagcaagggctatggagtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacattggaggcatcttcatcgtgctggccgccggcctggtgctgtctgtgtttgtggccatcggggagttcatctacaagagcaggaagaacaatgacatcgagcagcactactag

SEQ ID NO: 153938 - DNA, 2718 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaagattggcatctggaacagcaacagcggcctgaacatgacagacagcaacaaggacaagagcagcaacatcacagacagcctggccaacagaaccctgattgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtatggagcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctgtttgtgattgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagattggaggcctgattgacagcaagggctacggcgtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacatcggcggcatcttcatcgtgctggccgccggcctggtgctgtctgtgtttgtggccatcggggagttcatctacaagagcaggaagaacaatgacatcgagcagtgcctgtccttcaatgccatcatggaggagctgggcatcagcctgaagaaccagaagaagatcaagaagaagagcaggaccaagggcaagagcagcttcaccagcatcctgacctgccaccagaggaggacccagaggaaggagaccgtggcctag

SEQ ID NO: 153939 - DNA, 2757 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaaggccgccggggaggtgtccaagcacctgtacaaggtgtggaagaagattggcatctggaacagcaacagcggcctgaacatgacagacagcaacaaggacaagagcagcaacatcacagacagcctggccaacagaaccctcatcgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtacggggcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctcttcgtcatcgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagatcggcggcctgattgacagcaagggctatggagtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacattggaggcatcttcatcgtgctggccgccggcctggtgctgtctgtgtttgtggccatcggggagttcatctacaagagcaggaagaacaatgacatcgagcaggccttctgcttcttctacggcctgcagtgcaagcagacccaccccaccaacagcaccagcggcaccaccctgagcacagacctggagtgtgggaagctgatccgggaggagcggggcatcaggaagcagagctctgtgcacacagtgtag

SEQ ID NO: 153940 - DNA, 2712 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaagattggcatctggaacagcaacagcggcctgaacatgacagacagcaacaaggacaagagcagcaacatcacagacagcctggccaacagaaccctgattgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtatggagcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctgtttgtgattgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagattggaggcctgattgacagcaagggctacggcgtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacatcggcggcatcttcatcgtgctggccgccggcctggtgctgtctgtgtttgtggccatcggggagttcatctacaagagcaggaagaacaatgacatcgagcaggccttctgcttcttctacggcctgcagtgcaagcagacccaccccaccaacagcaccagcggcaccaccctgagcacagacctggagtgtgggaagctgatccgggaggagcggggcatcaggaagcagagctctgtgcacacagtgtag

SEQ ID NO: 153941 - DNA, 2763 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaaggccgccggggaggtgtccaagcacctgtacaaggtgtggaagaagattggcatctggaacagcaacagcggcctgaacatgacagacagcaacaaggacaagagcagcaacatcacagacagcctggccaacagaaccctcatcgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtacggggcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctcttcgtcatcgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagatcggcggcctgattgacagcaagggctatggagtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacattggaggcatcttcatcgtgctggccgccggcctggtgctgtctgtgtttgtggccatcggggagttcatctacaagagcaggaagaacaatgacatcgagcagtgcctgtccttcaatgccatcatggaggagctgggcatcagcctgaagaaccagaagaagatcaagaagaagagcaggaccaagggcaagagcagcttcaccagcatcctgacctgccaccagaggaggacccagaggaaggagaccgtggcctag

SEQ ID NO: 153942 - DNA, 2805 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaagattggcatctggaacagcaacagcggcctgaacatgacagacagcaacaaggacaagagcagcaacatcacagacagcctggccaacagaaccctgattgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtatggagcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctgtttgtgattgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagattggaggcctgattgacagcaagggctacggcgtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacatcggcggcatcttcatcgtgctggccgccggcctggtgctgtctgtgtttgtggccatcggggagttcatctacaagagcaggaagaacaatgacatcgagcagaagggcaagagcagccgcatccgcttctacttcaggaacaaggtgcgcttccacggcaggaagaagcagagcctgggcgtggagaagtgcctgtccttcaatgccatcatggaggagctgggcatcagcctgaagaaccagaagaagatcaagaagaagagcaggaccaagggcaagagcagcttcaccagcatcctgacctgccaccagaggaggacccagaggaaggagaccgtggcctag

SEQ ID NO: 153943 - DNA, 2769 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattggaggcatctttgaaacagtggagaatgaacctgtgaatgtggaggagctggccttcaagtttgctgtgaccagcatcaacagaaacagaaccctgatgcccaacaccaccctgacctatgacatccagaggatcaacctgtttgacagctttgaggccagccggcgggcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggccacagcccgctgggatggcctgaccggccacatcaccttcaacaagaccaacggcctgaggaaggactttgacctggacatcatcagcctgaaggaggagggcacagagaaggccgccggggaggtgtccaagcacctgtacaaggtgtggaagaagattggcatctggaacagcaacagcggcctgaacatgacagacagcaacaaggacaagagcagcaacatcacagacagcctggccaacagaaccctcatcgtgaccaccatcctggaggagccctacgtgatgtacaggaagagtgacaagcccctgtatggaaatgacagatttgagggctactgcctggacctgctgaaggagctgagcaacatcctgggcttcatctatgatgtgaagctggtgcctgatggcaagtacggggcccagaatgacaagggggagtggaatggcatggtgaaggagctgattgaccacagagctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctcttcgtcatcgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagatcggcggcctgattgacagcaagggctatggagtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacattggaggcatcttcatcgtgctggccgccggcctggtgctgtctgtgtttgtggccatcggggagttcatctacaagagcaggaagaacaatgacatcgagcagtgcctgtccttcaatgccatcatggaggagctgggcatcagcctgaagaaccagaagaagatcaagaagaagagcaggaccaagggcaagagcagcttcaccagcatcctgacctgccaccagaggaggacccagaggaaggagaccgtggcctag

SEQ ID NO: 153944 - DNA, 2247 bp, Artificial Sequence
  Description of Artificial Sequence: Synthetic coding sequence
atggagcacggcaccctgctggcccagcccggcctgtggacccgggacacctcctgggccctgctgtacttcctgtgctacatcctgccccagacagccccccaggtgctgagaattgcctgtgaccagctggccctgggcgtggccgccctgtttggccccagccacagcagctctgtgtctgctgtgcagagcatctgcaatgccctggaggtgccccacatccagacccgctggaagcaccccagcgtggacaacaaggacctcttctacatcaacctgtacccagactatgctgccatcagccgggccatcctggacctggtgctgtactacaactggaagacagtgacagtggtgtatgaggacagcacaggcctcatccggctgcaggagctgatcaaggcccccagccgctacaacatcaagatcaagatccggcagctgcccagcggcaacaaggatgccaagcccctgctgaaggagatgaagaagggcaaggagttctacgtgatctttgactgcagccatgaaacagctgctgagatcctgaagcagatcctcttcatgggcatgatgacagagtactaccactacttcttcaccaccctggacctgtttgccctggacctggagctgtaccgctacagcggcgtgaacatgacaggcttccggctgctgaacatcgacaacccccacgtgagcagcatcatcgagaagtggagcatggagcggctgcaggccccacccaggcctgagaccggcctgctggatggcatgatgaccacagaagctgccctgatgtatgatgctgtgtacatggtggccatcgccagccaccgggccagccagctgactgtgagcagcctgcagtgccaccgccacaagccctggaggctgggcccccgcttcatgaacctgatcaaggaggcccgctgggatggcctgaccggccacatcaccttcaacaagaccaacggcctgaggaaggactttgacctggacatcatcagcctgaaggaggagggcacagagaagattggcatctggaacagcaacagcggcctgaacatgacagacagcaacaaggacaagagcagcaacatcacagacagcctggccaacagaaccctgattgtgaccaccatcctgcgggctgacctggccgtggcccccctgaccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtatgtgctgctggcctgcctgggcgtgtcctgtgtgctgtttgtgattgcccgcttcaccccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtgagagatggcagcaccatgaccttcttcaagaagagcaagatcagcacctatgagaagatgtgggccttcatgagcagccggcagcagacagccctggtgaggaacagtgatgagggcatccagagggtgctgaccacagattatgccctgctgatggagagcaccagcattgaatatgtgacccagaggaactgcaacctgacccagattggaggcctgattgacagcaagggctacggcgtgggcacccccatcggcagcccctacagagacaagatcaccatcgccatcctgcagctgcaggaggagggcaagctgcacatgatgaaggagaagtggtggagaggaaatggctgcccagaggaggacaacaaggaggccagcgccctgggcgtggagaacatcggcggcatcttcatcgtgctggccgccggcctggtgctgtctgtgtttgtggccatcggggagttcatctacaagagcaggaagaacaatgacatcgagcagtgcctgtccttcaatgccatcatggaggagctgggcatcagcctgaagaaccagtag

SEQ ID NO: 153945 - DNA, 2610 bp, Artificial Sequence
  Description of Artificial Sequence: Synthetic coding sequence
atgaagatcatcttccccatcctgagcaaccctgtgttccggaggacagtgaagctgctgctgtgcctgctgtggattggctacagccagggcaccacccacgtgctgcgctttggaggcatctttgaatatgtggagagcggccccatgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggccgccggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagattctggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctcatcgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtacggggcccaggatgatgccaacggccagtggaatggcatggtgcgggagctgattgaccacaaggctgacctggccgtggcccccctggccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtacatcctgctggcctacctgggcgtgtcctgtgtgctgtttgtgattgcccgcttcagcccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtggaggatggagccaccatgaccttcttcaagaagagcaagatcagcacctatgacaagatgtgggccttcatgagcagccggcggcagagcgtgctggtgaagagcaatgaggagggcatccagagggtgctgaccagtgactatgccttcctgatggagagcaccaccatcgagtttgtgacccagaggaactgcaacctgacccagattggaggcctgattgacagcaagggctacggcgtgggcacccccatgggcagcccctacagagacaagatcaccatcgccatcctgcagctgcaggaggagggcaagctgcacatgatgaaggagaagtggtggagaggaaatggctgcccagaggaggagagcaaggaggccagcgccctgggcgtgcagaacatcggcggcatcttcatcgtgctggccgccggcctggtgctgtctgtgtttgtggccgtgggggagttcctgtacaagagcaagaagaatgcccagctggagaaggagagcagcatctggctggtgcccccctaccacccagacacagtgtag

SEQ ID NO: 153946 - DNA, 2580 bp, Artificial Sequence
  Description of Artificial Sequence: Synthetic coding sequence
atgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggctgctggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagacagcggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctgattgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtatggagcccaggatgatgccaacggccagtggaatggcatggtgcgggagctgattgaccacaaggctgacctggccgtggcccccctggccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtacatcctgctggcctacctgggcgtgtcctgtgtgctcttcgtcatcgcccgcttcagcccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcacccgcatcgtgggcggcatctggtggttcttcaccctcatcatcatcagcagctacacagccaacctggccgccttcctgactgtggagaggatggagagccccattgattctgcagatgacctggccaagcagaccaagattgaatatggagctgtggaggatggagccaccatgaccttcttcaagaagagcaagatcagcacctatgacaagatgtgggccttcatgagcagccggcggcagagcgtgctggtgaagagcaatgaggagggcatccagagggtgctgaccagtgactatgccttcctgatggagagcaccaccattgaatttgtgacccagaggaactgcaacctgacccagatcggcggcctgattgacagcaagggctatggagtgggcacccccatgggcagcccctacagagacaagatcaccatcgccatcctgcagctgcaggaggagggcaagctgcacatgatgaaggagaagtggtggagaggaaatggctgcccagaggaggagagcaaggaggccagcgccctgggcgtgcagaacattggaggcatcttcatcgtgctggccgccggcctggtgctgtctgtgtttgtggccgtgggggagttcctgtacaagagcaagaagaatgcccagctggagaagaggagcttctgcagcgccatggtggaggagctgaggatgagcctgaagtgccagaggcggctgaagcacaagccccaggcccctgtgattgtgaagacagaggaggtgatcaacatgcacaccttcaatgaccggcggctgcccgggaaggagaccatggcctag

SEQ ID NO: 153947 - DNA, 2499 bp, Artificial Sequence
  Description of Artificial Sequence: Synthetic coding sequence
atgaagatcatcttccccatcctgagcaaccctgtgttccggaggacagtgaagctgctgctgtgcctgctgtggattggctacagccagggcaccacccacgtgctgcgctttggaggcatctttgaatatgtggagagcggccccatgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggccgccggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagattctggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctcatcgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtacggggcccaggatgatgccaacggccagtggaatggcatggtgcgggagctgattgaccacaaggctgacctggccgtggcccccctggccatcacctacgtgcgggagaaggtgattgacttcagcaagcccttcatgaccctgggcatcagcatcctgtacaggaagcccaacggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtggaggatggagccaccatgaccttcttcaagaagagcaagatcagcacctatgacaagatgtgggccttcatgagcagccggcggcagagcgtgctggtgaagagcaatgaggagggcatccagagggtgctgaccagtgactatgccttcctgatggagagcaccaccatcgagtttgtgacccagaggaactgcaacctgacccagattggaggcctgattgacagcaagggctacggcgtgggcacccccatgggcagcccctacagagacaagatcaccatcgccatcctgcagctgcaggaggagggcaagctgcacatgatgaaggagaagtggtggagaggaaatggctgcccagaggaggagagcaaggaggccagcgccctgggcgtgcagaacatcggcggcatcttcatcgtgctggccgccggcctggtgctgtctgtgtttgtggccgtgggggagttcctgtacaagagcaagaagaatgcccagctggagaagaggagcttctgcagcgccatggtggaggagctgaggatgagcctgaagtgccagaggcggctgaagcacaagccccaggcccctgtgattgtgaagacagaggaggtgatcaacatgcacaccttcaatgaccggcggctgcccgggaaggagaccatggcctag

SEQ ID NO: 153948 - DNA, 2679 bp, Artificial Sequence
  Description of Artificial Sequence: Synthetic coding sequence
atgaagatcatcttccccatcctgagcaaccctgtgttccggaggacagtgaagctgctgctgtgcctgctgtggattggctacagccagggcaccacccacgtgctgcgctttggaggcatctttgaatatgtggagagcggccccatgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggccgccggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagattctggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctcatcgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtacggggcccaggatgatgccaacggccagtggaatggcatggtgcgggagctgattgaccacaaggctgacctggccgtggcccccctggccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtacatcctgctggcctacctgggcgtgtcctgtgtgctgtttgtgattgcccgcttcagcccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtggaggatggagccaccatgaccttcttcaagaagagcaagatcagcacctatgacaagatgtgggccttcatgagcagccggcggcagagcgtgctggtgaagagcaatgaggagggcatccagagggtgctgaccagtgactatgccttcctgatggagagcaccaccatcgagtttgtgacccagaggaactgcaacctgacccagattggaggcctgattgacagcaagggctacggcgtgggcacccccatgggcagcccctacagagacaagatcaccatcgccatcctgcagctgcaggaggagggcaagctgcacatgatgaaggagaagtggtggagaggaaatggctgcccagaggaggagagcaaggaggccagcgccctgggcgtgcagaacatcggcggcatcttcatcgtgctggccgccggcctggtgctgtctgtgtttgtggccgtgggggagttcctgtacaagagcaagaagaatgcccagctggagaagagggccaagaccaagctgccccaggactatgtgttcctgcccatcctggagagcgtgtccatcagcacagtgctgagcagcagccccagcagcagcagcctgagcagctgcagctag

SEQ ID NO: 153949 - DNA, 1755 bp, Artificial Sequence
  Description of Artificial Sequence: Synthetic coding sequence
atgaagatcatcttccccatcctgagcaaccctgtgttccggaggacagtgaagctgctgctgtgcctgctgtggattggctacagccagggcaccacccacgtgctgcgctttggaggcatctttgaatatgtggagagcggccccatgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggccgccggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagattctggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctcatcgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtacggggcccaggatgatgccaacggccagtggaatggcatggtgcgggagctgattgaccacaaggctgacctggccgtggcccccctggccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtacatcctgctggcctacctgggcgtgtcctgtgtgctgtttgtgattgcccgcttctag

SEQ ID NO: 153950 - DNA, 2610 bp, Artificial Sequence; identical to SEQ ID NO: 153945
  Description of Artificial Sequence: Synthetic coding sequence

SEQ ID NO: 153951 - DNA, 2727 bp, Artificial Sequence
  Description of Artificial Sequence: Synthetic coding sequence
atgaagatcatcttccccatcctgagcaaccctgtgttccggaggacagtgaagctgctgctgtgcctgctgtggattggctacagccagggcaccacccacgtgctgcgctttggaggcatctttgaatatgtggagagcggccccatgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggccgccggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagattctggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctcatcgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtacggggcccaggatgatgccaacggccagtggaatggcatggtgcgggagctgattgaccacaaggctgacctggccgtggcccccctggccatcacctacgtgcgggagaaggtgattgacttcagcaagcccttcatgaccctgggcatcagcatcctgtacaggaagcccaacggcaccaaccctggggtcttctccttcctgaaccccctgagcccagacatctggatgtacatcctgctggcctacctgggcgtgtcctgtgtgctgtttgtgattgcccgcttcagcccctatgagtggtacaacccccacccctgcaacccagacagtgatgtggtggagaacaacttcaccctgctgaacagcttctggtttggagtgggcgccctgatgcagcagggcagcgagctgatgcccaaggccctgagcaccagaattgtgggcggcatctggtggttcttcaccctcatcatcatcagcagctacacagccaacctggccgccttcctgactgtggagaggatggagagccccatcgacagcgcagatgacctggccaagcagaccaagattgaatatggagctgtggaggatggagccaccatgaccttcttcaagaagagcaagatcagcacctatgacaagatgtgggccttcatgagcagccggcggcagagcgtgctggtgaagagcaatgaggagggcatccagagggtgctgaccagtgactatgccttcctgatggagagcaccaccatcgagtttgtgacccagaggaactgcaacctgacccagattggaggcctgattgacagcaagggctacggcgtgggcacccccatgggcagcccctacagagacaagatcaccatcgccatcctgcagctgcaggaggagggcaagctgcacatgatgaaggagaagtggtggagaggaaatggctgcccagaggaggagagcaaggaggccagcgccctgggcgtgcagaacatcggcggcatcttcatcgtgctggccgccggcctggtgctgtctgtgtttgtggccgtgggggagttcctgtacaagagcaagaagaatgcccagctggagaagaggagcttctgcagcgccatggtggaggagctgaggatgagcctgaagtgccagaggcggctgaagcacaagccccaggcccctgtgattgtgaagacagaggaggtgatcaacatgcacaccttcaatgaccggcggctgcccgggaaggagaccatggcctag

SEQ ID NO: 153952 - DNA, 1935 bp, Artificial Sequence
  Description of Artificial Sequence: Synthetic coding sequence
gggggcatctttgaatatgtggagagcggccccatgggcgctgaggagctggccttccgctttgctgtgaacaccatcaacagaaacagaaccctgctgcccaacaccaccctgacctatgacacccagaagatcaacctgtatgacagctttgaggccagcaagaaggcctgtgaccagctgagcctgggcgtggccgccatcttcggccccagccacagcagcagcgccaatgctgtgcagagcatctgcaatgccctgggcgtgccccacatccagacccgctggaagcaccaggtgtctgacaacaaggacagcttctacgtgtccctgtacccagacttcagcagcctgagccgggccatcctggacctggtgcagttcttcaagtggaagacagtgacagtggtgtatgatgacagcacaggcctcatccggctgcaggagctgatcaaggcccccagccgctacaacctgcggctgaagatccggcagctgcctgctgacaccaaggatgccaagcccctgctgaaggagatgaagaggggcaaggagttccacgtgatctttgactgcagccatgagatggccgccggcatcctgaagcaggccctggccatgggcatgatgacagagtactaccactacatcttcaccaccctggacctgtttgccctggatgtggagccctaccgctacagcggcgtgaacatgacaggcttccgcatcctgaacacagagaacacccaggtgagcagcatcatcgagaagtggagcatggagcggctgcaggccccacccaagccagattctggcctgctggatggcttcatgaccacagatgctgccctgatgtatgatgctgtgcacgtggtgtctgtggccgtgcagcagttcccccagatgacagtgagcagcctgcagtgcaacagacacaagccctggaggtttggcacccgcttcatgagcctcatcaaggaggcccactgggagggcctgaccggccgcatcaccttcaacaagaccaacggcctgaggacagactttgacctggatgtgatcagcctgaaggaggagggcctggagaagattggcacctgggaccctgccagcggcctgaacatgacagagagccagaagggcaagccagccaacatcacagacagcctgagcaacagaagcctcatcgtgaccaccatcctggaggagccctacgtgctcttcaagaagagtgacaagcccctgtatggaaatgacagatttgagggctactgcatcgacctgctgcgggagctgagcaccatcctgggcttcacctatgagatccggctggtggaggatggcaagtacggggcccaggatgatgccaacggccagtggaatggcatggtgcgggagctgattgaccacaagagcaagatcagcacctatgacaagatgtgggccttcatgagcagccggcggcagagcgtgctggtgaagagcaatgaggagggcatccagagggtgctgaccagtgactatgccttcctgatggagagcaccaccattgaatttgtgacccagaggaactgcaacctgacccagatcggcggcctgattgacagcaagggctatggagtgggcacccccatgggcagcccctacagagacaagatcaccatcgccatcctgcagctgcaggaggagggcaagctgcacatgatgaaggagaagtggtggagaggaaatggctgcccagaggaggagagcaaggaggccagcgccctgggcgtgcagaacattggaggcatcttcatcgtgctggccgccggcctggtgctgtctgtgtttgtggccgtgggggagttcctgtacaagagcaagaagaatgcccagctggagaaggagagcagcatctggctggtgcccccctaccacccagacacagtgtag

SEQ ID NO: 153953 - DNA, 2760 bp, Artificial Sequence
  Description of Artificial Sequence: Synthetic coding sequence
atgacagccccctggaggcggctgcggagcctggtgtgggagtactgggccggcctgctggtgtgtgccttctggatcccagacagccggggcatgccccacgtgatccgcatcggcggcatctttgaatatgcagatggccccaatgcccaggtgatgaatgctgaggagcacgccttccgcttcagcgccaacatcatcaacagaaacagaaccctgctgcccaacaccaccctgacctatgacatccagaggatccacttccatgacagctttgaggccaccaagaaggcctgtgaccagctggccctgggcgtggtggccatcttcggccccagccagggcagctgcaccaatgctgtgcagagcatctgcaatgccctggaggtgccccacatccagctgcgctggaagcaccaccccctggacaacaaggacaccttctacgtgaacctgtacccagactatgccagcctgagccacgccatcctggacctggtgcagtacctgaagtggaggtctgccaccgtggtgtatgatgacagcacaggcctcatccggctgcaggagctgatcatggcccccagccgctacaacatccggctgaagatccggcagctgcccatcgacagtgatgacagccggcccctgctgaaggagatgaagaggggccgggagttccgcatcatctttgactgcagccacaccatggccgcccagatcctgaagcaggccatggccatgggcatgatgacagagtactaccacttcatcttcaccaccctggacctgtatgccctggacctggagccctaccgctacagcggcgtgaacctgaccggcttccgcatcctgaatgtggacaacccccacgtgtctgccatcgtggagaagtggagcatggagcggctgcaggccgcccccaggtctgagagcggcctgctggatggagtgatgatgacagatgctgccctgctgtatgatgctgtgcacatcgtgtctgtgtgctaccagagggccccccagatgacagtgaacagcctgcagtgccaccgccacaaggcctggaggtttggaggccgcttcatgaacttcatcaaggaggcccagtgggagggcctgaccggccgcatcgtgttcaacaagaccagcggcctgaggacagactttgacctggacatcatcagcctgaaggaggatggcctggagaaggtgggcgtgtggagccctgcagatggcctgaacatcacagaggtggccaagggccggggccccaacgtgacagacagcctgaccaacagaagcctgattgtgaccaccgtgctggaggagccctttgtgatgttcaggaagagtgacaggaccctgtatggaaatgacagatttgagggctactgcatcgacctgctgaaggagctggcccacatcctgggcttctcctatgagatccggctggtggaggatggcaagtatggagcccaggatgacaagggccagtggaatggcatggtgaaggagctgattgaccacaaggctgacctggccgtggcccccctgaccatcacccacgtgcgggagaaggccatcgacttcagcaagcccttcatgaccctgggcgtgtccatcctgtacaggaagcccaacggcaccaaccccagcgtcttctccttcctgaaccccctgagcccagacatctggatgtatgtgctgctggcctacctgggcgtgtcctgtgtgctgtttgtgattgcccgcttcagcccctatgagtggtatgatgcccacccctgcaaccctggcagcgaggtggtggagaacaacttcaccctgctgaacagcttctggtttggcatgggcagcctgatgcagcagggcagcgagctgatgcccaaggccctgagcacccgcatcatcggcggcatctggtggttcttcaccctcatcatcatcagcagctacacagccaacctggccgccttcctgactgtggagaggatggagagccccatcgacagcgcagatgacctggccaagcagaccaagattgaatatggagctgtgaaggatggagccaccatgaccttcttcaagaagagcaagatcagcacctttgagaagatgtgggccttcatgagcagcaagcccagcgccctggtgaagaacaatgaggagggcatccagagggccctgacagctgactatgccctgctgatggagagcaccaccattgaatatgtgacccagaggaactgcaacctgacccagatcggcggcctgattgacagcaagggctatggaattggcacccccatgggcagcccctacagagacaagatcaccatcgccatcctgcagctgcaggaggaggacaagctgcacatcatgaaggagaagtggtggaggggcagcggctgcccagaggaggagaacaaggaggccagcgccctgggcatccagaagattggaggcatcttcatcgtgctggccgccggcctggtgctgtctgtgctggtggccgtgggggagtttgtgtacaagctgaggaagacagctgagcgggagcagaggagcttctgcagcacagtggctgatgagatccgcttcagcctgacctgccagaggagagtgaagcacaagccccagccccccatgatggtgaagacagatgctgtgatcaacatgcacaccttcaatgaccggcggctgcccgggaaggacagcatggcctgcagcaccagcctggcccctgtgttcccctag

SEQ ID NO: 153954 - DNA, 2619 bp, Artificial Sequence
  Description of Artificial Sequence: Synthetic coding sequence
atgacagccccctggaggcggctgcggagcctggtgtgggagtactgggccggcctgctggtgtgtgccttctggatcccagacagccggggcatgccccacgtgatccgcatcggcggcatctttgaatatgcagatggccccaatgcccaggtgatgaatgctgaggagcacgccttccgcttcagcgccaacatcatcaacagaaacagaaccctgctgcccaacaccaccctgacctatgacatccagaggatccacttccatgacagctttgaggccaccaagaaggcctgtgaccagctggccctgggcgtggtggccatcttcggccccagccagggcagctgcaccaatgctgtgcagagcatctgcaatgccctggaggtgccccacatccagctgcgctggaagcaccaccccctggacaacaaggacaccttctacgtgaacctgtacccagactatgccagcctgagccacgccatcctggacctggtgcagtacctgaagtggaggtctgccaccgtggtgtatgatgacagcacaggcctcatccggctgcaggagctgatcatggcccccagccgctacaacatccggctgaagatccggcagctgcccatcgacagtgatgacagccggcccctgctgaaggagatgaagaggggccgggagttccgcatcatctttgactgcagccacaccatggccgcccagatcctgaagcaggccatggccatgggcatgatgacagagtactaccacttcatcttcaccaccctggacctgtatgccctggacctggagccctaccgctacagcggcgtgaacctgaccggcttccgcatcctgaatgtggacaacccccacgtgtctgccatcgtggagaagtggagcatggagcggctgcaggccgcccccaggtctgagagcggcctgctggatggagtgatgatgacagatgctgccctgctgtatgatgctgtgcacatcgtgtctgtgtgctaccagagggccccccagatgacagtgaacagcctgcagtgccaccgccacaaggcctggaggtttggaggccgcttcatgaacttcatcaaggaggcccagtgggagggcctgaccggccgcatcgtgttcaacaagaccagcggcctgaggacagactttgacctggacatcatcagcctgaaggaggatggcctggagaaggtgggcgtgtggagccctgcagatggcctgaacatcacagaggtggccaagggccggggccccaacgtgacagacagcctgaccaacagaagcctgattgtgaccaccgtgctggaggagccctttgtgatgttcaggaagagtgacaggaccctgtatggaaatgacagatttgagggctactgcatcgacctgctgaaggagctggcccacatcctgggcttctcctatgagatccggctggtggaggatggcaagtatggagcccaggatgacaagggccagtggaatggcatggtgaaggagctgattgaccacaaggctgacctggccgtggcccccctgaccatcacccacgtgcgggagaaggccatcgacttcagcaagcccttcatgaccctgggcgtgtccatcctgtacaggaagcccaacggcaccaaccccagcgtcttctccttcctgaaccccctgagcccagacatctggatgtatgtgctgctggcctacctgggcgtgtcctgtgtgctgtttgtgattgcccgcttcagcccctatgagtggtatgatgcccacccctgcaaccctggcagcgaggtggtggagaacaacttcaccctgctgaacagcttctggtttggcatgggcagcctgatgcagcagggcagcgagctgatgcccaaggccctgagcacccgcatcatcggcggcatctggtggttcttcaccctcatcatcatcagcagctacacagccaacctggccgccttcctgactgtggagaggatggagagccccatcgacagcgcagatgacctggccaagcagaccaagattgaatatggagctgtgaaggatggagccaccatgaccttcttcaagaagagcaagatcagcacctttgagaagatgtgggccttcatgagcagcaagcccagcgccctggtgaagaacaatgaggagggcatccagagggccctgacagctgactatgccctgctgatggagagcaccaccattgaatatgtgacccagaggaactgcaacctgacccagatcggcggcctgattgacagcaagggctatggaattggcacccccatgggcagcccctacagagacaagatcaccatcgccatcctgcagctgcaggaggaggacaagctgcacatcatgaaggagaagtggtggaggggcagcggctgcccagaggaggagaacaaggaggccagcgccctgggcatccagaagattggaggcatcttcatcgtgctggccgccggcctggtgctgtctgtgctggtggccgtgggggagtttgtgtacaagctgaggaagacagctgagcgggagcaggtgtccctgcgggcctggagcctgcacaggatgggaaatggagacagcaggtag

SEQ ID NO: 153955 - DNA, 2871 bp, Artificial Sequence
  Description of Artificial Sequence: Synthetic coding sequence
atgccccgggtgtctgcccccctggtgctgctgcctgcctggctggtgatggtggcctgcagcccccacagcctgagaattgctgccatcctggatgaccccatggagtgcagcagaggagagcggctgagcatcaccctggccaagaaccgcatcaacagagcccctgagcggctgggcaaggccaaggtggaggtggacatctttgagctgctgcgggacagtgaatatgaaacagctgagaccatgtgccagatcctgcccaagggcgtggtggccgtgctgggccccagcagcagccctgccagcagcagcatcatcagcaacatctgtggggagaaggaggtgccccacttcaaggtggcccctgaggagtttgtgaagttccagttccagcgcttcaccaccctgaacctgcaccccagcaacacagacatctctgtggccgtggccggcatcctgaacttcttcaactgcaccacagcctgcctgatctgtgccaaggccgagtgcctgctgaacctggagaagctgctgcggcagttcctgatcagcaaggacaccctgtctgtgaggatgctggatgacacccgggaccccacccccctgctgaaggagatcagagatgacaagacagccaccatcatcatccacgccaatgcctccatgagccacaccatcctgctgaaggctgctgagctgggcatggtgtctgcctactacacctacatcttcaccaacctggagttcagcctgcagaggatggacagcctggtggatgacagagtgaacatcctgggcttcagcatcttcaaccagagccacgccttcttccaggagtttgcccagagcctgaaccagagctggcaggagaactgtgaccacgtgcccttcaccggccctgccctgagcagcgccctgctgtttgatgctgtgtatgctgtggtgacagctgtgcaggagctgaacagaagccaggagattggagtgaagcccctgagctgtggcagcgcccagatctggcagcacggcaccagcctgatgaactacctgaggatggtggagctggagggcctgaccggccacatcgagttcaacagcaagggccagaggagcaactatgccctgaagatcctgcagttcaccagaaatggcttccggcagatcggccagtggcacgtggccgagggcctgtccatggacagccacctgtatgccagcaacatcagtgacaccctcttcaacaccaccctggtggtgaccaccatcctggagaacccctacctgatgctgaagggcaaccaccaggagatggagggcaatgacagatatgagggcttctgtgtggacatgctgaaggagctggccgagatcctgcgcttcaactacaagatccggctggtgggagatggagtgtatggagtgcctgaggccaacggcacctggacaggcatggtgggggagctgattgccaggaaggctgacctggccgtggccggcctgaccatcacagctgagcgggagaaggtgattgacttcagcaagcccttcatgaccctgggcatcagcatcctgtacagagtgcacatgggcaggaagccaggctacttctccttcctggaccccttcagccctggggtgtggctgttcatgctgctggcctacctggccgtgtcctgtgtgctcttcctggtggcccggctgaccccctatgagtggtacagcccccacccctgtgcccagggccgctgcaacctgctggtgaaccagtacagcctgggcaacagcctgtggttccctgtgggcggcttcatgcagcagggcagcaccatcgccccccgggccctgagcacccgctgtgtgtctggagtgtggtgggccttcaccctcatcatcatcagcagctacacagccaacctggccgccttcctgactgtgcagaggatggatgtgcccattgaatctgtggatgacctggccgaccagacagccattgaatatggcaccatccatggaggcagctccatgaccttcttccagaacagccgctaccagacctaccagaggatgtggaactacatgtacagcaagcagcccagcgtgtttgtgaagagcacagaggagggcatcgcccgggtgctgaacagcaactatgccttcctgctggagagcaccatgaatgagtactaccggcagaggaactgcaacctgacccagatcggcggcctgctggacaccaagggctatggaattggcatgcctgtgggctctgtgttcagagatgaatttgacctggccatcctgcagctgcaggagaacaaccggctggagatcctgaagaggaagtggtgggagggcggcaagtgccccaaggaggaggaccaccgggccaagggcctgggcatggagaacattggaggcatctttgtggtgctgatctgtggcctgattgtggccatcttcatggccatgctggagttcctgtggaccctgcggcacagcgaggccacagaggtgtctgtgtgccaggagatggtgacagagctgcggagcatcatcctgtgccaggacagcatccaccccaggagaagaagagctgctgtgcccccacccaggcctcccatccctgaggagcggcggccccggggcacagccaccctgagcaatggcaagctgtgtggggccggggagccagaccagctggcccagaggctggcccaggaggccgccctggtggcccggggctgcacccacatccgggtgtgcccagagtgccgccgcttccagggcctgcgggcccggcccagccctgcccggtctgaggagagcctggagtgggagaagaccaccaacagcagcgagcctgagtag

SEQ ID NO: 153956 - DNA, 2871 bp, Artificial Sequence; identical to SEQ ID NO: 153955
  Description of Artificial Sequence: Synthetic coding sequence

SEQ ID NO: 153957 - DNA, 2943 bp, Artificial Sequence
  Description of Artificial Sequence: Synthetic coding sequence
atgcctgctgagctgctgctgctgctgattgtggcctttgccagccccagctgccaggtgctgagcagcctgaggatggccgccatcctggatgaccagacagtgtgtggccgcggggagcggctggccctggccctggcccgggagcagatcaatggcatcatcgaggtgcctgccaaggcccgggtggaggtggacatctttgagctgcagagggacagccagtatgagaccacagacaccatgtgccagatcctgcccaagggcgtggtgtctgtgctgggccccagcagcagccctgccagcgccagcacagtgagccacatctgtggggagaaggagatcccccacatcaaggtgggccctgaggagaccccccggctgcagtacctgcgctttgcctctgtgtccctgtaccccagcaatgaagatgtgtccctggccgtgagccgcatcctgaagagcttcaactaccccagcgccagcctcatctgtgccaaggcagaatgtctgctgcggctggaggagctggtgcggggcttcctgatcagcaaggagaccctgtctgtgaggatgctggatgacagccgggaccccacccccctgctgaaggagatcagagatgacaaggtgtccaccatcatcattgatgccaatgccagcatcagccacctgatcctgaggaaggccagcgagctgggcatgaccagcgccttctacaagtacatcctgaccaccatggacttccccatcctgcacctggatggcatcgtggaggacagcagcaacatcctgggcttctccatgttcaacaccagccaccccttctacccagagtttgtgcgcagcctgaacatgtcctggagggagaactgtgaggccagcacctacctgggccctgccctgtctgctgccctgatgtttgatgctgtgcacgtggtggtgtctgctgtgcgggagctgaacagaagccaggagattggagtgaagcccctggcctgcaccagcgccaacatctggccccacggcaccagcctgatgaactacctgaggatggtggagtatgatggcctgaccggccgggtggagttcaacagcaagggccagaggaccaactacaccctgcgcatcctggagaagagccggcagggccaccgggagattggagtgtggtacagcaacagaaccctggccatgaatgccaccaccctggacatcaacctgagccagaccctggccaacaagaccctggtggtgaccaccatcctggagaacccctacgtgatgaggcggcccaacttccaggccctgtctggaaatgaaagatttgagggcttctgtgtggacatgctgcgggagctggccgagctgctgcgcttccgctaccgcctgcggctggtggaggatggcctgtatggagcccctgagcccaacggctcctggacaggcatggtgggggagctgatcaacaggaaggctgacctggccgtggccgccttcaccatcacagctgagcgggagaaggtgattgacttcagcaagcccttcatgaccctgggcatcagcatcctgtacagagtgcacatgggcaggaagccaggctacttctccttcctggaccccttcagccctgctgtgtggctgttcatgctgctggcctacctggccgtgtcctgtgtgctcttcctggccgcccggctgagcccctatgagtggtacaacccccacccctgcctgcgggcccggccccacatcctggagaaccagtacaccctgggcaacagcctgtggttccctgtgggcggcttcatgcagcagggcagcgagatcatgccccgggccctgagcacccgctgtgtgtctggagtgtggtgggccttcaccctcatcatcatcagcagctacacagccaacctggccgccttcctgactgtgcagaggatggaggtgcctgtggagagcgcagatgacctggccgaccagaccaacatcgagtatggcaccatccatgctggcagcaccatgaccttcttccagaacagccgctaccagacctaccagaggatgtggaactacatgcagagcaagcagcccagcgtgtttgtgaagagcacagaggagggcatcgcccgggtgctgaacagccgctatgccttcctgctggagagcaccatgaatgagtaccaccggcggctgaactgcaacctgacccagattggaggcctgctggacaccaagggctacggcatcggcatgcccctgggcagccccttcagagatgagatcaccctggccatcctgcagctgcaggagaacaaccggctggagatcctgaagaggaagtggtgggagggcggccgctgccccaaggaggaggaccaccgggccaagggcctgggcatggagaacatcggcggcatcttcatcgtgctgatctgtggcctcatcatcgctgtgtttgtggccgtgatggagttcatctggagcaccaggagatctgctgagagcgaggaggtgtctgtgtgccaggagatgctgcaggagctgcggcatgctgtgtcctgcaggaagaccagccgcagcagaagaagaagaagacctgggggccccagccgggccctgctgagcctgcgggctgtgcgggagatgaggctgagcaatggcaagctgtacagcgctggagctggaggagatgctggcagcgcccatggaggcccccagaggctgctggatgatcctggccccccatctggggcccggcctgctgcccccaccccctgcacccacgtgcgggtgtgccaggagtgccgccgcatccaggccctgcgggccagcggggccggggccccaccccggggcctgggcgtgcctgctgaggccaccagccccccccggccccggcccggccctgctggcccccgggagctggccgagcatgaatag

SEQ ID NO: 153958 - DNA, 2946 bp, Artificial Sequence
  Description of Artificial Sequence: Synthetic coding sequence
atgcctgctgagctgctgctgctgctgattgtggcctttgccagccccagctgccaggtgctgagcagcctgaggatggccgccatcctggatgaccagacagtgtgtggccgcggggagcggctggccctggccctggcccgggagcagatcaatggcatcatcgaggtgcctgccaaggcccgggtggaggtggacatctttgagctgcagagggacagccagtatgagaccacagacaccatgtgccagatcctgcccaagggcgtggtgtctgtgctgggccccagcagcagccctgccagcgccagcacagtgagccacatctgtggggagaaggagatcccccacatcaaggtgggccctgaggagaccccccggctgcagtacctgcgctttgcctctgtgtccctgtaccccagcaatgaagatgtgtccctggccgtgagccgcatcctgaagagcttcaactaccccagcgccagcctcatctgtgccaaggcagaatgtctgctgcggctggaggagctggtgcggggcttcctgatcagcaaggagaccctgtctgtgaggatgctggatgacagccgggaccccacccccctgctgaaggagatcagagatgacaaggtgtccaccatcatcattgatgccaatgccagcatcagccacctgatcctgaggaaggccagcgagctgggcatgaccagcgccttctacaagtacatcctgaccaccatggacttccccatcctgcacctggatggcatcgtggaggacagcagcaacatcctgggcttctccatgttcaacaccagccaccccttctacccagagtttgtgcgcagcctgaacatgtcctggagggagaactgtgaggccagcacctacctgggccctgccctgtctgctgccctgatgtttgatgctgtgcacgtggtggtgtctgctgtgcgggagctgaacagaagccaggagattggagtgaagcccctggcctgcaccagcgccaacatctggccccacggcaccagcctgatgaactacctgaggatggtggagtatgatggcctgaccggccgggtggagttcaacagcaagggccagaggaccaactacaccctgcgcatcctggagaagagccggcagggccaccgggagattggagtgtggtacagcaacagaaccctggccatgaatgccaccaccctggacatcaacctgagccagaccctggccaacaagaccctggtggtgaccaccatcctggagaacccctacgtgatgaggcggcccaacttccaggccctgtctggaaatgaaagatttgagggcttctgtgtggacatgctgcgggagctggccgagctgctgcgcttccgctaccgcctgcggctggtggaggatggcctgtatggagcccctgagcccaacggctcctggacaggcatggtgggggagctgatcaacaggaaggctgacctggccgtggccgccttcaccatcacagctgagcgggagaaggtgattgacttcagcaagcccttcatgaccctgggcatcagcatcctgtacagagtgcacatgggcaggaagccaggctacttctccttcctggaccccttcagccctgctgtgtggctgttcatgctgctggcctacctggccgtgtcctgtgtgctcttcctggccgcccggctgagcccctatgagtggtacaacccccacccctgcctgcgggcccggccccacatcctggagaaccagtacaccctgggcaacagcctgtggttccctgtgggcggcttcatgcagcagggcagcgagatcatgccccgggccctgagcacccgctgtgtgtctggagtgtggtgggccttcaccctcatcatcatcagcagctacacagccaacctggccgccttcctgactgtgcagaggatggaggtgcctgtggagagcgcagatgacctggccgaccagaccaacatcgagtatggcaccatccatgctggcagcaccatgaccttcttccagaacagccgctaccagacctaccagaggatgtggaactacatgcagagcaagcagcccagcgtgtttgtgaagagcacagaggagggcatcgcccgggtgctgaacagccgctatgccttcctgctggagagcaccatgaatgagtaccaccggcggctgaactgcaacctgacccagattggaggcctgctggacaccaagggctacggcatcggcatgcccctgggcagccccttcagagatgagatcaccctggccatcctgcagctgcaggagaacaaccggctggagatcctgaagaggaagtggtgggagggcggccgctgccccaaggaggaggaccaccgggccaagggcctgggcatggagaacatcggcggcatcttcatcgtgctgatctgtggcctcatcatcgctgtgtttgtggccgtgatggagttcatctggagcaccaggagatctgctgagagcgaggagaccccagccctgcaccctgctgcctgccagtgcagcgccctgggccccaggacccccctgaaggagcccagcatgctgctggtgaaggtgcccagcaccagggtgcaggtggccttcagcaggaccagcctgcggcaggtgtgccccttcctgctgcagcaccagctgagcagcctgtactggatccaggccaccaacgtgcagatctgctgccacttcagcagcctgaagcccagcccagacctgaccttcccccccagccaccggcccctgagcagcctgctcttcaccgccctggccgctgtgggcggcctgcctgatgccagcagcttcttcttcccccccatcagcagctgcccccccctgcagagcggcatcggcccctgccacagcacagaggccaccctggtgaccagcaacttccacgtgtag

SEQ ID NO: 153959 - DNA, 1077 bp, Artificial Sequence
  Description of Artificial Sequence: Synthetic coding sequence
tgatgggccttcaccctcatcatcatcagcagctacacagccaacctggccgccttcctgactgtgcagaggatggaggtgcctgtggagagcgcagatgacctggccgaccagaccaacattgaatatggcaccatccacgccggcagcaccatgaccttcttccagaacagccgctaccagacctaccagaggatgtggaactacatgcagagcaagcagcccagcgtgtttgtgaagagcacagaggagggcatcgcccgggtgctgaacagccgctatgccttcctgctggagagcaccatgaatgagtaccaccggcggctgaactgcaacctgacccagatcggcggcctgctggacaccaagggctatggaattggcatgcccctgggcagccccttcagagatgagatcaccctggccatcctgcagctgcaggagaacaaccggctggagatcctgaagaggaagtggtgggagggcggccgctgccccaaggaggaggaccaccgggccaagggcctgggcatggagaacattggaggcatcttcatcgtgctgatctgtggcctcatcatcgctgtgtttgtggccgtgatggagttcatctggagcacccggcgctctgctgagagcgaggagaccccagccctgcaccctgctgcctgccagtgcagcgccctgggccccaggacccccctgaaggagcccagcatgctgctggtgaaggtgcccagcaccagggtgcaggtggccttcagcaggaccagcctgcggcaggtgtgccccttcctgctgcagcaccagctgagcagcctgtactggatccaggccaccaacgtgcagatctgctgccacttcagcagcctgaagcccagcccagacctgaccttcccccccagccaccggcccctgagcagcctgctcttcaccgccctggccgctgtgggcggcctgcctgatgccagcagcttcttcttcccccccatcagcagctgcccccccctgcagagcggcatcggcccctgccacagcacagaggccaccctggtgaccagcaacttccacgtgtag

SEQ ID NO: 153960 - DNA, 2769 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaaggccgagaaggtgctgcagtttgatcctggcaccaagaatgtgacagccctgctgatggaggccaaggagctggaggcccgggtcatcatcctgagcgcctctgaagatgatgctgccaccgtgtacagagctgctgccatgctgaacatgactggaagtggctacgtgtggctggtgggggagcgggagatctctggaaatgccctgcgctatgccccagatggcatcctgggcctgcagctgatcaatggcaagaatgaaagtgcccacatcagtgatgctgtgggcgtggtggcccaggccgtgcatgagctgctggagaaggagaacatcacagaccccccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcattggagagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgaatctgctgctgaggccatccaggccgtgcgggacaacaagctgcacgccttcatctgggacagcgctgtgctggagtttgaggccagccagaagtgtgacctggtgaccactggagagctgttcttccgcagcggcttcggcatcggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcattgaaattgcctacaagaggcacaaggatgcccggaggaagcagatgcagctggcctttgctgctgtgaatgtgtggaggaagaacctgcaggacaggaagagcggccgggcagagccagaccccaagaagaaggccaccttccgggccatcaccagcaccctggccagcagcttcaagagaagaagaagcagcaaggacacccagtaccaccccacagacatcaccggccccctgaacctgagtgaccccagcgtgtccacagtggtgtag

SEQ ID NO: 153961 - DNA, 2730 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaaggccgagaaggtgctgcagtttgatcctggcaccaagaatgtgacagccctgctgatggaggccaaggagctggaggcccgggtcatcatcctgagcgcctctgaagatgatgctgccaccgtgtacagagctgctgccatgctgaacatgactggaagtggctacgtgtggctggtgggggagcgggagatctctggaaatgccctgcgctatgccccagatggcatcctgggcctgcagctgatcaatggcaagaatgaaagtgcccacatcagtgatgctgtgggcgtggtggcccaggccgtgcatgagctgctggagaaggagaacatcacagaccccccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcattggagagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgaatctgctgctgaggccatccaggccgtgcgggacaacaagctgcacgccttcatctgggacagcgctgtgctggagtttgaggccagccagaagtgtgacctggtgaccactggagagctgttcttccgcagcggcttcggcatcggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcattgaaattgcctacaagaggcacaaggatgcccggaggaagcagatgcagctggcctttgctgctgtgaatgtgtggaggaagaacctgcaggtgggccaggccaccctgcggggcctggtgccccgggcccggcccggccacggccccccacccagccccaaggctgtggccctggccctggccctggtgggccgcactggagcccggagccacggccagggccagtggtag

SEQ ID NO: 153962 - DNA, 2832 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaagagcaagaagaggaactatgagaacctggaccagctgtcctatgacaacaagaggggccccaaggccgagaaggtgctgcagtttgaccccggcaccaagaatgtgacagccctgctgatggaggccaaggagctggaggcccgggtcatcatcctgagcgcctctgaagatgatgctgccaccgtgtacagagctgctgccatgctgaacatgacaggcagcggctacgtgtggctggtgggggagcgggagatctctggaaatgccctgcgctatgccccagatggcatcctgggcctgcagctgatcaacgggaagaatgaaagtgcccacatcagtgatgctgtgggcgtggtggcccaggccgtgcatgagctgctggagaaggagaacatcacagatcctccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcatcggggagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgagagcgctgctgaggccatccaggccgtgcgggacaacaagctgcacgccttcatctgggacagcgctgtgctggagtttgaggccagccagaagtgtgacctggtgaccaccggggagctgttcttccgcagcggctttggaattggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcatcgagatcgcctacaagaggcacaaggatgcccggaggaagcagatgcagctggcctttgctgctgtgaatgtgtggaggaagaacctgcaggacaggaagagcggccgggcagagccagaccccaagaagaaggccaccttccgggccatcaccagcaccctggccagcagcttcaagagaagaagaagcagcaaggacacccagtaccaccccacagacatcaccggccccctgaacctgagtgaccccagcgtgtccacagtggtgtag

SEQ ID NO: 153963 - DNA, 2769 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaagagcaagaagaggaactatgagaacctggaccagctgtcctatgacaacaagaggggccccaaggccgagaaggtgctgcagtttgaccccggcaccaagaatgtgacagccctgctgatggaggccaaggagctggaggcccgggtcatcatcctgagcgcctctgaagatgatgctgccaccgtgtacagagctgctgccatgctgaacatgacaggcagcggctacgtgtggctggtgggggagcgggagatctctggaaatgccctgcgctatgccccagatggcatcctgggcctgcagctgatcaacgggaagaatgaaagtgcccacatcagtgatgctgtgggcgtggtggcccaggccgtgcatgagctgctggagaaggagaacatcacagatcctccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcatcggggagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgagagcgctgctgaggccatccaggccgtgcgggacaacaagctgcacgccttcatctgggacagcgctgtgctggagtttgaggccagccagaagtgtgacctggtgaccaccggggagctgttcttccgcagcggctttggaattggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcatcgagatcgcctacaagaggcacaaggatgcccggaggaagcagatgcagctggcctttgctgctgtgaatgtgtggaggaagaacctgcagagcactggaggcggccgcggggccctgcagaaccagaaggacacagtgctgccccggcgggccatcgagcgggaggagggccagctgcagctgtgcagccgccaccgggagagctag

SEQ ID NO: 153964 - DNA, 2721 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaagagcaagaagaggaactatgagaacctggaccagctgtcctatgacaacaagaggggccccaaggccgagaaggtgctgcagtttgaccccggcaccaagaatgtgacagccctgctgatggaggccaaggagctggaggcccgggtcatcatcctgagcgcctctgaagatgatgctgccaccgtgtacagagctgctgccatgctgaacatgacaggcagcggctacgtgtggctggtgggggagcgggagatctctggaaatgccctgcgctatgccccagatggcatcctgggcctgcagctgatcaacgggaagaatgaaagtgcccacatcagtgatgctgtgggcgtggtggcccaggccgtgcatgagctgctggagaaggagaacatcacagatcctccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcatcggggagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgagagcgctgctgaggccatccaggccgtgcgggacaacaagctgcacgccttcatctgggacagcgctgtgctggagtttgaggccagccagaagtgtgacctggtgaccaccggggagctgttcttccgcagcggctttggaattggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcatcgagatcgcctacaagaggcacaaggatgcccggaggaagcagatgcagctggcctttgctgctgtgaatgtgtggaggaagaacctgcagcagtaccaccccacagacatcaccggccccctgaacctgagtgaccccagcgtgtccacagtggtgtag

SEQ ID NO: 153965 - DNA, 2817 bp, Artificial Sequence
  Description of Artificial Sequence: Synthetic coding sequence
atgagcaccatgaggctgctgaccctggccctgctcttcagctgcagcgtggcccgggccgcctgtgaccccaagatcgtgaacattggagctgtgctgagcaccaggaagcatgagcagatgttccgggaggccgtgaaccaggccaacaagagacatggctcctggaagatccagctgaatgccacctctgtgacccacaagcccaatgccatccagatggccctgtctgtgtgtgaggacctgatcagcagccaggtgtatgccatcctggtgagccacccccccaccccaaatgaccacttcacccccacccctgtgtcctacacagctggcttctaccgcatccctgtgctgggcctgaccaccaggatgagcatctacagcgacaagagcatccacctgtccttcctgaggacagtgcccccctacagccaccagagctctgtgtggtttgagatgatgagggtgtacagctggaaccacatcatcctgctggtgtctgatgaccacgagggccgggccgcccagaagaggctggagaccctgctggaggagcgggagagcaaggccgagaaggtgctgcagtttgatcctggcaccaagaatgtgacagccctgctgatggaggccaaggagctggaggcccgggtcatcatcctgagcgcctctgaagatgatgctgccaccgtgtacagagctgctgccatgctgaacatgactggaagtggctacgtgtggctggtgggggagcgggagatctctggaaatgccctgcgctatgccccagatggcatcctgggcctgcagctgatcaatggcaagaatgaaagtgcccacatcagtgatgctgtgggcgtggtggcccaggccgtgcatgagctgctggagaaggagaacatcacagaccccccccggggctgtgtgggcaacaccaacatctggaagacaggccccctcttcaagagggtgctgatgagcagcaaatatgcagatggagtgacaggccgggtggagttcaatgaagatggagacaggaagtttgccaactacagcatcatgaacctgcagaacaggaagctggtgcaggtgggcatctacaacggcacccacgtgatccccaatgacaggaagatcatctggccaggaggagaaacagagaagccccggggctaccagatgagcacccggctgaagatcgtgaccatccaccaggagccctttgtgtatgtgaagcccaccctgagtgatggcacctgcaaggaggagttcaccgtgaatggagaccctgtgaagaaggtgatctgcaccggccccaatgacaccagccctggcagccccaggcacacagtgccccagtgctgctacggcttctgcatcgacctgctgatcaagctggcccggaccatgaacttcacctatgaggtgcacctggtggctgatggcaagtttggcacccaggagcgggtgaacaacagcaacaagaaggagtggaatggcatgatgggagagctgctgagcggccaggccgacatgattgtggcccccctgaccatcaacaatgaaagagcccagtacatcgagttcagcaagcccttcaagtaccagggcctgaccatcctggtgaagaaggagatccccaggagcaccctggacagcttcatgcagcccttccagagcaccctgtggctgctggtgggcctgtctgtgcacgtggtggccgtgatgctgtacctgctggaccgcttcagccccttcggccgcttcaaggtgaacagcgaggaggaggaggaggatgccctgaccctgagcagcgccatgtggttctcctggggcgtgctgctgaacagcggcattggagagggcgcccccaggagcttcagcgcccgcatcctgggcatggtgtgggccggctttgccatgatcatcgtggccagctacacagccaacctggccgccttcctggtgctggacaggcctgaggagcgcatcaccggcatcaatgacccccggctgaggaaccccagcgacaagttcatctatgccaccgtgaagcagagctctgtggacatctacttccggcggcaggtggagctgagcaccatgtaccgccacatggagaagcacaactatgaatctgctgctgaggccatccaggccgtgcgggacaacaagctgcacgccttcatctgggacagcgctgtgctggagtttgaggccagccagaagtgtgacctggtgaccactggagagctgttcttccgcagcggcttcggcatcggcatgaggaaggacagcccctggaagcagaatgtgtccctgagcatcctgaagagccatgaaaatggcttcatggaggacctggacaagacctgggtgcgctaccaggagtgtgacagccgcagcaatgccccagccaccctgacctttgagaacatggccggggtcttcatgctggtggccggcggcatcgtggccggcatcttcctgatcttcattgaaattgcctacaagaggcacaaggatgcccggaggaagcagatgcagctggcctttgctgctgtgaatgtgtggaggaagaacctgcaggacaggaagagcggccgggcagagccagaccccaagaagaaggccaccttccgggccatcaccagcaccctggccagcagcttcaagagaagaagaagcagcaaggacaccagcactggaggcggccgcggggccctgcagaaccagaaggacacagtgctgccccggcgggccatcgagcgggaggagggccagctgcagctgtgcagccgccaccgggagagctag

SEQ ID NO: 153966 - DNA, 4395 bp, Artificial Sequence
  Description of Artificial Sequence: Synthetic coding sequence
atgggccgggtgggctactggaccctgctggtgctgcctgccctgctggtgtggaggggccctgcccccagcgctgctgctgagaagggccccccagccctgaacattgctgtgatgctgggccacagccatgatgtgacagagcgggagctgcggaccctgtggggccctgagcaggccgccggcctgcccctggatgtgaatgtggtggccctgctgatgaacagaacagaccccaagagcctcatcacccacgtgtgtgacctgatgtctggggcccgcatccacggcctggtgtttggagatgacacagaccaggaggccgtggcccagatgctggacttcatcagcagccacacctttgtgcccatcctgggcatccacggcggggcctccatgatcatggctgacaaggaccccaccagcaccttcttccagtttggagccagcatccagcagcaggccaccgtgatgctgaagatcatgcaggactatgactggcacgtgttcagcctggtgaccaccatcttccctggctaccgggagttcatcagctttgtgaagaccaccgtggacaacagctttgtgggctgggacatgcagaatgtcatcaccctggacaccagctttgaagatgccaagacccaggtgcagctgaagaagatccacagcagcgtcatcctgctgtactgcagcaaggatgaggccgtgctgatcctgtctgaggcccggagcctgggcctgaccggctatgacttcttctggatcgtgcccagcctggtgtctggcaacacagagctgatccccaaggagttccccagcggcctcatctctgtgtcctatgatgactgggactacagcctggaggcccgggtgagagatggcatcggcatcctgaccacagctgccagctccatgctggagaagttctcctacatccctgaggccaaggccagctgctacggccagatggagaggcctgaggtgcccatgcacaccctgcaccccttcatggtgaatgtgacctgggatggcaaggacctgtccttcacagaggagggctaccaggtgcacccccggctggtggtgattgtgctgaacaaggaccgggagtgggagaaggtgggcaagtgggagaaccacaccctgagcctgcggcatgctgtgtggccccgctacaagagcttcagtgactgtgagccagatgacaaccacctgagcatcgtgaccctggaggaggcccccttcgtcatcgtggaggacatcgaccccctgacagagacctgtgtgaggaacacagtgccctgcaggaagtttgtgaagatcaacaacagcaccaatgaaggcatgaatgtgaagaagtgctgcaagggcttctgcatcgacatcctgaagaagctgagcaggacagtgaagttcacctatgacctgtacctggtgaccaacgggaagcacggcaagaaggtgaacaacgtgtggaatggcatgattggagaggtggtgtaccagagagctgtgatggctgtgggcagcctgaccatcaatgaggagaggtctgaggtggtggacttctctgtgccctttgtggagaccggcatctctgtgatggtgagccgcagcaatggaacagtgagccccagcgccttcctggagcccttcagcgcctctgtgtgggtgatgatgtttgtgatgctgctgattgtgtctgccatcgctgtgtttgtgtttgagtacttcagccctgtgggctacaacagaaacctggccaagggcaaggcccctcatggccccagcttcaccatcggcaaggccatctggctgctgtggggcctggtgttcaacaacagcgtgcctgtgcagaaccccaagggcaccaccagcaagatcatggtgtctgtgtgggccttctttgctgtgatcttcctggccagctacacagccaacctggccgccttcatgatccaggaggagtttgtggaccaggtgacaggcctgagtgacaagaagttccagaggcctcatgactacagcccccccttccgcttcggcaccgtgcccaacggcagcacagagaggaacatccggaacaactacccctacatgcaccagtacatgaccaagttcaaccagaagggcgtggaggatgccctggtgtccctgaagacaggcaagctggatgccttcatctatgatgctgctgtgctgaactacaaggccggcagagatgagggctgcaagctggtgaccatcggcagcggctacatctttgccaccaccggctatggaattgccctgcagaagggcagcccctggaagaggcagattgacctggccctgctgcagtttgtgggagatggagagatggaggagctggagaccctgtggctgaccggcatctgccacaatgagaagaatgaggtgatgagcagccagctggacatcgacaacatggccggggtcttctacatgctggccgccgccatggccctgagcctcatcaccttcatctgggagcacctgttctactggaagctgcgcttctgcttcaccggggtgtgcagcgacaggcctggcctgctcttcagcatcagccggggcatctacagctgcatccacggcgtgcacatcgaggagaagaagaagagcccagacttcaacctgaccggcagccagagcaacatgctgaagctgctgcggagcgccaagaacatcagctccatgagcaacatgaacagcagcaggatggacagccccaagagagctgctgacttcatccagaggggcagcctcatcatggacatggtgtctgacaagggcaacctgatgtacagcgacaacagaagcttccagggcaaggagagcatctttggagacaacatgaatgagctgcagacctttgtggccaaccggcagaaggacaacctgaacaactacgtgttccagggccagcaccccctgaccctgaatgaaagcaaccccaacacagtggaggtggccgtgtccacagagagcaaggccaacagccggccccggcagctgtggaagaagtctgtggacagcatccggcaggacagcctgagccagaaccctgtgtcccagagagatgaggccacagctgagaacagaacccacagcctgaagagcccccgctacctgcctgaggagatggcccacagcgacatcagcgagaccagcaacagagccacctgccaccgggagccagacaacagcaagaaccacaagaccaaggacaacttcaagaggtctgtggccagcaagtaccccaaggactgcagcgaggtggagaggacctacctgaagaccaagagcagcagcccccgggacaagatctacaccattgatggagagaaggagcccggcttccacctggaccccccccagtttgtggagaatgtgaccctgcctgaaaatgtggacttcccagacccctaccaggaccccagcgagaacttcaggaagggggacagcaccctgcccatgaacagaaaccccctgcacaatgaggagggcctgagcaacaatgaccagtacaagctgtacagcaagcacttcaccctgaaggacaagggcagcccccacagcgagaccagcgagcgctaccggcagaacagcacccactgccgcagctgcctgagcaacatgcccacctacagcggccacttcaccatgaggagccccttcaagtgtgatgcctgcctgaggatgggcaacctgtatgacattgatgaggaccagatgctgcaggagactggaaatcctgccaccggggagcaggtgtaccagcaggactgggcccagaacaatgccctgcagctgcagaagaacaagctgcgcatcagccggcagcacagctatgacaacatcgtggacaagccccgggagctggacctgagccggcccagccgcagcatcagcctgaaggaccgggagcggctgctggagggcaacttctacggcagcctcttctctgtgcccagcagcaagctgagcggcaagaagagcagcctcttcccccagggcctggaggacagcaagaggagcaagagcctgctgcctgaccacaccagtgacaaccccttcctgcacagccacagagatgaccagaggctggtgattggccgctgccccagcgacccctacaagcacagcctgcccagccaggccgtgaatgacagctacctgcggagcagcctgcggagcacagccagctactgcagccgggacagccggggccacaatgatgtgtacatcagcgagcacgtgatgccctatgctgccaacaagaacaacatgtacagcaccccccgggtgctgaacagctgcagcaacagaagagtgtacaagaagatgcccagcattgaaagtgatgtgtag

SEQ ID NO: 153967 - DNA, 4395 bp, Artificial Sequence; identical to SEQ ID NO: 153966
  Description of Artificial Sequence: Synthetic coding sequence

SEQ ID NO: 153968 - DNA, 4395 bp, Artificial Sequence; identical to SEQ ID NO: 153966
  Description of Artificial Sequence: Synthetic coding sequence

SEQ ID NO: 153969 - DNA, 3846 bp, Artificial Sequence
  Description of Artificial Sequence: Synthetic coding sequence
atgggccgggtgggctactggaccctgctggtgctgcctgccctgctggtgtggaggggccctgcccccagcgctgctgctgagaagggccccccagccctgaacattgctgtgatgctgggccacagccatgatgtgacagagcgggagctgcggaccctgtggggccctgagcaggccgccggcctgcccctggatgtgaatgtggtggccctgctgatgaacagaacagaccccaagagcctcatcacccacgtgtgtgacctgatgtctggggcccgcatccacggcctggtgtttggagatgacacagaccaggaggccgtggcccagatgctggacttcatcagcagccacacctttgtgcccatcctgggcatccacggcggggcctccatgatcatggctgacaaggaccccaccagcaccttcttccagtttggagccagcatccagcagcaggccaccgtgatgctgaagatcatgcaggactatgactggcacgtgttcagcctggtgaccaccatcttccctggctaccgggagttcatcagctttgtgaagaccaccgtggacaacagctttgtgggctgggacatgcagaatgtcatcaccctggacaccagctttgaagatgccaagacccaggtgcagctgaagaagatccacagcagcgtcatcctgctgtactgcagcaaggatgaggccgtgctgatcctgtctgaggcccggagcctgggcctgaccggctatgacttcttctggatcgtgcccagcctggtgtctggcaacacagagctgatccccaaggagttccccagcggcctcatctctgtgtcctatgatgactgggactacagcctggaggcccgggtgagagatggcatcggcatcctgaccacagctgccagctccatgctggagaagttctcctacatccctgaggccaaggccagctgctacggccagatggagaggcctgaggtgcccatgcacaccctgcaccccttcatggtgaatgtgacctgggatggcaaggacctgtccttcacagaggagggctaccaggtgcacccccggctggtggtgattgtgctgaacaaggaccgggagtgggagaaggtgggcaagtgggagaaccacaccctgagcctgcggcatgctgtgtggccccgctacaagagcttcagtgactgtgagccagatgacaaccacctgagcatcgtgaccctggaggaggcccccttcgtcatcgtggaggacatcgaccccctgacagagacctgtgtgaggaacacagtgccctgcaggaagtttgtgaagatcaacaacagcaccaatgaaggcatgaatgtgaagaagtgctgcaagggcttctgcatcgacatcctgaagaagctgagcaggacagtgaagttcacctatgacctgtacctggtgaccaacgggaagcacggcaagaaggtgaacaacgtgtggaatggcatgattggagaggtggtgtaccagagagctgtgatggctgtgggcagcctgaccatcaatgaggagaggtctgaggtggtggacttctctgtgccctttgtggagaccggcatctctgtgatggtgagccgcagcaatggaacagtgagccccagcgccttcctggagcccttcagcgcctctgtgtgggtgatgatgtttgtgatgctgctgattgtgtctgccatcgctgtgtttgtgtttgagtacttcagccctgtgggctacaacagaaacctggccaagggcaaggcccctcatggccccagcttcaccatcggcaaggccatctggctgctgtggggcctggtgttcaacaacagcgtgcctgtgcagaaccccaagggcaccaccagcaagatcatggtgtctgtgtgggccttctttgctgtgatcttcctggccagctacacagccaacctggccgccttcatgatccaggaggagtttgtggaccaggtgacaggcctgagtgacaagaagttccagaggcctcatgactacagcccccccttccgcttcggcaccgtgcccaacggcagcacagagaggaacatccggaacaactacccctacatgcaccagtacatgaccaagttcaaccagaagggcgtggaggatgccctggtgtccctgaagacaggcaagctggatgccttcatctatgatgctgctgtgctgaactacaaggccggcagagatgagggctgcaagctggtgaccatcggcagcggctacatctttgccaccaccggctatggaattgccctgcagaagggcagcccctggaagaggcagattgacctggccctgctgcagtttgtgggagatggagagatggaggagctggagaccctgtggctgaccggcatctgccacaatgagaagaatgaggtgatgagcagccagctggacatcgacaacatggccggggtcttctacatgctggccgccgccatggccctgagcctcatcaccttcatctgggagcacctgttctactggaagctgcgcttctgcttcaccggggtgtgcagcgacaggcctggcctgctcttcagcatcagccggggcatctacagctgcatccacggcgtgcacatcgaggagaagaagaagagcccagacttcaacctgaccggcagccagagcaacatgctgaagctgctgcggagcgccaagaacatcagctccatgagcaacatgaacagcagcaggatggacagccccaagagagctgctgacttcatccagaggggcagcctcatcatggacatggtgtctgacaagggcaacctgatgtacagcgacaacagaagcttccagggcaaggagagcatctttggagacaacatgaatgagctgcagacctttgtggccaaccggcagaaggacaacctgaacaactacgtgttccagggccagcaccccctgaccctgaatgaaagcaaccccaacacagtggaggtggccgtgtccacagagagcaaggccaacagccggccccggcagctgtggaagaagtctgtggacagcatccggcaggacagcctgagccagaaccctgtgtcccagagagatgaggccacagctgagaacagaacccacagcctgaagagcccccgctacctgcctgaggagatggcccacagcgacatcagcgagaccagcaacagagccacctgccaccgggagccagacaacagcaagaaccacaagaccaaggacaacttcaagaggtctgtggccagcaagtaccccaaggactgcagcgaggtggagaggacctacctgaagaccaagagcagcagcccccgggacaagatctacaccattgatggagagaaggagcccggcttccacctggaccccccccagtttgtggagaatgtgaccctgcctgaaaatgtggacttcccagacccctaccaggaccccagcgagaacttcaggaagggggacagcaccctgcccatgaacagaaaccccctgcacaatgaggagggcctgagcaacaatgaccagtacaagctgtacagcaagcacttcaccctgaaggacaagggcagcccccacagcgagaccagcgagcgctaccggcagaacagcacccactgccgcagctgcctgagcaacatgcccacctacagcggccacttcaccatgaggagccccttcaagtgtgatgcctgcctgaggatgggcaacctgtatgacattgatgaggaccagatgctgcaggagaccggcatgaccaatgcctggctgctgggagatgcccccaggaccctgaccaacacccgctgccaccccaggaggtag

SEQ ID NO: 153970 - DNA, 3375 bp, Artificial Sequence
  Description of Artificial Sequence: Synthetic coding sequence
atgctgaagatcatgcaggactatgactggcacgtgttcagcctggtgaccaccatcttccctggctaccgggagttcatcagctttgtgaagaccaccgtggacaacagctttgtgggctgggacatgcagaatgtcatcaccctggacaccagctttgaagatgccaagacccaggtgcagctgaagaagatccacagcagcgtcatcctgctgtactgcagcaaggatgaagctgtgctgatcctgtctgaggcccggagcctgggcctgaccggctatgacttcttctggatcgtgcccagcctggtgtctggcaacacagagctgatccccaaggagttccccagcggcctcatctctgtgtcctatgatgactgggactacagcctggaggcccgggtgagagatggcatcggcatcctgaccacagctgccagctccatgctggagaagttctcctacatccctgaggccaaggccagctgctacggccagatggagaggcctgaggtgcccatgcacaccctgcaccccttcatggtgaatgtgacctgggatggcaaggacctgtccttcacagaggagggctaccaggtgcacccccggctggtggtgattgtgctgaacaaggaccgggagtgggagaaggtgggcaagtgggagaaccacaccctgagcctgcggcatgctgtgtggccccgctacaagagcttcagtgactgtgagccagatgacaaccacctgagcatcgtgaccctggaggaggccccctttgtgattgtggaggacatcgaccccctgacagagacctgtgtgaggaacacagtgccctgcaggaagtttgtgaagatcaacaacagcaccaatgaaggcatgaatgtgaagaagtgctgcaagggcttctgcatcgacatcctgaagaagctgagcaggacagtgaagttcacctatgacctgtacctggtgaccaacgggaagcacggcaagaaggtgaacaacgtgtggaatggcatgattggagaggtggtgtaccagagagctgtgatggctgtgggcagcctgaccatcaatgaggagaggtctgaggtggtggacttctctgtgccctttgtggagaccggcatctctgtgatggtgagccgcagcaatggcaccgtgagccccagcgccttcctggagcccttcagcgcctctgtgtgggtgatgatgtttgtgatgctgctgattgtgtctgccatcgctgtgtttgtgtttgagtacttcagccctgtgggctacaacagaaacctggccaagggcaaggccccccacggccccagcttcaccatcggcaaggccatctggctgctgtggggcctggtgttcaacaacagcgtgcctgtgcagaaccccaagggcaccaccagcaagatcatggtgtctgtgtgggccttctttgctgtgatcttcctggccagctacacagccaacctggccgccttcatgatccaggaggagtttgtggaccaggtgacaggcctgagtgacaagaagttccagaggcctcatgactacagcccccccttccgctttggaacagtgcccaacggcagcacagaaagaaacatccggaacaactacccctacatgcaccagtacatgaccaagttcaaccagaagggcgtggaggatgccctggtgtccctgaagacaggcaagctggatgccttcatctatgatgctgctgtgctgaactacaaggccggcagagatgagggctgcaagctggtgaccatcggcagcggctacatctttgccaccaccggctacggcatcgccctgcagaagggcagcccctggaagaggcagattgacctggccctgctgcagtttgtgggagatggagagatggaggagctggagaccctgtggctgaccggcatctgccacaatgagaagaatgaggtgatgagcagccagctggacatcgacaacatggccggggtcttctacatgctggccgccgccatggccctgagcctcatcaccttcatctgggagcacctgttctactggaagctgcgcttctgcttcaccggggtgtgcagcgaccggcccggcctgctcttcagcatcagccggggcatctacagctgcatccatggagtgcacatcgaggagaagaagaagagcccagacttcaacctgaccggcagccagagcaacatgctgaagctgctgcggagcgccaagaacatcagctccatgagcaacatgaacagcagcaggatggacagccccaagagagctgctgacttcatccagaggggcagcctcatcatggacatggtgtctgacaagggcaacctgatgtacagcgacaacagaagcttccagggcaaggagagcatctttggagacaacatgaatgagctgcagacctttgtggccaaccggcagaaggacaacctgaacaactacgtgttccagggccagcaccccctgaccctgaatgaaagcaaccccaacacagtggaggtggccgtgtccacagagagcaaggccaacagccggccccggcagctgtggaagaagtctgtggacagcatccggcaggacagcctgagccagaaccctgtgtcccagagagatgaggccacagcagaaaatagaacccacagcctgaagagcccccgctacctgcctgaggagatggcccacagcgacatcagcgagaccagcaacagagccacctgccaccgggagccagacaacagcaagaaccacaagaccaaggacaacttcaagaggtctgtggccagcaagtaccccaaggactgcagcgaggtggagaggacctacctgaagaccaagagcagcagcccccgggacaagatctacaccattgatggagagaaggagcccggcttccacctggaccccccccagtttgtggagaatgtgaccctgcctgaaaatgtggacttcccagacccctaccaggaccccagcgagaacttcagaaaaggagacagcaccctgcccatgaacagaaaccccctgcacaatgaggagggcctgagcaacaatgaccagtacaagctgtacagcaagcacttcaccctgaaggacaagggcagcccccacagcgagaccagcgagcgctaccggcagaacagcacccactgccgcagctgcctgagcaacatgcccacctacagcggccacttcaccatgaggagccccttcaagtgtgatgcctgcctgaggatgggcaacctgtatgacattgatgaggaccagatgctgcaggagaccggcatgaccaatgcctggctgctgggagatgcccccaggaccctgaccaacacccgctgccaccccaggaggtag

SEQ ID NO: 153971 - DNA, 4455 bp, Artificial Sequence
  Description of Artificial Sequence: Synthetic coding sequence
atgaagcccagggctgagtgctgcagccccaagttctggctggtgctggccgtgctggccgtgtctggcagccgggcccggagccagaagagcccccccagcattggaattgctgtgatcctggtgggcaccagtgatgaggtggccatcaaggatgcccacgagaaggatgacttccaccacctgtctgtggtgccccgggtggagctggtggccatgaatgaaacagaccccaagagcatcatcacccgcatctgtgacctgatgtctgacaggaagatccagggcgtggtgtttgctgatgacacagaccaggaggccatcgcccagatcctggacttcatcagcgcccagaccctgacccccatcctgggcatccatggaggcagctccatgatcatggctgacaaggatgagagctccatgttcttccagtttggccccagcattgagcagcaggcctctgtgatgctgaacatcatggaggagtatgactggtacatcttcagcatcgtgaccacctacttccctggctaccaggactttgtgaacaagatccgcagcaccattgaaaattcctttgtgggctgggagctggaggaggtgctgctgctggacatgagcctggatgatggagacagcaagatccagaaccagctgaagaagctgcagagccccatcatcctgctgtactgcaccaaggaggaggccacctacatctttgaggtggccaacagcgtgggcctgaccggctacggctacacctggatcgtgcccagcctggtggccggggacacagacacagtgcctgctgagttccccaccggcctcatctctgtgtcctatgatgagtgggactatggcctgcctgcccgggtgagagatggcatcgccatcatcaccacagctgccagtgacatgctgtctgagcacagcttcatccctgagcccaagagcagctgctacaacacccatgagaagaggatctaccagagcaacatgctgaaccgctacctgatcaacgtgacctttgagggcaggaacctgtccttctctgaagatggctaccagatgcaccccaagctggtgatcatcctgctgaacaaggagaggaagtgggagcgggtgggcaagtggaaggacaagagcctgcagatgaagtactacgtgtggcccaggatgtgcccagagacagaggagcaggaggatgaccacctgagcatcgtgaccctggaggaggcccccttcgtcatcgtggagagcgtggaccccctgagcggcacctgcatgaggaacacagtgccctgccagaagagaattgtgacagagaacaagacagatgaggagcccggctacatcaagaagtgctgcaagggcttctgcatcgacatcctgaagaagatcagcaagtctgtgaagttcacctatgacctgtacctggtgaccaacgggaagcacggcaagaagatcaatggcacctggaatggcatgattggagaggtggtgatgaagagggcctacatggctgtgggcagcctgaccatcaatgaggagaggtctgaggtggtggacttctctgtgcccttcatcgagaccggcatctctgtgatggtgagccgcagcaatggcaccgtgagccccagcgccttcctggagcccttcagcgcagatgtgtgggtgatgatgtttgtgatgctgctgattgtgtctgctgtggccgtgtttgtgtttgagtacttcagccctgtgggctacaaccgctgcctggctgatggccgggagcccggcggccccagcttcaccatcggcaaggccatctggctgctgtggggcctggtgttcaacaacagcgtgcctgtgcagaaccccaagggcaccaccagcaagatcatggtgtctgtgtgggccttctttgctgtgatcttcctggccagctacacagccaacctggccgccttcatgatccaggaggagtatgtggaccaggtgtctggcctgagtgacaagaagttccagaggcccaatgacttcagcccccccttccgctttggaacagtgcccaacggcagcacagaaagaaacatccggaacaactatgcagagatgcacgcctacatgggcaagttcaaccagaggggcgtggatgatgccctgctgagcctgaagacaggcaagctggatgccttcatctatgatgctgctgtgctgaactacatggccggcagagatgagggctgcaagctggtgaccatcggcagcggcaaggtgtttgccagcacaggctacggcatcgccatccagaaggacagcggctggaagaggcaggtggacctggccatcctgcagctgtttggagatggagagatggaggagctggaggccctgtggctgaccggcatctgccacaatgagaagaatgaggtgatgagcagccagctggacatcgacaacatggccggggtcttctacatgctgggcgccgccatggccctgagcctcatcaccttcatctgtgagcacctgttctactggcagttccgccactgcttcatgggcgtgtgcagcggcaagccaggcatggtgttcagcatcagccggggcatctacagctgcatccatggagtggccatcgaggagcggcagagcgtgatgaacagccccacagccaccatgaacaacacccacagcaacatcctgcggctgctgaggacagccaagaacatggccaacctgagcggcgtgaatggcagcccccagagcgccctggacttcatccggcgggagagctctgtgtatgacatcagcgagcaccggcgctccttcacccacagcgactgcaagagctacaacaaccccccctgtgaggagaacctcttcagtgactacatcagcgaggtggagaggaccttcggcaacctgcagctgaaggacagcaatgtgtaccaggaccactaccaccaccaccaccggccccacagcatcggcagcgccagcagcattgatggcctgtatgactgtgacaacccccccttcaccacccagagccgcagcatcagcaagaagcccctggacatcggcctgcccagcagcaagcacagccagctgagtgacctgtatggcaagttctccttcaagagtgaccgctacagcggccatgatgacctgatccgcagtgatgtgtctgacatcagcacccacacagtgacctacggcaacatcgagggcaatgctgccaagaggaggaagcagcagtacaaggacagcctgaagaagaggcctgccagcgccaagagcagaagagaatttgatgaaattgagctggcctacagaagaagaccacccaggagcccagaccacaagcgctacttccgggacaaggagggcctgcgggacttctacctggaccagttccgcaccaaggagaacagcccccactgggagcacgtggacctgacagacatctacaaggagaggagtgatgacttcaagagggacagcgtgtctgggggcggcccctgcaccaacagaagccacatcaagcatggaactggagacaagcatggagtggtgtctggagtgcctgccccctgggagaagaacctgaccaacgtggagtgggaggacagaagtggcggcaacttctgccgcagctgccccagcaagctgcacaactacagcaccaccgtgacaggccagaacagcggccggcaggcctgcatccgctgtgaggcctgcaagaaggccggcaacctgtatgacatcagcgaggacaacagcctgcaggagctggaccagcctgctgcccctgtggccgtgaccagcaatgccagcaccaccaagtacccccagagccccaccaacagcaaggcccagaagaagaacagaaacaagctgcggcggcagcacagctatgacacctttgtggacctgcagaaggaggaggccgccctggcccccaggtctgtgtccctgaaggacaagggccgcttcatggatggcagcccctatgcccacatgtttgagatgtctgctggggagagcacctttgccaacaacaagagctctgtgcccacagctggccaccaccaccacaacaaccctgggggcggctacatgctgagcaagagcctgtacccagacagagtgacccagaaccccttcatccccacctttggagatgaccagtgcctgctgcacggcagcaagagctacttcttccggcagcccaccgtggccggggccagcaaggcccggccagacttccgggccctggtgaccaacaagcctgtggtgtctgccctgcatggagctgtgcctgcccgcttccagaaggacatctgcatcggcaaccagagcaacccctgtgtgcccaacaacaagaacccccgggccttcaacggcagcagcaatggccacgtgtatgagaagctgagcagcattgaaagtgatgtgtag

SEQ ID NO: 153972 - DNA, 3702 bp, Artificial Sequence
  Description of Artificial Sequence: Synthetic coding sequence
atgggcggggccctgggccctgccctgctgctgaccagcctgtttggagcctgggccggcctgggccctggccagggcgagcagggcatgacagtggccgtggtgttcagcagcagcggccccccccaggcccagttccgggcccggctgaccccccagagcttcctggacctgcccctggagatccagcccctgactgtgggcgtgaacaccaccaaccccagcagcctgctgacccagatctgtggcctgctgggcgccgcccacgtgcatggaattgtgtttgaggacaacgtggacacagaagctgtggcccagatcctggacttcatcagcagccagacccacgtgcccatcctgagcatcagcggcggcagcgctgtggtgctgacccccaaggagcccggcagcgccttcctgcagctgggcgtgtccctggagcagcagctgcaggtgctcttcaaggtgctggaggagtatgactggagcgcctttgctgtgatcaccagcctgcaccctggccacgccctcttcctggagggcgtgcgggctgtggctgatgccagccacgtgtcctggaggctgctggatgtggtgaccctggagctgggccctgggggcccccgggcccggacccagaggctgctgcggcagctggatgcccctgtgtttgtggcctactgcagccgggaggaggccgaggtgctgtttgctgaggccgcccaggccggcctggtgggccctggccacgtgtggctggtgcccaacctggccctgggcagcacagatgcccccccagccaccttccctgtgggcctcatctctgtggtgacagagagctggaggctgagcctgcggcagaaggtgagagatggagtggccatcctggccctgggcgcccacagctactggaggcagcacggcaccctgcctgccccagctggggactgccgggtgcaccctggccctgtgtccccagcccgggaggccttctaccgccacctgctgaatgtgacctgggagggccgggacttctccttcagccctgggggctacctggtgcagcccaccatggtggtgattgccctgaacagacaccggctgtgggagatggtgggccgctgggagcacggcgtgctgtacatgaagtaccctgtgtggccccgctacagcgccagcctgcagcctgtggtggacagccgccacctgactgtggccaccctggaggagcggccctttgtgattgtggagagcccagaccccggcactggaggctgtgtgcccaacacagtgccctgccggcggcagagcaaccacaccttcagcagtggagatgtggccccctacaccaagctgtgctgcaagggcttctgcatcgacatcctgaagaagctggcccgggtggtgaagttctcctatgacctgtacctggtgaccaacgggaagcacggcaagagggtgcggggcgtgtggaatggcatgattggagaggtgtactacaagagagctgacatggccatcggcagcctgaccatcaatgaggagaggagtgaaattgtggacttctctgtgccctttgtggagaccggcatctctgtgatggtggcccggagcaatggaacagtgagccccagcgccttcctggagccctacagccctgctgtgtgggtgatgatgtttgtgatgtgcctgactgtggtggccatcaccgtcttcatgtttgagtacttcagccctgtgtcctacaaccagaacctgacccggggcaagaagagcggcggccctgccttcaccatcggcaagtctgtgtggctgctgtgggccctggtgttcaacaacagcgtgcccatcgagaacccccggggcaccaccagcaagatcatggtgctggtgtgggccttctttgctgtgatcttcctggccagctacacagccaacctggccgccttcatgatccaggagcagtacatcgacacagtgtctggcctgagtgacaagaagttccagaggccccaggaccagtacccacccttccgcttcggcaccgtgcccaacggcagcacagagaggaacatccgcagcaactacagagacatgcacacccacatggtgaagttcaaccagaggtctgtggaggatgccctgaccagcctgaagatgggcaagctggatgccttcatctatgatgctgctgtgctgaactacatggccggcaaggatgagggctgcaagctggtgaccatcggcagcggcaaggtgtttgccaccaccggctatggaattgccatgcagaaggacagccactggaagagggccatcgacctggccctgctgcagttcctgggagatggagagacccagaagctggagaccgtgtggctgagcggcatctgccagaatgagaagaatgaggtgatgagcagcaagctggacatcgacaacatggccggggtcttctacatgctgctggtggccatgggcctggccctgctggtgtttgcctgggagcacctggtgtactggaagctgcggcacagcgtgcccaacagcagccagctggacttcctgctggccttcagccggggcatctacagctgcttcagcggcgtgcagagcctggccagccccccccggcaggccagcccagacctgacagccagcagcgcccaggcctctgtgctgaagatgctgcaggccgcccgggacatggtgaccacagctggggtgagcagcagcctggaccgggccaccaggaccatcgagaactggggcggcggcagaagagcccccccacccagcccctgccccacccccaggagcggccccagcccctgcctgcccaccccagaccccccacctgagcccagccccaccggctggggccccccagatggcggccgggccgccctggtgcggcgggccccccagcccccaggccggccccccaccccaggcccccccctgagtgatgtgtcccgggtgtcccggcggcctgcctgggaggcccgctggcctgtgaggacaggccactgcggccgccacctgagcgccagcgagcggcccctgagccctgcccgctgccactacagcagcttccccagggctgacaggagcggccggcccttcctgcccctcttccctgagctggaggacctgcccctgctgggccctgagcagctggcccggcgggaggccctgctgcatgctgcctgggcccggggcagccggcccaggcatgccagcctgcccagctctgtggccgaggcctttgcccggcccagcagcctgcctgctggctgcaccggccctgcctgtgcccggccagatggccacagcgcctgccggcggctggcccaggcccagagcatgtgcctgcccatctaccgggaggcctgccaggagggggagcaggccggggccccagcctggcagcaccggcagcacgtgtgcctgcacgcccacgcccacctgcccttctgctggggcgctgtgtgcccccacctgcccccctgtgccagccacggctcctggctgagcggggcctggggccccctgggccaccggggccgcaccctgggcctgggcaccggctacagagattctgggggcctggatgagatcagccgggtggcccggggcacccagggcttccctggcccctgcacctggaggcgcatcagcagcctggagagcgaggtgtag

SEQ ID NO: 153973 - DNA, 2724 bp, Artificial Sequence
  Description of Artificial Sequence: Synthetic coding sequence
cggggccagggcggggacaccaggagcaagggcacccggcagcctgagcccccaggggccagccgggaccctgcccggagctgctgggacccccctgtggacatgggcggggccctgggccctgccctgctgctgaccagcctgtttggagcctgggccggcctgggccctggccagggcgagcagggcatgacagtggccgtggtgttcagcagcagcggccccccccaggcccagttccgggcccggctgaccccccagagcttcctggacctgcccctggagatccagcccctgactgtgggcgtgaacaccaccaaccccagcagcctgctgacccagatctgtggcctgctgggcgccgcccacgtgcatggaattgtgtttgaggacaacgtggacacagaagctgtggcccagatcctggacttcatcagcagccagacccacgtgcccatcctgagcatcagcggcggcagcgctgtggtgctgacccccaaggagcccggcagcgccttcctgcagctgggcgtgtccctggagcagcagctgcaggtgctcttcaaggtgctggaggagtatgactggagcgcctttgctgtgatcaccagcctgcaccctggccacgccctcttcctggagggcgtgcgggctgtggctgatgccagccacgtgtcctggaggctgctggatgtggtgaccctggagctgggccctgggggcccccgggcccggacccagaggctgctgcggcagctggatgcccctgtgtttgtggcctactgcagccgggaggaggccgaggtgctgtttgctgaggccgcccaggccggcctggtgggccctggccacgtgtggctggtgcccaacctggccctgggcagcacagatgcccccccagccaccttccctgtgggcctcatctctgtggtgacagagagctggaggctgagcctgcggcagaaggtgagagatggagtggccatcctggccctgggcgcccacagctactggaggcagcacggcaccctgcctgccccagctggggactgccgggtgcaccctggccctgtgtccccagcccgggaggccttctaccgccacctgctgaatgtgacctgggagggccgggacttctccttcagccctgggggctacctggtgcagcccaccatggtggtgattgccctgaacagacaccggctgtgggagatggtgggccgctgggagcacggcgtgctgtacatgaagtaccctgtgtggccccgctacagcgccagcctgcagcctgtggtggacagccgccacctgactgtggccaccctggaggagcggccctttgtgattgtggagagcccagaccccggcactggaggctgtgtgcccaacacagtgccctgccggcggcagagcaaccacaccttcagcagtggagatgtggccccctacaccaagctgtgctgcaagggcttctgcatcgacatcctgaagaagctggcccgggtggtgaagttctcctatgacctgtacctggtgaccaacgggaagcacggcaagagggtgcggggcgtgtggaatggcatgattggagaggtgtactacaagagagctgacatggccatcggcagcctgaccatcaatgaggagaggagtgaaattgtggacttctctgtgccctttgtggagaccggcatctctgtgatggtggcccggagcaatggaacagtgagccccagcgccttcctggagccctacagccctgctgtgtgggtgatgatgtttgtgatgtgcctgactgtggtggccatcaccgtcttcatgtttgagtacttcagccctgtgtcctacaaccagaacctgacccggggcaagaagagcggcggccctgccttcaccatcggcaagtctgtgtggctgctgtgggccctggtgttcaacaacagcgtgcccatcgagaacccccggggcaccaccagcaagatcatggtgctggtgtgggccttctttgctgtgatcttcctggccagctacacagccaacctggccgccttcatgatccaggagcagtacatcgacacagtgtctggcctgagtgacaagaagttccagaggccccaggaccagtacccacccttccgcttcggcaccgtgcccaacggcagcacagagaggaacatccgcagcaactacagagacatgcacacccacatggtgaagttcaaccagaggtctgtggaggatgccctgaccagcctgaagatgggcaagctggatgccttcatctatgatgctgctgtgctgaactacatggccggcaaggatgagggctgcaagctggtgaccatcggcagcggcaaggtgtttgccaccaccggctatggaattgccatgcagaaggacagccactggaagagggccatcgacctggccctgctgcagttcctgggagatggagagacccagaagctggagaccgtgtggctgagcggcatctgccagaatgagaagaatgaggtgatgagcagcaagctggacatcgacaacatggccggggtcttctacatgctgctggtggccatgggcctggccctgctggtgtttgcctgggagcacctggtgtactggaagctgcggcacagcgtgcccaacagcagccagctggacttcctgctggccttcagccgggtgggcgcccaccccagcccccaccggcccaagttctag

SEQ ID NO: 153974 - DNA, 4011 bp, Artificial Sequence
  Description of Artificial Sequence: Synthetic coding sequence
atgagaggagctgggggcccccggggcccccggggccctgccaagatgctgctgctgctggccctggcctgtgccagccccttccctgaggaggcccctggccctggaggagctgggggccctgggggcggcctgggcggggcccggcccctgaatgtggccctggtgttcagcggccctgcctatgctgctgaggccgcccggctgggccctgctgtggccgctgctgtgcgcagccctggcctggatgtgcggcctgtggccctggtgctgaatggaagtgaccccaggagcctggtgctgcagctgtgtgacctgctgagcggcctgcgggtgcatggagtggtgtttgaagatgacagccgggccccagctgtggcccccatcctggacttcctgagcgcccagaccagcctgcccatcgtggccgtgcatggaggagctgccctggtgctgacccccaaggagaagggcagcaccttcctgcagctgggcagcagcacagagcagcagctgcaggtgatctttgaggtgctggaggagtatgactggaccagctttgtggccgtgaccacccgggcccctggccaccgggccttcctgagctacatcgaggtgctgacagatggcagcctggtgggctgggagcacagaggagccctgaccctggaccctggagctggggaggccgtgctgagcgcccagctgcggtctgtgtctgcccagatccggctgctcttctgtgcccgggaggaggccgagcctgtgttccgggctgctgaggaggccggcctgaccggcagcggctacgtgtggttcatggtgggcccccagctggccggcggcggcggcagcggggcccctggagagccccccctgctgcctggaggagcccccctgcctgctggcctgtttgctgtgcgctctgctggctggagagatgacctggcccggcgggtggccgccggcgtggccgtggtggcccggggggcccaggccctgctgcgggactatggcttcctgcctgagctgggccatgactgccgggcccagaacagaacccacagaggagagagcctgcaccgctacttcatgaacatcacctgggacaacagagactacagcttcaatgaagatggcttcctggtgaaccccagcctggtggtgatcagcctgacccgggacaggacctgggaggtggtgggctcctgggagcagcagaccctgcggctgaagtaccccctgtggagccgctatggccgcttcctgcagcctgtggatgacacccagcacctgactgtggccaccctggaggagcggcccttcgtcatcgtggagcctgctgaccccatcagcggcacctgcatccgggacagcgtgccctgccgcagccagctgaacagaacccacagccccccaccagatgcccccaggcctgagaagcgctgctgcaagggcttctgcatcgacatcctgaagaggctggcccacaccatcggcttctcctatgacctgtacctggtgaccaacgggaagcacggcaagaagattgatggagtgtggaatggcatgattggagaggtgttctaccagagagctgacatggccatcggcagcctgaccatcaatgaggagaggagtgaaattgtggacttctctgtgccctttgtggagaccggcatctctgtgatggtggcccggagcaatggaacagtgagccccagcgccttcctggagccctacagccctgctgtgtgggtgatgatgtttgtgatgtgcctgactgtggtggccgtgaccgtcttcatctttgagtacctgagccctgtgggctacaacagaagcctggccaccgggaagaggcctgggggcagcaccttcaccatcggcaagagcatctggctgctgtgggccctggtgttcaacaacagcgtgcctgtggagaacccccggggcaccaccagcaagatcatggtgctggtgtgggccttctttgctgtgatcttcctggccagctacacagccaacctggccgccttcatgatccaggaggagtatgtggacacagtgtctggcctgagtgacaggaagttccagaggccccaggagcagtacccacccctgaagtttggcaccgtgcccaacggcagcacagagaagaacatccgcagcaactacccagacatgcacagctacatggtgcgctacaaccagccccgggtggaggaggccctgacccagctgaaggccggcaagctggatgccttcatctatgatgctgctgtgctgaactacatggccaggaaggatgagggctgcaagctggtgaccatcggcagcggcaaggtgtttgccaccaccggctatggaattgccctgcacaagggcagccgctggaagaggcccatcgacctggccctgctgcagttcctgggagatgatgaaattgagatgctggagcggctgtggctgagcggcatctgccacaatgacaagattgaggtgatgagcagcaagctggacatcgacaacatggccggggtcttctacatgctgctggtggccatgggcctgagcctgctggtgtttgcctgggagcacctggtgtactggaggctgcggcactgcctgggccccacccacaggatggacttcctgctggccttcagccggggcatgtacagctgctgcagcgctgaggccgcccctcctccagccaagcccccacctccaccccagcccctgcccagccctgcctacccagcccccaggcctgcccctggccctgccccctttgtgccccgggagcgggcctctgtggaccgctggaggaggaccaagggagctggccccccaggaggagctggcctggctgatggcttccaccgctactacggccccatcgagccccagggcctgggcctgggcctgggggaggcccgggccgcccccagaggagctgctggccggcccctgagccccccagctgcccagcccccccagaagcccccacccagctactttgccatcgtgcgggacaaggagcctgctgagcccccagctggggccttccctggcttccccagccccccagcccctcctgctgctgctgccacagctgtgggcccccccctgtgccgcctggcctttgaagatgagagccccccagccccagcccgctggcccaggagtgaccctgagagccagcccctgctgggccctggggccggcggggccggcggcaccggcggggccggcggcggggccccagctgcccccccaccctgccgggccgcccccccaccctgcccctacctggacctggagcccagccccagcgacagcgaggacagcgagagcctgggcggggccagcctgggcggcctggagccctggtggtttgctgacttcccctacccctatgcagagcggctgggccccccacctggccgctactggagcgtggacaagctgggcggctggagggctggctcctgggactacctgccccccaggagcggccctgctgcctggcactgccgccactgtgccagcctggagctgctgcccccacccaggcacctgagctgcagccatgatggcctggatggcggctggtgggcccctcctcctccaccctgggccgccggccccctgccccggcggcgggcccgctgtggctgccccaggagccacccccaccggccccgggccagccacaggaccccagctgctgctgccccccaccaccaccgccaccggcgggctgctgggggctgggacctgcccccaccagcccccaccagccgcagcctggaggacctgagcagctgccccagggctgccccagcccggcggctgaccggccccagcagacatgcccggcgctgcccccacgccgcccactggggcccccccctgcccacagccagccacagaagacacagaggaggagacctgggcacccggcggggcagcgcccacttcagcagcctggagagcgaggtgtag

SEQ ID NO: 153975 - DNA, 1116 bp, Artificial Sequence
  Description of Artificial Sequence: Synthetic coding sequence
atgagccatgagaagagcttcctggtgtctggggacaactaccccccacccaaccctggctacccaggcggcccccagccccccatgccaccctatgcccagcccccctacccaggggccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgtttcctggccaggaccctgacagcccccagcacggcaactaccaggaggagggcccccccagctactatgacaaccaggacttccctgccaccaactgggatgacaagagcatccggcaggccttcatcaggaaggtgttcctggtgctgaccctgcagctgtctgtgaccctgagcacagtgtctgtgttcacctttgtggccgaggtgaagggctttgtgagagaaaatgtgtggacctactacgtgtcctatgctgtgttcttcatcagcctcatcgtgctgagctgctgcggggacttccggaggaagcacccctggaacctggtggccctgtctgtgctgacagccagcctgagctacatggtgggcatgattgccagcttctacaacacagaagctgtgatcatggctgtgggcatcaccacagctgtgtgcttcaccgtggtgatcttctccatgcagaccaggtatgacttcaccagctgcatgggcgtgctgctggtgtccatggtggtgctcttcatctttgccatcctgtgcatcttcatccggaaccgcatcctggagatcgtgtatgccagcctgggcgccctgctcttcacctgcttcctggccgtggacacccagctgctgctgggcaacaagcagctgagcctgagccctgaggagtatgtgtttgctgccctgaacctgtacacagacatcatcaacatcttcctgtacatcctgaccatcatcggccgggccaaggagtag

SEQ ID NO: 153976 - DNA, 1116 bp, Artificial Sequence; identical to SEQ ID NO: 153975
  Description of Artificial Sequence: Synthetic coding sequence

SEQ ID NO: 153977 - DNA, 825 bp, Artificial Sequence
  Description of Artificial Sequence: Synthetic coding sequence
atgagccatgagaagagcttcctggtgtctggggacaactaccccccacccaaccctggctacccaggcggcccccagccccccatgccaccctatgcccagcccccctacccaggggccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgtttcctggccaggaccctgacagcccccagcacggcaactaccaggaggagggcccccccagctactatgacaaccaggacttccctgccaccaactgggatgacaagagcatccggcaggccttcatcaggaaggtgttcctggtgctgaccctgcagctgtctgtgaccctgagcacagtgtctgtgttcacctttgtggccgaggtgaagggctttgtgagagaaaatgtgtggacctactacgtgtcctatgctgtgttcttcatcagcctcatcgtgctgagctgctgcggggacttccggaggaagcacccctggaacctggtggccctgtctgtgctgacagccagcctgagctacatggtgggcatgattgccagcttctacaacacagaagctgtgatcatggctgtgggcatcaccacagctgtgtgcttcaccgtggtgatcttctccatgcagtag

SEQ ID NO: 153978 - DNA, 306 bp, Artificial Sequence
  Description of Artificial Sequence: Synthetic coding sequence
atgagccatgagaagagcttcctggtgtctggggacaactaccccccacccaaccctggctacccaggcggcccccagccccccatgccaccctatgcccagcccccctacccaggggccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagtag

SEQ ID NO: 153979 - DNA, 1059 bp, Artificial Sequence
  Description of Artificial Sequence: Synthetic coding sequence
atgagccatgagaagagcttcctggtgtctggggacaactaccccccaccctacccaggggccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgtttcctggccaggaccctgacagcccccagcacggcaactaccaggaggagggccccccatcctactatgacaaccaggacttccctgccaccaactgggatgacaagagcatccggcaggccttcatcaggaaggtgttcctggtgctgaccctgcagctgtctgtgaccctgagcacagtgtctgtgttcacctttgtggccgaggtgaagggctttgtgcgggagaatgtgtggacctactacgtgtcctatgctgtgttcttcatcagcctgattgtgctgagctgctgcggggacttccggaggaagcacccctggaacctggtggccctgtctgtgctgacagccagcctgagctacatggtgggcatgattgccagcttctacaacacagaggccgtcatcatggctgtgggcatcaccacagctgtgtgcttcaccgtggtgatcttctccatgcagaccaggtatgacttcaccagctgcatgggcgtgctgctggtgtccatggtggtgctcttcatctttgccatcctgtgcatcttcatccggaaccgcatcctggagatcgtgtatgccagcctgggcgccctgctcttcacctgcttcctggccgtggacacccagctgctgctgggcaacaagcagctgagcctgagccctgaggagtatgtgtttgctgccctgaacctgtacacagacatcatcaacatcttcctgtacatcctgaccatcatcggccgggccaaggagtag

SEQ ID NO: 153980 - DNA, 3348 bp, Artificial Sequence
  Description of Artificial Sequence: Synthetic coding sequence
atgaggcggctgagcctgtggtggctgctgagccgggtgtgcctgctgctgcccccaccctgtgccctggtgctggccggcgtgcccagcagcagcagccacccccagccctgccagatcctgaagagaattggacatgctgtgcgggtgggcgctgtgcacctgcagccctggaccacagccccccgggccgccagccgggccccagatgacagccgggccggggcccagagagatgagcctgagcccggcacccggcgcagccctgcccccagccctggggcccgctggctgggcagcaccctgcacggccggggccccccaggcagcaggaagccaggagagggcgcccgggcagaggccctgtggcccagagatgccctgctgtttgctgtggacaacctgaacagagtggagggcctgctgccctacaacctgagcctggaggtggtgatggccatcgaggccggcctgggggacctgcccctgctgcccttcagcagccccagcagcccctggagcagtgaccccttctccttcctgcagagcgtgtgccacacagtggtggtgcagggcgtgtctgccctgctggccttcccccagagccagggcgagatgatggagctggacctggtgtccctggtgctgcacatccctgtgatcagcatcgtgagacatgagttcccccgggagagccagaaccccctgcacctgcagctgagcctggagaacagcctgagcagtgatgctgatgtgacagtgtccatcctgaccatgaacaactggtacaacttcagcctgctgctgtgccaggaggactggaacatcacagacttcctgctgctgacccagaacaacagcaagttccacctgggcagcatcatcaacatcacagccaacctgcccagcacccaggacctgctgtccttcctgcagatccagctggagagcatcaagaacagcacccccaccgtggtgatgtttggctgtgacatggagagcatccgccgcatctttgagatcaccacccagtttggagtgatgcctcctgagctgcgctgggtgctgggggacagccagaatgtggaggagctgaggacagagggcctgcccctgggcctgattgcccacggcaagaccacccagagcgtgtttgagcactacgtgcaggatgccatggagctggtggcccgggctgtggccacagccaccatgatccagcctgagctggccctgatccccagcaccatgaactgcatggaggtggagaccaccaacctgaccagcggccagtacctgagccgcttcctggccaacaccaccttccggggcctgagcggcagcatccgggtgaagggcagcaccatcgtgtcctctgagaacaacttcttcatctggaacctgcagcacgaccccatgggcaagcccatgtggacccggctgggctcctggcagggcggcaagatcgtgatggactatggcatctggccagagcaggcccagaggcacaagacccacttccagcaccccagcaagctgcacctgcgggtggtgaccctgattgagcacccctttgtgttcacccgggaggtggatgatgagggcctgtgcccagctggccagctgtgcctggaccccatgaccaatgacagcagcaccctggacagcctcttcagcagcctgcacagcagcaatgacacagtgcccatcaagttcaagaagtgctgctacggctactgcatcgacctgctggagaagattgctgaggacatgaactttgattttgacctgtacatcgtgggagatggcaagtatggagcctggaagaatggccactggacaggcctggtgggggacctgctgcggggcacagcccacatggctgtgaccagcttcagcatcaacacagcccggagccaggtgattgacttcaccagccccttcttcagcaccagcctgggcatcctggtgaggacccgggacacagctgcccccatcggggccttcatgtggcccctgcactggaccatgtggctgggcatctttgtggccctgcacatcacagctgtgttcctgaccctgtatgagtggaagagccccttcggcctgacccccaagggcaggaacagaagcaaggtgttctccttcagcagcgccctgaacatctgctacgccctgctgtttggccgcacagtggccatcaagccacccaagtgctggacaggccgcttcctgatgaacctgtgggccatcttctgcatgttctgcctgagcacctacacagccaacctggccgctgtgatggtgggggagaagatctatgaggagctgagcggcatccatgaccccaagctgcaccaccccagccagggcttccgcttcggcaccgtgcgggagagcagcgcagaagattatgtgcggcagagcttccctgagatgcatgagtacatgaggcgctacaacgtgcctgccaccccagatggagtggagtacctgaagaatgaccctgagaagctggatgccttcatcatggacaaggccctgctggactatgaggtgtccattgatgctgactgcaagctgctgactgtgggcaagccctttgccatcgagggctatggaattggcctgccccccaacagccccctgacagccaacatcagcgagctgatcagccagtacaagagccacggcttcatggacatgctgcatgacaagtggtacagagtggtgccctgtgggaagaggagctttgctgtgacagagaccctgcagatgggcatcaagcacttcagcggcctgtttgtgctgctgtgcatcggcttcggcctgagcatcctgaccaccatcggggagcacatcgtgtaccgcctgctgctgccccgcatcaagaacaagagcaagctgcagtactggctgcacaccagccagaggctgcaccgggccatcaacaccagcttcatcgaggagaagcagcagcacttcaagaccaagagggtggagaagaggagcaatgtgggcccccggcagctgactgtgtggaacaccagcaacctgagccatgacaacagaaggaagtacatcttcagtgatgaggagggccagaaccagctgggcatccgcatccaccaggacatccccctgcccccaagaagaagagagctgcctgccctgcggaccaccaacgggaaggctgacagcctgaatgtgtccaggaacagcgtgatgcaggagctgtctgagctggagaagcagatccaggtgatccggcaggagctgcagctggccgtgtccaggaagacagagctggaggagtaccagaggaccagcaggacctgtgagagctag

SEQ ID NO: 153981 - DNA, 3585 bp, Artificial Sequence
  Description of Artificial Sequence: Synthetic coding sequence
atggtgggcctgctgctcttcttcttccctgccatcttcctggaggtgtccctgctgcccaggagccctggcaggaaggtgctgctggccggggccagcagccagaggtctgtggccaggatggatggagatgtgatcattggagccctcttctctgtgcaccaccagcccccagctgagaaggtgcctgagaggaaatgtggggagatccgggagcagtatggcatccagagggtggaggccatgttccacaccctggacaagatcaatgctgaccctgtgctgctgcccaacatcaccctgggcagcgagatccgggacagctgctggcacagctctgtggccctggagcagagcattgagttcatccgggacagcctcatcagcatcagagatgagaaggatggcatcaaccgctgcctgcctgatggccagagcctgcccccaggccgcaccaagaagcccatcgccggggtcatcggccctggcagcagctctgtggccatccaggtgcagaacctgctgcagctgtttgacatcccccagatcgcctacagcgccaccagcattgacctgagtgacaagaccctgtacaagtacttcctgcgggtggtgcccagcgacaccctgcaggcccgggccatgctggacatcgtgaagcgctacaactggacctacgtgtctgctgtgcacacagagggcaactacggggagagcggcatggatgccttcaaggagctggccgcccaggagggcctgtgcatcgcccacagcgacaagatctacagcaatgctggggagaagagctttgaccggctgctgaggaagctgcgggagcggctgcccaaggcccgggtggtggtgtgcttctgtgagggcatgacagtgcggggcctgctgagcgccatgaggcggctgggcgtggtgggggagttcagcctgattggaagtgatggctgggccgacagagatgaggtgattgagggctatgaggtggaggccaatggaggcatcaccatcaagctgcagagccctgaggtgcgcagctttgatgactacttcctgaagctgcggctggacaccaacaccaggaacccctggttccctgagttctggcagcaccgcttccagtgccgcctgcccggccacctgctggagaaccccaacttcaagaggatctgcacaggaaatgaaagcctggaggagaactacgtgcaggacagcaagatgggcttcgtcatcaatgccatctatgccatggcccacggcctgcagaacatgcaccacgccctgtgccccggccacgtgggcctgtgtgatgccatgaagcccattgatggcagcaagctgctggacttcctgatcaagagcagcttcatcggcgtgtctggagaggaggtgtggtttgatgagaagggagatgcccctggccgctatgacatcatgaacctgcagtacacagaggccaacagatatgactatgtgcacgtgggcacctggcatgaaggagtgctgaacattgatgactacaagatccagatgaacaagtctggagtggtgcgctctgtgtgcagcgagccctgcctgaagggccagatcaaggtgatcaggaagggggaggtgtcctgctgctggatctgcacagcctgcaaggaaaatgaatatgtgcaggatgagttcacctgcaaggcctgtgacctgggctggtggcccaatgctgacctgaccggctgtgagcccatccctgtgcgctacctggagtggagcaacatcgagagcatcatcgccatcgccttcagctgcctgggcatcctggtgaccctgtttgtgaccctcatctttgtgctgtacagagacacccctgtggtgaagagcagcagccgggagctgtgctacatcatcctggccggcatcttcctgggctacgtgtgccccttcaccctgattgccaagcccaccaccaccagctgctacctgcagaggctgctggtgggcctgagcagcgccatgtgctacagcgccctggtgaccaagaccaaccgcatcgcccgcatcctggccggcagcaagaagaagatctgcaccaggaagccccgcttcatgtctgcctgggcccaggtgatcatcgccagcatcctgatctctgtgcagctgaccctggtggtgaccctcatcatcatggagccccccatgcccatcctgagctaccccagcatcaaggaggtgtacctgatctgcaacaccagcaacctgggcgtggtggcccccctgggctacaacggcctgctgatcatgagctgcacctactatgccttcaagaccagaaatgtgcctgccaacttcaatgaggccaagtacatcgccttcaccatgtacaccacctgcatcatctggctggcctttgtgcccatctacttcggcagcaactacaagatcatcaccacctgctttgctgtgtccctgtctgtgacagtggccctgggctgcatgttcacccccaagatgtacatcatcatcgccaagccagagagaaatgtgcgcagcgccttcaccaccagtgatgtggtgaggatgcacgtgggagatggcaagctgccctgccgcagcaacaccttcctgaacatcttccggaggaagaaggccggggctggaaatgccaacagcaatggcaagtctgtgtcctggagcgagcccggcggcggccaggtgcccaagggccagcacatgtggcaccggctgtctgtgcacgtgaagaccaatgaaacagcctgcaaccagacagctgtgatcaagcccctgaccaagagctaccagggcagcggcaagagcctgaccttcagtgacaccagcaccaagaccctgtacaacgtggaggaggaggaggatgcccagcccatccgcttcagccccccaggcagccccagcatggtggtgcaccggcgggtgcccagcgctgccaccaccccacccctgcccagccacctgacagctgaggagacccccctcttcctggccgagcccgccctgcccaagggcctgcccccacccctgcagcagcagcagcagcccccaccccagcagaagagcctgatggaccagctgcagggcgtggtgagcaacttcagcacagccatcccagacttccacgctgtgctggccggccctgggggccctggaaatggcctgcggagcctgtacccacctcctcctccaccccagcacctgcagatgctgcccctgcagctgagcacctttggagaggagctggtgagccccccagcagatgatgatgatgacagcgagcgcttcaagctgctgcaggagtatgtgtatgaacatgagcgggagggcaacacagaagaagatgagctggaggaggaggaggaggacctgcaggccgccagcaagctgaccccagatgacagccctgccctgaccccacccagccccttccgggacagcgtggccagcggcagctctgtgcccagcagccctgtgtctgagagcgtgctgtgcaccccacccaacgtgtcctatgccagcgtcatcctgcgggactacaagcagagcagcagcaccctgtag

SEQ ID NO: 153982 - DNA, 3585 bp, Artificial Sequence; identical to SEQ ID NO: 153981
  Description of Artificial Sequence: Synthetic coding sequence

SEQ ID NO: 153983 - DNA, 2721 bp, Artificial Sequence
  Description of Artificial Sequence: Synthetic coding sequence
atggtgggcctgctgctcttcttcttccctgccatcttcctggaggtgtccctgctgcccaggagccctggcaggaaggtgctgctggccggggccagcagccagaggtctgtggccaggatggatggagatgtgatcattggagccctcttctctgtgcaccaccagcccccagctgagaaggtgcctgagaggaaatgtggggagatccgggagcagtatggcatccagagggtggaggccatgttccacaccctggacaagatcaatgctgaccctgtgctgctgcccaacatcaccctgggcagcgagatccgggacagctgctggcacagctctgtggccctggagcagagcattgagttcatccgggacagcctcatcagcatcagagatgagaaggatggcatcaaccgctgcctgcctgatggccagagcctgcccccaggccgcaccaagaagcccatcgccggggtcatcggccctggcagcagctctgtggccatccaggtgcagaacctgctgcagctgtttgacatcccccagatcgcctacagcgccaccagcattgacctgagtgacaagaccctgtacaagtacttcctgcgggtggtgcccagcgacaccctgcaggcccgggccatgctggacatcgtgaagcgctacaactggacctacgtgtctgctgtgcacacagagggcaactacggggagagcggcatggatgccttcaaggagctggccgcccaggagggcctgtgcatcgcccacagcgacaagatctacagcaatgctggggagaagagctttgaccggctgctgaggaagctgcgggagcggctgcccaaggcccgggtggtggtgtgcttctgtgagggcatgacagtgcggggcctgctgagcgccatgaggcggctgggcgtggtgggggagttcagcctgattggaagtgatggctgggccgacagagatgaggtgattgagggctatgaggtggaggccaatggaggcatcaccatcaagctgcagagccctgaggtgcgcagctttgatgactacttcctgaagctgcggctggacaccaacaccaggaacccctggttccctgagttctggcagcaccgcttccagtgccgcctgcccggccacctgctggagaaccccaacttcaagaggatctgcacaggaaatgaaagcctggaggagaactacgtgcaggacagcaagatgggcttcgtcatcaatgccatctatgccatggcccacggcctgcagaacatgcaccacgccctgtgccccggccacgtgggcctgtgtgatgccatgaagcccattgatggcagcaagctgctggacttcctgatcaagagcagcttcatcggcgtgtctggagaggaggtgtggtttgatgagaagggagatgcccctggccgctatgacatcatgaacctgcagtacacagaggccaacagatatgactatgtgcacgtgggcacctggcatgaaggagtgctgaacattgatgactacaagatccagatgaacaagtctggagtggtgcgctctgtgtgcagcgagccctgcctgaagggccagatcaaggtgatcaggaagggggaggtgtcctgctgctggatctgcacagcctgcaaggaaaatgaatatgtgcaggatgagttcacctgcaaggcctgtgacctgggctggtggcccaatgctgacctgaccggctgtgagcccatccctgtgcgctacctggagtggagcaacatcgagagcatcatcgccatcgccttcagctgcctgggcatcctggtgaccctgtttgtgaccctcatctttgtgctgtacagagacacccctgtggtgaagagcagcagccgggagctgtgctacatcatcctggccggcatcttcctgggctacgtgtgccccttcaccctgattgccaagcccaccaccaccagctgctacctgcagaggctgctggtgggcctgagcagcgccatgtgctacagcgccctggtgaccaagaccaaccgcatcgcccgcatcctggccggcagcaagaagaagatctgcaccaggaagccccgcttcatgtctgcctgggcccaggtgatcatcgccagcatcctgatctctgtgcagctgaccctggtggtgaccctcatcatcatggagccccccatgcccatcctgagctaccccagcatcaaggaggtgtacctgatctgcaacaccagcaacctgggcgtggtggcccccctgggctacaacggcctgctgatcatgagctgcacctactatgccttcaagaccagaaatgtgcctgccaacttcaatgaggccaagtacatcgccttcaccatgtacaccacctgcatcatctggctggcctttgtgcccatctacttcggcagcaactacaagatcatcaccacctgctttgctgtgtccctgtctgtgacagtggccctgggctgcatgttcacccccaagatgtacatcatcatcgccaagccagagagaaatgtgcgcagcgccttcaccaccagtgatgtggtgaggatgcacgtgggagatggcaagctgccctgccgcagcaacaccttcctgaacatcttccggaggaagaaggccggggctggaaatgccaagaagaggcagcctgagttcagccccaccagccagtgccccagcgcccacgtgcagctgtag

SEQ ID NO: 153984 - DNA, 2721 bp, Artificial Sequence; identical to SEQ ID NO: 153983
  Description of Artificial Sequence: Synthetic coding sequence

SEQ ID NO: 153985 - DNA, 2721 bp, Artificial Sequence; identical to SEQ ID NO: 153983
  Description of Artificial Sequence: Synthetic coding sequence

SEQ ID NO: 153986 - DNA, 2619 bp, Artificial Sequence
  Description of Artificial Sequence: Synthetic coding sequence
atgggcagcctgctggccctgctggccctgctgctgctgtggggcgctgtggccgagggccctgccaagaaggtgctgaccctggagggggacctggtgctgggcggcctcttccctgtgcaccagaagggcggccctgctgaggactgtggccctgtgaatgagcaccggggcatccagaggctggaggccatgctgtttgccctggaccgcatcaacagagacccccacctgctgcccggggtgcggctgggcgcccacatcctggacagctgcagcaaggacacccacgccctggagcaggccctggactttgtgcgggccagcctgagcagaggagcagatggcagccgccacatctgcccagatggcagctatgccacccatggagatgcccccacagccatcactggagtcatcggcggcagctacagtgatgtgtccatccaggtggccaacctgctgcggctcttccagatcccccagatctcctatgccagcaccagcgccaagctgagtgacaagagccgctatgactactttgccaggacagtgcccccagacttcttccaggccaaggccatggccgagatcctgcgcttcttcaactggacctacgtgtccacagtggccagcgagggggactatggagaaacaggaattgaggcctttgagctggaggcccgggccaggaacatctgtgtggccaccagcgagaaggtgggccgggccatgagccgggccgcctttgagggcgtggtgcgggccctgctgcagaagcccagcgcccgggtggccgtgctcttcaccaggagtgaagatgcccgggagctgctggccgccagccagaggctgaatgccagcttcacctgggtggccagtgatggctggggcgccctggagagcgtggtggccggcagcgagggcgctgctgagggcgccatcaccatcgagctggccagctaccccatcagtgactttgccagctacttccagagcctggacccctggaacaacagcaggaacccctggttccgggagttctgggagcagcgcttccgctgcagcttccggcagagggactgtgccgcccacagcctgcgggctgtgccctttgagcaggagagcaagatcatgtttgtggtgaatgctgtgtatgccatggcccacgccctgcacaacatgcaccgggccctgtgccccaacaccacccggctgtgtgatgccatgaggcctgtgaatggccggcggctgtacaaggactttgtgctgaatgtgaagtttgatgcccccttccggcctgctgacacccacaatgaggtgcgctttgacagatttggagatggcatcggccgctacaacatcttcacctacctgcgggccggcagcggccgctaccgctaccagaaggtgggctactgggccgagggcctgaccctggacaccagcctcatcccctgggccagccccagcgctggccccctgcctgccagccgctgcagcgagccctgcctgcagaatgaggtgaagtctgtgcagcccggggaggtgtgctgctggctgtgcatcccctgccagccctatgagtaccgcctggatgagttcacctgtgccgactgtggcctgggctactggcccaatgccagcctgaccggctgctttgagctgccccaggagtacatccgctggggagatgcctgggccgtgggccctgtgaccatcgcctgcctgggcgccctggccaccctgtttgtgctgggcgtgtttgtgcgccacaatgccacccctgtggtgaaggccagcggccgggagctgtgctacatcctgctgggcggcgtcttcctgtgctactgcatgaccttcatcttcatcgccaagcccagcacagctgtgtgcaccctgcggcggctgggcctgggcacagccttctctgtgtgctacagcgccctgctgaccaagaccaacagaattgcccgcatctttggaggagcccgggagggcgcccagaggccccgcttcatcagccctgccagccaggtggccatctgcctggccctgatcagcggccagctgctgattgtggtggcctggctggtggtggaggcccctggcaccgggaaggagacagcccctgagcggcgggaggtggtgaccctgcgctgcaaccacagagatgcctccatgctgggcagcctggcctacaacgtgctgctgattgccctgtgcaccctgtatgccttcaagaccaggaaatgtcctgagaacttcaatgaggccaagttcatcggcttcaccatgtacaccacctgcatcatctggctggccttcctgcccatcttctacgtgaccagcagtgactacagagtgcagaccaccaccatgtgtgtgtctgtgtccctgagcggctctgtggtgctgggctgcctgtttgcccccaagctgcacatcatcctcttccagccccagaagaatgtggtgagccaccgggcccccaccagcagatttggatctgctgctgcccgggccagcagcagcctgggccagggcagcggcagccagtttgtgcccaccgtgtgcaatggccgggaggtggtggacagcaccaccagcagcctgtag

SEQ ID NO: 153987 - DNA, 213 bp, Artificial Sequence
  Description of Artificial Sequence: Synthetic coding sequence
atgggcagcctgctggccctgctggccctgctgctgctgtggggcgctgtggccgagggccctgccaagaaggtgctgaccctggagggggacctggtgctgggcggcctcttccctgtgcaccagaagggcggccctgctgaggactgtggccctgtgaatgagcaccggggcatccagaggctggaggccatgctgtttgccctggactag

SEQ ID NO: 153988 - DNA, 2640 bp, Artificial Sequence
  Description of Artificial Sequence: Synthetic coding sequence
atgaagatgctgacccggctgcaggtgctgaccctggccctcttcagcaagggcttcctgctgagcctgggggaccacaacttcctgcggcgggagatcaagattgaaggagacctggtgctgggcggcctcttccccatcaatgagaagggcaccggcacagaggagtgtggccgcatcaatgaagatcggggcatccagaggctggaggccatgctgtttgccattgatgagatcaacaaggatgactacctgctgcccggggtgaagctgggcgtgcacatcctggacacctgcagccgggacacctacgccctggagcagagcctggagtttgtgcgggccagcctgaccaaggtggatgaagctgagtacatgtgcccagatggcagctatgccatccaggagaacatccccctgctgattgctggggtcatcggcggcagctacagctctgtgtccatccaggtggccaacctgctgcggctcttccagatcccccagatctcctatgccagcaccagcgccaagctgagtgacaagagccgctatgactactttgccaggacagtgcccccagacttctaccaggccaaggccatggccgagatcctgcgcttcttcaactggacctacgtgtccacagtggccagcgagggggactatggagaaacaggaattgaggcctttgagcaggaggcccggctgaggaacatctgcatcgccacagctgagaaggtgggccgcagcaacatcaggaagagctatgacagcgtcatccgggagctgctgcagaagcccaatgcccgggtggtggtgctcttcatgagaagtgatgacagccgggagctgattgctgctgccagccgggccaatgccagcttcacctgggtggccagtgatggctggggcgcccaggagagcatcatcaagggcagcgagcacgtggcctacggggccatcaccctggagctggccagccagcctgtgcggcagtttgaccgctacttccagagcctgaacccctacaacaaccacaggaacccctggttccgggacttctgggagcagaagttccagtgcagcctgcagaacaagaggaaccaccggcgggtgtgtgacaagcacctggccatcgacagcagcaactatgagcaggagagcaagatcatgtttgtggtgaatgctgtgtatgccatggcccacgccctgcacaagatgcagaggaccctgtgccccaacaccaccaagctgtgtgatgccatgaagatcctggatggcaagaagctgtacaaggactacctgctgaagatcaacttcaccgcccccttcaaccccaacaaggatgctgacagcatcgtgaagtttgacacctttggagatggcatgggccgctacaacgtgttcaacttccagaatgtgggcggcaagtacagctacctgaaggtgggccactgggccgagaccctgagcctggatgtgaacagcatccactggagcagaaattctgtgcccaccagccagtgcagcgacccctgtgccccaaatgagatgaagaacatgcagcctggagatgtgtgctgctggatctgcatcccctgtgagccctatgagtacctggctgatgagttcacctgcatggactgtggcagcggccagtggcccacagctgacctgaccggctgctatgacctgcctgaggactacatccgctgggaggatgcctgggccatcggccctgtgaccatcgcctgcctgggcttcatgtgcacctgcatggtggtgaccgtcttcatcaagcacaacaacacccccctggtgaaggccagcggccgggagctgtgctacatcctgctgtttggagtgggcctgagctactgcatgaccttcttcttcatcgccaagcccagccctgtgatctgtgccctgcggcggctgggcctgggcagcagctttgccatctgctacagcgccctgctgaccaagaccaactgcatcgcccgcatctttgatggagtgaagaatggagcccagaggcccaagttcatcagccccagcagccaggtgttcatctgcctgggcctcatcctggtgcagatcgtgatggtgtctgtgtggctgatcctggaggcccctggcacccggcgctacaccctggccgagaagcgggagaccgtcatcctgaagtgcaatgtgaaggacagctccatgctgatcagcctgacctatgatgtgatcctggtgatcctgtgcaccgtgtatgccttcaagaccaggaagtgcccagagaacttcaatgaggccaagttcatcggcttcaccatgtacaccacctgcatcatctggctggccttcctgcccatcttctacgtgaccagcagtgactacagagtgcagaccaccaccatgtgcatctctgtgtccctgagcggctttgtggtgctgggctgcctgtttgcccccaaggtgcacatcatcctcttccagccccagaagaatgtggtgacccaccggctgcacctgaaccgcttctctgtgtctggaacaggcaccacctacagccagagcagcgccagcacctacgtgcccaccgtgtgcaatggccgggaggtgctggacagcaccaccagcagcctgtag

SEQ ID NO: 153989 - DNA, 1608 bp, Artificial Sequence
  Description of Artificial Sequence: Synthetic coding sequence
atgctgacccggctgcaggtgctgaccctggccctcttcagcaagggcttcctgctgagcctgggggaccacaacttcctgcggcgggagatcaagattgaaggagacctggtgctgggcggcctcttccccatcaatgagaagggcaccggcacagaggagtgtggccgcatcaatgaagatcggggcatccagaggctggaggccatgctgtttgccattgatgagatcaacaaggatgactacctgctgcccggggtgaagctgggcgtgcacatcctggacacctgcagccgggacacctacgccctggagcagagcctggagtttgtgcgggccagcctgaccaaggtggatgaagctgagtacatgtgcccagatggcagctatgccatccaggagaacatccccctgctgattgctggggtcatcggcggcagctacagctctgtgtccatccaggtggccaacctgctgcggctcttccagatcccccagatctcctatgccagcaccagcgccaagctgagtgacaagagccgctatgactactttgccaggacagtgcccccagacttctaccaggccaaggccatggccgagatcctgcgcttcttcaactggacctacgtgtccacagtggccagcgagggggactatggagaaacaggaattgaggcctttgagcaggaggcccggctgaggaacatctgcatcgccacagctgagaaggtgggccgcagcaacatcaggaagagctatgacagcgtcatccgggagctgctgcagaagcccaatgcccgggtggtggtgctcttcatgagaagtgatgacagccgggagctgattgctgctgccagccgggccaatgccagcttcacctgggtggccagtgatggctggggcgcccaggagagcatcatcaagggcagcgagcacgtggcctacggggccatcaccctggagctggccagccagcctgtgcggcagtttgaccgctacttccagagcctgaacccctacaacaaccacaggaacccctggttccgggacttctgggagcagaagttccagtgcagcctgcagaacaagaggaaccaccggcgggtgtgtgacaagcacctggccatcgacagcagcaactatgagcaggagagcaagatcatgtttgtggtgaatgctgtgtatgccatggcccacgccctgcacaagatgcagaggaccctgtgccccaacaccaccaagctgtgtgatgccatgaagatcctggatggcaagaagctgtacaaggactacctgctgaagatcaacttcaccggggctgatgacaaccacgtgcacctgtgccagcctgagtggctgtgtggcctgggcctgtttgtgtgcacccagggcagccaccaccctgtgtccaccccagaggagtgctgccacacccagacagccccccagcaggtgcagtgccagtggaactgggaccacatcctgtctgtgctgtgcaagcacgtgtgtgccaacggggtgcagtgggccggcagcccccggctgcaccacctgatctctgtgattgtgaactgcagctctgtgctggtgttcctggactgctag

SEQ ID NO: 153990 - DNA, 264 bp, Artificial Sequence
  Description of Artificial Sequence: Synthetic coding sequence
atgaagatgctgacccggctgcaggtgctgaccctggccctcttcagcaagggcttcctgctgagcctgggggaccacaacttcctgcggcgggagatcaagattgaaggagacctggtgctgggcggcctcttccccatcaatgagaagggcaccggcacagaggagtgtggccgcatcaatgaagatcggggcatccagaggctggaggccatgctgtttgccattgatgagatcaacaaggatgactacctgctgccctag

SEQ ID NO: 153991 - DNA, 1614 bp, Artificial Sequence
  Description of Artificial Sequence: Synthetic coding sequence
atgaagatgctgacccggctgcaggtgctgaccctggccctcttcagcaagggcttcctgctgagcctgggggaccacaacttcctgcggcgggagatcaagattgaaggagacctggtgctgggcggcctcttccccatcaatgagaagggcaccggcacagaggagtgtggccgcatcaatgaagatcggggcatccagaggctggaggccatgctgtttgccattgatgagatcaacaaggatgactacctgctgcccggggtgaagctgggcgtgcacatcctggacacctgcagccgggacacctacgccctggagcagagcctggagtttgtgcgggccagcctgaccaaggtggatgaagctgagtacatgtgcccagatggcagctatgccatccaggagaacatccccctgctgattgctggggtcatcggcggcagctacagctctgtgtccatccaggtggccaacctgctgcggctcttccagatcccccagatctcctatgccagcaccagcgccaagctgagtgacaagagccgctatgactactttgccaggacagtgcccccagacttctaccaggccaaggccatggccgagatcctgcgcttcttcaactggacctacgtgtccacagtggccagcgagggggactatggagaaacaggaattgaggcctttgagcaggaggcccggctgaggaacatctgcatcgccacagctgagaaggtgggccgcagcaacatcaggaagagctatgacagcgtcatccgggagctgctgcagaagcccaatgcccgggtggtggtgctcttcatgagaagtgatgacagccgggagctgattgctgctgccagccgggccaatgccagcttcacctgggtggccagtgatggctggggcgcccaggagagcatcatcaagggcagcgagcacgtggcctacggggccatcaccctggagctggccagccagcctgtgcggcagtttgaccgctacttccagagcctgaacccctacaacaaccacaggaacccctggttccgggacttctgggagcagaagttccagtgcagcctgcagaacaagaggaaccaccggcgggtgtgtgacaagcacctggccatcgacagcagcaactatgagcaggagagcaagatcatgtttgtggtgaatgctgtgtatgccatggcccacgccctgcacaagatgcagaggaccctgtgccccaacaccaccaagctgtgtgatgccatgaagatcctggatggcaagaagctgtacaaggactacctgctgaagatcaacttcaccggggctgatgacaaccacgtgcacctgtgccagcctgagtggctgtgtggcctgggcctgtttgtgtgcacccagggcagccaccaccctgtgtccaccccagaggagtgctgccacacccagacagccccccagcaggtgcagtgccagtggaactgggaccacatcctgtctgtgctgtgcaagcacgtgtgtgccaacggggtgcagtgggccggcagcccccggctgcaccacctgatctctgtgattgtgaactgcagctctgtgctggtgttcctggactgctag

SEQ ID NO: 153992 - DNA, 246 bp, Artificial Sequence
  Description of Artificial Sequence: Synthetic coding sequence
atgaagatgctgacccggctgcaggtgctgaccctggccctcttcagcaagggcttcctgctgagcctgggggaccacaacttcctgcggcgggagatcaagattgaaggagacctggtgctgggcggcctcttccccatcaatgagaagggcaccggcacagaggagtgtggccgcatcaatgaagatcggggcatccagaggctggaggccatgctgtttgccattgatgagatcaacaagtag

SEQ ID NO: 153993 - DNA, 2256 bp, Artificial Sequence
  Description of Artificial Sequence: Synthetic coding sequence
atgagccagagccctggagctggcagccccccacccctgccccccaggtctgcccctgtgcctgcccggagctgccgctgtgaggtggccaacctgctgcggctcttccagatcccccagatctcctatgccagcaccagcgccaagctgagtgacaagagccgctatgactactttgccaggacagtgcccccagacttctaccaggccaaggccatggccgagatcctgcgcttcttcaactggacctacgtgtccacagtggccagcgagggggactatggagaaacaggaattgaggcctttgagcaggaggcccggctgaggaacatctgcatcgccacagctgagaaggtgggccgcagcaacatcaggaagagctatgacagcgtcatccgggagctgctgcagaagcccaatgcccgggtggtggtgctcttcatgagaagtgatgacagccgggagctgattgctgctgccagccgggccaatgccagcttcacctgggtggccagtgatggctggggcgcccaggagagcatcatcaagggcagcgagcacgtggcctacggggccatcaccctggagctggccagccagcctgtgcggcagtttgaccgctacttccagagcctgaacccctacaacaaccacaggaacccctggttccgggacttctgggagcagaagttccagtgcagcctgcagaacaagaggaaccaccggcgggtgtgtgacaagcacctggccatcgacagcagcaactatgagcaggagagcaagatcatgtttgtggtgaatgctgtgtatgccatggcccacgccctgcacaagatgcagaggaccctgtgccccaacaccaccaagctgtgtgatgccatgaagatcctggatggcaagaagctgtacaaggactacctgctgaagatcaacttcaccgcccccttcaaccccaacaaggatgctgacagcatcgtgaagtttgacacctttggagatggcatgggccgctacaacgtgttcaacttccagaatgtgggcggcaagtacagctacctgaaggtgggccactgggccgagaccctgagcctggatgtgaacagcatccactggagcagaaattctgtgcccaccagccagtgcagcgacccctgtgccccaaatgagatgaagaacatgcagcctggagatgtgtgctgctggatctgcatcccctgtgagccctatgagtacctggctgatgagttcacctgcatggactgtggcagcggccagtggcccacagctgacctgaccggctgctatgacctgcctgaggactacatccgctgggaggatgcctgggccatcggccctgtgaccatcgcctgcctgggcttcatgtgcacctgcatggtggtgaccgtcttcatcaagcacaacaacacccccctggtgaaggccagcggccgggagctgtgctacatcctgctgtttggagtgggcctgagctactgcatgaccttcttcttcatcgccaagcccagccctgtgatctgtgccctgcggcggctgggcctgggcagcagctttgccatctgctacagcgccctgctgaccaagaccaactgcatcgcccgcatctttgatggagtgaagaatggagcccagaggcccaagttcatcagccccagcagccaggtgttcatctgcctgggcctcatcctggtgcagatcgtgatggtgtctgtgtggctgatcctggaggcccctggcacccggcgctacaccctggccgagaagcgggagaccgtcatcctgaagtgcaatgtgaaggacagctccatgctgatcagcctgacctatgatgtgatcctggtgatcctgtgcaccgtgtatgccttcaagaccaggaagtgcccagagaacttcaatgaggccaagttcatcggcttcaccatgtacaccacctgcatcatctggctggccttcctgcccatcttctacgtgaccagcagtgactacagagtgcagaccaccaccatgtgcatctctgtgtccctgagcggctttgtggtgctgggctgcctgtttgcccccaaggtgcacatcatcctcttccagccccagaagaatgtggtgacccaccggctgcacctgaaccgcttctctgtgtctggaacaggcaccacctacagccagagcagcgccagcacctacgtgcccaccgtgtgcaatggccgggaggtgctggacagcaccaccagcagcctgtag

SEQ ID NO: 153994 - DNA, 1416 bp, Artificial Sequence
  Description of Artificial Sequence: Synthetic coding sequence
atgaggaggaccaaccacgagcctgagcccggctgccgcctgacagctgctgctgccacagctgtgagcagcagcagctgccaggagctgtctgtgcgggcccccttcaaccccaacaaggatgctgacagcatcgtgaagtttgacacctttggagatggcatgggccgctacaacgtgttcaacttccagaatgtgggcggcaagtacagctacctgaaggtgggccactgggccgagaccctgagcctggatgtgaacagcatccactggagcagaaattctgtgcccaccagccagtgcagcgacccctgtgccccaaatgagatgaagaacatgcagcctggagatgtgtgctgctggatctgcatcccctgtgagccctatgagtacctggctgatgagttcacctgcatggactgtggcagcggccagtggcccacagctgacctgaccggctgctatgacctgcctgaggactacatccgctgggaggatgcctgggccatcggccctgtgaccatcgcctgcctgggcttcatgtgcacctgcatggtggtgaccgtcttcatcaagcacaacaacacccccctggtgaaggccagcggccgggagctgtgctacatcctgctgtttggagtgggcctgagctactgcatgaccttcttcttcatcgccaagcccagccctgtgatctgtgccctgcggcggctgggcctgggcagcagctttgccatctgctacagcgccctgctgaccaagaccaactgcatcgcccgcatctttgatggagtgaagaatggagcccagaggcccaagttcatcagccccagcagccaggtgttcatctgcctgggcctcatcctggtgcagatcgtgatggtgtctgtgtggctgatcctggaggcccctggcacccggcgctacaccctggccgagaagcgggagaccgtcatcctgaagtgcaatgtgaaggacagctccatgctgatcagcctgacctatgatgtgatcctggtgatcctgtgcaccgtgtatgccttcaagaccaggaagtgcccagagaacttcaatgaggccaagttcatcggcttcaccatgtacaccacctgcatcatctggctggccttcctgcccatcttctacgtgaccagcagtgactacagagtgcagaccaccaccatgtgcatctctgtgtccctgagcggctttgtggtgctgggctgcctgtttgcccccaaggtgcacatcatcctcttccagccccagaagaatgtggtgacccaccggctgcacctgaaccgcttctctgtgtctggaacaggcaccacctacagccagagcagcgccagcacctacgtgcccaccgtgtgcaatggccgggaggtgctggacagcaccaccagcagcctgtag

SEQ ID NO: 153995 - DNA, 2391 bp, Artificial Sequence
  Description of Artificial Sequence: Synthetic coding sequence
atgcctgcctgggagcccggggtggccgccagctgtggctggagggccccaccctgcagccccctgcggctgtgcatcgccccccacccctgcaccccacccagcagccaccagggcaacctgacctgccgcctgccccccaggagctttggcttctgccgctgtgtgtgggtgaggacccggggccccagcctgcccggggagcaggtgtccctggccgcccatgaaagtgaaggagctgctgcccagctgggcagcagccctgagattgacccccggcggccccgctgcctgctgcctgagagcgcccagatcccccagatctcctatgccagcacagccccagacctgagtgacaacagccgctatgacttcttcagccgggtggtgcccagcgacacctaccaggcccaggccatggtggacatcgtgcgggccctgaagtggaactacgtgtccacagtggccagcgagggcagctatggagagagcggcgtggaggccttcatccagaagagcagagaagatggcggcgtgtgcatcgcccagagcgtgaagatcccccgggagcccaaggccggggagtttgacaagatcatccggcggctgctggagaccagcaatgcccgggctgtgatcatctttgccaatgaagatgacatccggcgggtgctggaggccgcccggcgggccaaccagacaggccacttcttctggatgggcagtgacagctggggcagcaagatcgcccctgtgctgcacctggaggaggtggccgagggcgctgtgaccatcctgcccaagaggatgtctgtgcgggaccgggagcgcatcggccaggacagcgcctatgagcaggagggcaaggtgcagtttgtgattgatgctgtgtatgccatgggccacgccctgcacgccatgcaccgggacctgtgccccggccgggtgggcctgtgccccaggatggaccctgtggatggcacccagctgctgaagtacatcagaaatgtgaacttcagcggcattgctggcaaccctgtgaccttcaatgaaaatggagatgcccctggccgctatgacatctaccagtaccagctgagaaatgacagcgctgagtacaaggtgattggctcctggacagaccacctgcacctgagaattgaaagaatgcactggccaggcagcggccagcagctgcccaggagcatctgcagcctgccctgccagcccggggagaggaagaagacagtgaagggcatgccctgctgctggcactgtgagccctgcaccggctaccagtaccaggtggaccgctacacctgcaagacctgcccctatgacatgaggcccacagagaacagaacaggctgccggcccatccccatcatcaagctggagtggggcagcccctgggccgtgctgcccctcttcctggccgtggtgggcattgctgccaccctgtttgtggtgatcacctttgtgcgctacaatgacacccccatcgtgaaggccagcggccgggagctgtcctatgtgctgctggccggcatcttcctgtgctacgccaccaccttcctgatgattgctgagccagacctgggcacctgcagcctgcggcgcatcttcctgggcctgggcatgagcatctcctatgctgccctgctgaccaagaccaaccgcatctaccgcatctttgagcagggcaagaggtctgtgtctgccccccgcttcatcagccctgccagccagctggccatcaccttcagcctcatcagcctgcagctgctgggcatctgtgtgtggtttgtggtggaccccagccacagcgtggtggacttccaggaccagaggaccctggaccccaggtttgcccggggcgtgctgaagtgtgacatcagtgacctgagcctcatctgcctgctgggctacagcatgctgctgatggtgacctgcaccgtgtatgccatcaagacccggggcgtgcctgagaccttcaatgaggccaagcccatcggcttcaccatgtacaccacctgcatcgtgtggctggccttcatccccatcttcttcggcaccagccagagcgctgacaagctgtacatccagaccaccaccctgactgtgtctgtgtccctgagcgcctctgtgtccctgggcatgctgtacatgcccaaggtgtacatcatcctcttccaccctgagcagaatgtgcccaagaggaagaggagcctgaaggctgtggtgacagctgccaccatgagcaacaagttcacccagaagggcaacttccggcccaacggggaggccaagtctgagctgtgtgagaacctggaggccccagccctggccaccaagcagacctacgtgacctacaccaaccacgccatctag

SEQ ID NO: 153996 - DNA, 2739 bp, Artificial Sequence
  Description of Artificial Sequence: Synthetic coding sequence
atgcctgggaagaggggcctgggctggtggtgggcccggctgcccctgtgcctgctgctgagcctgtatggcccctggatgcccagcagcctgggcaagcccaagggccacccccacatgaacagcatcagaattgatggagacatcaccctgggcggcctcttccctgtgcacggccggggcagcgagggcaagccctgtggggagctgaagaaggagaagggcatccaccggctggaggccatgctgtttgccctggaccgcatcaacaatgaccctgacctgctgcccaacatcaccctgggcgcccgcatcctggacacctgcagccgggacacccacgccctggagcagagcctgacctttgtgcaggccctgattgagaaggatggaacagaggtgcgctgtggcagcggcggcccccccatcatcaccaagccagagcgggtggtgggcgtcatcggggccagcggcagctctgtgtccatcatggtggccaacatcctgcggctcttcaagatcccccagatctcctatgccagcacagccccagacctgagtgacaacagccgctatgacttcttcagccgggtggtgcccagcgacacctaccaggcccaggccatggtggacatcgtgcgggccctgaagtggaactacgtgtccacagtggccagcgagggcagctatggagagagcggcgtggaggccttcatccagaagagccgggaggatggaggagtgtgcatcgcccagagcgtgaagatcccccgggagcccaaggccggggagtttgacaagatcatccggcggctgctggagaccagcaatgcccgggccgtcatcatctttgccaatgaagatgacatcagaagagtgctggaggccgcccggcgggccaaccagacaggccacttcttctggatgggcagtgacagctggggcagcaagatcgcccctgtgctgcacctggaggaggtggccgagggcgctgtgaccatcctgcccaagaggatgtctgtgcggggctttgaccgctacttcagcagcaggaccctggacaacaacagaagaaacatctggtttgctgagttctgggaggacaacttccactgcaagctgagcagacatgccctgaagaagggcagccacgtgaagaagtgcaccaaccgggagcgcatcggccaggacagcgcctatgagcaggagggcaaggtgcagtttgtgattgatgctgtgtatgccatgggccacgccctgcacgccatgcaccgggacctgtgccccggccgggtgggcctgtgccccaggatggaccctgtggatggcacccagctgctgaagtacatcagaaatgtgaacttcagcggcattgctggcaaccctgtgaccttcaatgaaaatggagatgcccctggccgctatgacatctaccagtaccagctgagaaatgacagcgctgagtacaaggtgattggctcctggacagaccacctgcacctgagaattgaaagaatgcactggccaggcagcggccagcagctgcccaggagcatctgcagcctgccctgccagcccggggagaggaagaagacagtgaagggcatgccctgctgctggcactgtgagccctgcaccggctaccagtaccaggtggaccgctacacctgcaagacctgcccctatgacatgaggcccacagagaacagaacaggctgccggcccatccccatcatcaagctggagtggggcagcccctgggccgtgctgcccctcttcctggccgtggtgggcattgctgccaccctgtttgtggtgatcacctttgtgcgctacaatgacacccccatcgtgaaggccagcggccgggagctgtcctatgtgctgctggccggcatcttcctgtgctacgccaccaccttcctgatgattgctgagccagacctgggcacctgcagcctgcggcgcatcttcctgggcctgggcatgagcatctcctatgctgccctgctgaccaagaccaaccgcatctaccgcatctttgagcagggcaagaggtctgtgtctgccccccgcttcatcagccctgccagccagctggccatcaccttcagcctcatcagcctgcagctgctgggcatctgtgtgtggtttgtggtggaccccagccacagcgtggtggacttccaggaccagaggaccctggaccccaggtttgcccggggcgtgctgaagtgtgacatcagtgacctgagcctcatctgcctgctgggctacagcatgctgctgatggtgacctgcaccgtgtatgccatcaagacccggggcgtgcctgagaccttcaatgaggccaagcccatcggcttcaccatgtacaccacctgcatcgtgtggctggccttcatccccatcttcttcggcaccagccagagcgctgacaagctgtacatccagaccaccaccctgactgtgtctgtgtccctgagcgcctctgtgtccctgggcatgctgtacatgcccaaggtgtacatcatcctcttccaccctgagcagaatgtgcccaagaggaagaggagcctgaaggctgtggtgacagctgccaccatgagcaacaagttcacccagaagggcaacttccggcccaacggggaggccaagtctgagctgtgtgagaacctggaggccccagccctggccaccaagcagacctacgtgacctacaccaaccacgccatctag

SEQ ID NO: 153997 - DNA, 2319 bp, Artificial Sequence
  Description of Artificial Sequence: Synthetic coding sequence
atggtgcagaccctgcccaagctgttcccccatgatggagccaagaggaagaagaggaccctgcggaccagcggcccctgcttcggcggcggcggccagatcccccagatctcctatgccagcacagccccagacctgagtgacaacagccgctatgacttcttcagccgggtggtgcccagcgacacctaccaggcccaggccatggtggacatcgtgcgggccctgaagtggaactacgtgtccacagtggccagcgagggcagctatggagagagcggcgtggaggccttcatccagaagagccgggaggatggaggagtgtgcatcgcccagagcgtgaagatcccccgggagcccaaggccggggagtttgacaagatcatccggcggctgctggagaccagcaatgcccgggccgtcatcatctttgccaatgaagatgacatcagaagagtgctggaggccgcccggcgggccaaccagacaggccacttcttctggatgggcagtgacagctggggcagcaagatcgcccctgtgctgcacctggaggaggtggccgagggcgctgtgaccatcctgcccaagaggatgtctgtgcggggctttgaccgctacttcagcagcaggaccctggacaacaacagaagaaacatctggtttgctgagttctgggaggacaacttccactgcaagctgagcagacatgccctgaagaagggcagccacgtgaagaagtgcaccaaccgggagcgcatcggccaggacagcgcctatgagcaggagggcaaggtgcagtttgtgattgatgctgtgtatgccatgggccacgccctgcacgccatgcaccgggacctgtgccccggccgggtgggcctgtgccccaggatggaccctgtggatggcacccagctgctgaagtacatcagaaatgtgaacttcagcggcattgctggcaaccctgtgaccttcaatgaaaatggagatgcccctggccgctatgacatctaccagtaccagctgagaaatgacagcgctgagtacaaggtgattggctcctggacagaccacctgcacctgagaattgaaagaatgcactggccaggcagcggccagcagctgcccaggagcatctgcagcctgccctgccagcccggggagaggaagaagacagtgaagggcatgccctgctgctggcactgtgagccctgcaccggctaccagtaccaggtggaccgctacacctgcaagacctgcccctatgacatgaggcccacagagaacagaacaggctgccggcccatccccatcatcaagctggagtggggcagcccctgggccgtgctgcccctcttcctggccgtggtgggcattgctgccaccctgtttgtggtgatcacctttgtgcgctacaatgacacccccatcgtgaaggccagcggccgggagctgtcctatgtgctgctggccggcatcttcctgtgctacgccaccaccttcctgatgattgctgagccagacctgggcacctgcagcctgcggcgcatcttcctgggcctgggcatgagcatctcctatgctgccctgctgaccaagaccaaccgcatctaccgcatctttgagcagggcaagaggtctgtgtctgccccccgcttcatcagccctgccagccagctggccatcaccttcagcctcatcagcctgcagctgctgggcatctgtgtgtggtttgtggtggaccccagccacagcgtggtggacttccaggaccagaggaccctggaccccaggtttgcccggggcgtgctgaagtgtgacatcagtgacctgagcctcatctgcctgctgggctacagcatgctgctgatggtgacctgcaccgtgtatgccatcaagacccggggcgtgcctgagaccttcaatgaggccaagcccatcggcttcaccatgtacaccacctgcatcgtgtggctggccttcatccccatcttcttcggcaccagccagagcgctgacaagctgtacatccagaccaccaccctgactgtgtctgtgtccctgagcgcctctgtgtccctgggcatgctgtacatgcccaaggtgtacatcatcctcttccaccctgagcagaatgtgcccaagaggaagaggagcctgaaggctgtggtgacagctgccaccatgagcaacaagttcacccagaagggcaacttccggcccaacggggaggccaagtctgagctgtgtgagaacctggaggccccagccctggccaccaagcagacctacgtgacctacaccaaccacgccatctag

SEQ ID NO: 153998 - DNA, 2340 bp, Artificial Sequence
  Description of Artificial Sequence: Synthetic coding sequence
atggctgtgcccctgggcgccccctgctgggccagcgccctgcctgcctgggcccctcctggcctgccccacaggagcctgctgacccggctgctgagccagcacgtgaagccagccaagatcccccagatctcctatgccagcacagccccagacctgagtgacaacagccgctatgacttcttcagccgggtggtgcccagcgacacctaccaggcccaggccatggtggacatcgtgcgggccctgaagtggaactacgtgtccacagtggccagcgagggcagctatggagagagcggcgtggaggccttcatccagaagagcagagaagatggcggcgtgtgcatcgcccagagcgtgaagatcccccgggagcccaaggccggggagtttgacaagatcatccggcggctgctggagaccagcaatgcccgggctgtgatcatctttgccaatgaagatgacatccggcgggtgctggaggccgcccggcgggccaaccagacaggccacttcttctggatgggcagtgacagctggggcagcaagatcgcccctgtgctgcacctggaggaggtggccgagggcgctgtgaccatcctgcccaagaggatgtctgtgcggggctttgaccgctacttcagcagcaggaccctggacaacaacagaagaaacatctggtttgctgagttctgggaggacaacttccactgcaagctgagcagacatgccctgaagaagggcagccacgtgaagaagtgcaccaaccgggagagaattggccaggacagcgcctatgagcaggagggcaaggtgcagtttgtgattgatgctgtgtatgccatgggccacgccctgcacgccatgcaccgggacctgtgccccggccgggtgggcctgtgccccaggatggaccctgtggatggcacccagctgctgaagtacatcagaaatgtgaacttctctggaattgctggcaaccctgtgaccttcaatgaaaatggagatgcccctggccgctatgacatctaccagtaccagctgagaaatgattctgctgagtacaaggtgattggctcctggacagaccacctgcacctgcgcatcgagaggatgcactggccaggcagcggccagcagctgcccaggagcatctgcagcctgccctgccagcctggagagaggaagaagacagtgaagggcatgccctgctgctggcactgtgagccctgcaccggctaccagtaccaggtggaccgctacacctgcaagacctgcccctatgacatgaggcccacagaaaatagaacaggctgccggcccatccccatcatcaagctggagtggggcagcccctgggccgtgctgcccctcttcctggccgtggtgggcattgctgccaccctgtttgtggtgatcacctttgtgcgctacaatgacacccccatcgtgaaggccagcggccgggagctgtcctatgtgctgctggccggcatcttcctgtgctacgccaccaccttcctgatgattgctgagccagacctgggcacctgcagcctgcggcgcatcttcctgggcctgggcatgagcatctcctatgctgccctgctgaccaagaccaaccgcatctaccgcatctttgagcagggcaagaggtctgtgtctgccccccgcttcatcagccctgccagccagctggccatcaccttcagcctcatcagcctgcagctgctgggcatctgtgtgtggtttgtggtggaccccagccacagcgtggtggacttccaggaccagaggaccctggaccccaggtttgcccggggcgtgctgaagtgtgacatcagtgacctgagcctcatctgcctgctgggctacagcatgctgctgatggtgacctgcaccgtgtatgccatcaagacccggggcgtgcctgagaccttcaatgaggccaagcccatcggcttcaccatgtacaccacctgcatcgtgtggctggccttcatccccatcttcttcggcaccagccagagcgctgacaagctgtacatccagaccaccaccctgactgtgtctgtgtccctgagcgcctctgtgtccctgggcatgctgtacatgcccaaggtgtacatcatcctcttccaccctgagcagaatgtgcccaagaggaagaggagcctgaaggctgtggtgacagctgccaccatgagcaacaagttcacccagaagggcaacttccggcccaatggagaggccaagtctgagctgtgtgagaacctggaggccccagccctggccaccaagcagacctacgtgacctacaccaaccacgccatctag

SEQ ID NO: 153999 - DNA, 2739 bp, Artificial Sequence; identical to SEQ ID NO: 153996
  Description of Artificial Sequence: Synthetic coding sequence

SEQ ID NO: 154000 - DNA, 2232 bp, Artificial Sequence
  Description of Artificial Sequence: Synthetic coding sequence
atgagctgcaagatcccccagatctcctatgccagcacagccccagacctgagtgacaacagccgctatgacttcttcagccgggtggtgcccagcgacacctaccaggcccaggccatggtggacatcgtgcgggccctgaagtggaactacgtgtccacagtggccagcgagggcagctatggagagagcggcgtggaggccttcatccagaagagcagagaagatggcggcgtgtgcatcgcccagagcgtgaagatcccccgggagcccaaggccggggagtttgacaagatcatccggcggctgctggagaccagcaatgcccgggctgtgatcatctttgccaatgaagatgacatccggcgggtgctggaggccgcccggcgggccaaccagacaggccacttcttctggatgggcagtgacagctggggcagcaagatcgcccctgtgctgcacctggaggaggtggccgagggcgctgtgaccatcctgcccaagaggatgtctgtgcggggctttgaccgctacttcagcagcaggaccctggacaacaacagaagaaacatctggtttgctgagttctgggaggacaacttccactgcaagctgagcagacatgccctgaagaagggcagccacgtgaagaagtgcaccaaccgggagagaattggccaggacagcgcctatgagcaggagggcaaggtgcagtttgtgattgatgctgtgtatgccatgggccacgccctgcacgccatgcaccgggacctgtgccccggccgggtgggcctgtgccccaggatggaccctgtggatggcacccagctgctgaagtacatcagaaatgtgaacttctctggaattgctggcaaccctgtgaccttcaatgaaaatggagatgcccctggccgctatgacatctaccagtaccagctgagaaatgattctgctgagtacaaggtgattggctcctggacagaccacctgcacctgcgcatcgagaggatgcactggccaggcagcggccagcagctgcccaggagcatctgcagcctgccctgccagcctggagagaggaagaagacagtgaagggcatgccctgctgctggcactgtgagccctgcaccggctaccagtaccaggtggaccgctacacctgcaagacctgcccctatgacatgaggcccacagaaaatagaacaggctgccggcccatccccatcatcaagctggagtggggcagcccctgggccgtgctgcccctcttcctggccgtggtgggcattgctgccaccctgtttgtggtgatcacctttgtgcgctacaatgacacccccatcgtgaaggccagcggccgggagctgtcctatgtgctgctggccggcatcttcctgtgctacgccaccaccttcctgatgattgctgagccagacctgggcacctgcagcctgcggcgcatcttcctgggcctgggcatgagcatctcctatgctgccctgctgaccaagaccaaccgcatctaccgcatctttgagcagggcaagaggtctgtgtctgccccccgcttcatcagccctgccagccagctggccatcaccttcagcctcatcagcctgcagctgctgggcatctgtgtgtggtttgtggtggaccccagccacagcgtggtggacttccaggaccagaggaccctggaccccaggtttgcccggggcgtgctgaagtgtgacatcagtgacctgagcctcatctgcctgctgggctacagcatgctgctgatggtgacctgcaccgtgtatgccatcaagacccggggcgtgcctgagaccttcaatgaggccaagcccatcggcttcaccatgtacaccacctgcatcgtgtggctggccttcatccccatcttcttcggcaccagccagagcgctgacaagctgtacatccagaccaccaccctgactgtgtctgtgtccctgagcgcctctgtgtccctgggcatgctgtacatgcccaaggtgtacatcatcctcttccaccctgagcagaatgtgcccaagaggaagaggagcctgaaggctgtggtgacagctgccaccatgagcaacaagttcacccagaagggcaacttccggcccaatggagaggccaagtctgagctgtgtgagaacctggaggccccagccctggccaccaagcagacctacgtgacctacaccaaccacgccatctag

SEQ ID NO: 154001 - DNA, 1776 bp, Artificial Sequence
  Description of Artificial Sequence: Synthetic coding sequence
atgggcagtgacagctggggcagcaagatcgcccctgtgctgcacctggaggaggtggccgagggcgctgtgaccatcctgcccaagaggatgtctgtgcggggctttgaccgctacttcagcagcaggaccctggacaacaacagaagaaacatctggtttgctgagttctgggaggacaacttccactgcaagctgagcagacatgccctgaagaagggcagccacgtgaagaagtgcaccaaccgggagcgcatcggccaggacagcgcctatgagcaggagggcaaggtgcagtttgtgattgatgctgtgtatgccatgggccacgccctgcacgccatgcaccgggacctgtgccccggccgggtgggcctgtgccccaggatggaccctgtggatggcacccagctgctgaagtacatcagaaatgtgaacttcagcggcattgctggcaaccctgtgaccttcaatgaaaatggagatgcccctggccgctatgacatctaccagtaccagctgagaaatgacagcgctgagtacaaggtgattggctcctggacagaccacctgcacctgagaattgaaagaatgcactggccaggcagcggccagcagctgcccaggagcatctgcagcctgccctgccagcccggggagaggaagaagacagtgaagggcatgccctgctgctggcactgtgagccctgcaccggctaccagtaccaggtggaccgctacacctgcaagacctgcccctatgacatgaggcccacagagaacagaacaggctgccggcccatccccatcatcaagctggagtggggcagcccctgggccgtgctgcccctcttcctggccgtggtgggcattgctgccaccctgtttgtggtgatcacctttgtgcgctacaatgacacccccatcgtgaaggccagcggccgggagctgtcctatgtgctgctggccggcatcttcctgtgctacgccaccaccttcctgatgattgctgagccagacctgggcacctgcagcctgcggcgcatcttcctgggcctgggcatgagcatctcctatgctgccctgctgaccaagaccaaccgcatctaccgcatctttgagcagggcaagaggtctgtgtctgccccccgcttcatcagccctgccagccagctggccatcaccttcagcctcatcagcctgcagctgctgggcatctgtgtgtggtttgtggtggaccccagccacagcgtggtggacttccaggaccagaggaccctggaccccaggtttgcccggggcgtgctgaagtgtgacatcagtgacctgagcctcatctgcctgctgggctacagcatgctgctgatggtgacctgcaccgtgtatgccatcaagacccggggcgtgcctgagaccttcaatgaggccaagcccatcggcttcaccatgtacaccacctgcatcgtgtggctggccttcatccccatcttcttcggcaccagccagagcgctgacaagctgtacatccagaccaccaccctgactgtgtctgtgtccctgagcgcctctgtgtccctgggcatgctgtacatgcccaaggtgtacatcatcctcttccaccctgagcagaatgtgcccaagaggaagaggagcctgaaggctgtggtgacagctgccaccatgagcaacaagttcacccagaagggcaacttccggcccaacggggaggccaagtctgagctgtgtgagaacctggaggcccctggcagcagctag

SEQ ID NO: 154002 - DNA, 2364 bp, Artificial Sequence
  Description of Artificial Sequence: Synthetic coding sequence
atggagcctgctggggagcgcttccctgagcagaggcaggtgctgatcctgctgctgctgctggaggtgaccctggccggctgggagccccggcgctacagcgtgatggaggagacagagcggggcagctttgtggccaacctggccaatgacctgggcctgggcgtgggggagctggccgagcggggggcccgggtggtgtctgaagataatgagcagggcctgcagctggacctgcagacaggccagctgatcctgaatgagaagctggaccgggagaagctgtgtggccccacagagccctgcatcatgcacttccaggtgctgctgaagaagcccctggaggtgttccgggcagagctgctggtgacagacatcaatgaccacagccctgagttccctgagcgggagatgaccctgaagatccctgagaccagcagcctgggcaccgtcttccccctgaagaaggcccgggacctggatgtgggcagcaacaacgtgcagaactacaacatcagccccaacagccacttccacgtgtccaccaggaccagaggagatggcaggaagtacccagagctggtgctggacacagagctggaccgggaggagcaggccgagctgcggctgaccctgacagctgtggatggcggcagcccccccaggtctggaacagtgcagatcctgatcctggtgctggatgccaatgacaatgcccctgagtttgtgcaggccctgtatgaggtgcaggtgcctgagaacagccctgtgggcagcctggtggtgaaggtgtctgcccgggacctggacaccggcaccaacggggagatctcctacagcctgtactacagcagccaggagattgacaagccctttgagctgagcagcctgagcggggagatccgcctcatcaagaagctggactttgagaccatgagcagctatgacctggacatcgaggccagtgatggcggcggcctgagcggcaagtgcagcgtgtctgtgaaggtgctggatgtgaatgacaacttccctgagctgagcatcagcagcctgaccagccccatccctgagaacagccctgagacagaggtggccctcttccgcatccgggaccgggacagcggagaaaatggcaagatgatctgcagcatccaggatgatgtgcccttcaagctgaagcccagcgtggagaacttctaccgcctggtgacagaaggagccctggaccgggagaccagggctgagtacaacatcaccatcaccatcacagacctgggcaccccccggctgaagacagagcagagcatcaccgtgctggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccgggacccccacctgcccctgaccagcctggtgtccatcaacacagacaatggccacctgtttgccctgcagagcctggactatgaggccctgcaggcctttgagttccgggtgggcgccacagaccggggcttccctgccctgagcagcgaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgtggccaagcaccggctggtggtgctggtgaaggacaatggagagccccccaggtctgccacagccaccctgcaggtgctgctggtggatggcttcagccagccctacctgcccctgcctgaggccgccccagcccaggcccaggccgacagcctgactgtgtacctggtggtggccctggcctctgtgagcagcctcttcctgttcagcgtcttcctgtttgtggccgtgcggctgtgcagaagaagcagagctgcctctgtgggccgctgcagcgtgcctgagggccccttccctggccacctggtggatgtgtctggcaccggcaccctgagccagagctaccagtatgaggtgtgcctgaccggcggcagcgagagcaatgacttcaagttcctgaagcccatcttccccaacatcgtgtcccaggacagcaggaggaagtctgagttcctggagtag

SEQ ID NO: 154003 - DNA, 3276 bp, Artificial Sequence
  Description of Artificial Sequence: Synthetic coding sequence
atgcagctggatggcctgcaggccctgtgctggggcagcctcttccgcacccagctggtgcctgtgtatgtggccgtgctgcccagcccccagccctgcatcccccccacctgcacagccttcacagagttcagcggccccctggccaagcaccacagcttccagcccttccaggtggccgccccagctggccccaggagccccccccagcccttccacctgcccagcgtgtcccaggtgcacgccacccacctgctgtgccctgtgcgggtgctgggccccccctacccacccagcctggagctgctgaccagcatccacagccctgctgtgctgcctgccccccagatcccccagatctcctatgccagcacagcccctgagctgagtgacagcaccaggtatgacttcttcagccgggtggtgcccccagacagctaccaggcccaggccatggtggacatcgtgcgggccctgggctggaactacgtgtccaccctggccagcgagggcaactatggagagagcggcgtggaggcctttgtgcagatcagccgggaggccggggagctgggcgcccccaggcaccagggcgtgtacatcgtgtgggcccggggcccccagctgggccagaagcagaaggatggcggccccaggtccatgctgggccggggctgcctggccggggccccctgtggccgggacctgtttgtgctggatgacagcgccctgccccaggcctggaggagagtgcaggcccggctgcacccctgccggcccttcagccagcccacccagagcagcgctgctgtggcccgctggagcatcaagatcccccgggagcccaagccaggagagttcagcaaggtgatccggcggctgatggagaccccaaatgcccggggcatcatcatctttgccaatgaagatgacatcagccctgcccccacccggcgggtgctggaggccgcccggcaggccaacctgaccggccacttcctgtgggtgggcagtgacagctggggcgccaagaccagccccatcctgagcctggaggatgtggccgtgggcgccatcaccatcctgcccaagagggccagcattgatggctttgaccagtacttcatgaccaggagcctggagaacaacagaagaaacatctggtttgctgagttctgggaggagaacttcaactgcaagctgaccagcagcggcacccagagtgatgacagcaccaggaagtgcaccggggagagctgccccggctggacaggagaggagagaattggccgggacagcacctatgagcaggagggcaaggtgcagtttgtgattgatgctgtgtatgccatcgcccacgccctgcacagcatgcaccaggccctgtgccccggccacacaggcctgtgcccagccatggagcccacagatggccgcatgctgctgcagtacatccgctgccccctgcagtggctgaaccgcatccccctgtgtgagtggccccggcgggtgcggcccttcttctgccagtggaccctgggcctgctgagcagctgtggctacgtgaacaatgctgctgtgaatgtggccgtgcaggccttcctggccaccctgctgagcagcctgagcagcatctacccaggagtggagctgctgggccacgtgttcaacctgctgcggcggctgcacacagtgttctgcagcggctgcagcctcttcccccccaccgtgcacaagggcagcgctggcacccctgtgatgtttaatgaaaatggagatgcccctggccgctatgacatcttccagtaccaggccaccaatggaagtgccagcagcggcggctaccaggccgtgggccagtgggccgagaccctgcggctggatgtgtctgtgcagacagagccccaggtgggcatgggccctggcagccggcggcagaccccccagcccgtcttctgtgccagccaggtggaggccctgcagtggagcggggacccccatgaggtgcccagcagcctgtgcagcctgccctgtggccctggagagaggaagaagatggtgaagggcgtgccctgctgctggcactgtgaggcctgtgatggctaccgcttccaggtggatgagttcacctgtgaggcctgccctggggacatgaggcccacccccaaccacacaggctgccggcccacccctgtggtgcggctgtcctggagcagcccctgggccgccccacccctgctgctggccgtgctgggcatcgtggccaccaccaccgtggtggccacctttgtgcgctacaacaacacccccatcgtgcgggccagcggccgggagctgtcctatgtgctgctgaccggcatcttcctgatctatgccatcaccttcctgatggtggccgagcctggagctgctgtgtgtgccgcccggcggctcttcctgggcctgggcaccaccctgagctacagcgccctgctgaccaagaccaaccgcatctaccgcatctttgagcagggcaagaggtctgtgaccccaccacccttcatcagccccaccagccagctggtgatcaccttcagcctgaccagcctgcagatcaatgctgtgttccgggtgaccctcttctacttcggcagcctgcagtggcactacctgagcagcctgcaggccctgcccagcggggacctgtctgtgcagcacctgagcgcctctgtgtccctgggcatgctgtacagcaagagcaagacccctgtggacctggaggtgggcagcgagccctggggctacctgggagatggagtgctgcaggccgagcactggggcgagggccgcggggactggccccacgtgaaggtgatggtggtggtgtaccagagcagcctggtgtactacatgaagcaggcccaggccggccgggtgaagacagagctgctgaaggtggcccaccaccaggtggccaagtctgtgcctgaggagagccagatcgtggtgctgcacctggtgacagctggctacgtggacatggccatccgcaccacccgggccagcctgcacctgatgcccctgaccctggtgcctggagctgctgctgaggtgaatgagacccaggtggccgcccggctgggccctggcagcacagtgggcacctaccaggtggtggtggtgctgatgaggagcctgcagattgacaagaccaccaaccagctgagcctggagacctgcttcagcggcatccagggcttcctggcctctgtgaacagcctggtgatggacaagtag

SEQ ID NO: 154004 - DNA, 2634 bp, Artificial Sequence
  Description of Artificial Sequence: Synthetic coding sequence
atggcccggccccggcgggcccgggagcccctgctggtggccctgctgcccctggcctggctggcccaggccggcctggcccgggccgccggctctgtgcggctggccggcggcctgaccctgggcggcctcttccctgtgcacgcccggggagctgctggccgggcctgtggccagctgaagaaggagcagggcgtgcaccggctggaggccatgctgtatgccctggacagagtgaatgctgaccctgagctgctgcccggggtgcggctgggcgcccggctgctggacacctgcagccgggacacctacgccctggagcaggccctgagctttgtgcaggccctgatccggggcagaggagatggagatgaggtgggcgtgcgctgccctggaggagtgccccccctgcggcctgcccctcctgagcgggtggtggccgtggtgggcgccagcgccagctctgtgtccatcatggtggccaacgtgctgcggctgtttgccatcccccagatctcctatgccagcacagcccctgagctgagtgacagcaccaggtatgacttcttcagccgggtggtgcccccagacagctaccaggcccaggccatggtggacatcgtgcgggccctgggctggaactacgtgtccaccctggccagcgagggcaactatggagagagcggcgtggaggcctttgtgcagatcagccgggaggccggcggcgtgtgcatcgcccagagcatcaagatcccccgggagcccaagccaggagagttcagcaaggtgatccggcggctgatggagaccccaaatgcccggggcatcatcatctttgccaatgaagatgacatccggcgggtgctggaggccgcccggcaggccaacctgaccggccacttcctgtgggtgggcagtgacagctggggcgccaagaccagccccatcctgagcctggaggatgtggccgtgggcgccatcaccatcctgcccaagagggccagcattgatggctttgaccagtacttcatgaccaggagcctggagaacaacagaagaaacatctggtttgctgagttctgggaggagaacttcaactgcaagctgaccagcagcggcacccagagtgatgacagcaccaggaagtgcaccggggaggagagaattggccgggacagcacctatgagcaggagggcaaggtgcagtttgtgattgatgctgtgtatgccatcgcccacgccctgcacagcatgcaccaggccctgtgccccggccacacaggcctgtgcccagccatggagcccacagatggccgcatgctgctgcagtacatccgggctgtgcgcttcaatggatctgctggcacccctgtgatgtttaatgaaaatggagatgcccctggccgctatgacatcttccagtaccaggccaccaatggaagtgccagcagcggcggctaccaggccgtgggccagtgggccgagaccctgcggctggatgtggaggccctgcagtggagcggggacccccatgaggtgcccagcagcctgtgcagcctgccctgtggccctggagagaggaagaagatggtgaagggcgtgccctgctgctggcactgtgaggcctgtgatggctaccgcttccaggtggatgagttcacctgtgaggcctgccctggggacatgaggcccacccccaaccacacaggctgccggcccacccctgtggtgcggctgtcctggagcagcccctgggccgccccacccctgctgctggccgtgctgggcatcgtggccaccaccaccgtggtggccacctttgtgcgctacaacaacacccccatcgtgcgggccagcggccgggagctgtcctatgtgctgctgaccggcatcttcctgatctatgccatcaccttcctgatggtggccgagcctggagctgctgtgtgtgccgcccggcggctcttcctgggcctgggcaccaccctgagctacagcgccctgctgaccaagaccaaccgcatctaccgcatctttgagcagggcaagaggtctgtgaccccaccacccttcatcagccccaccagccagctggtgatcaccttcagcctgaccagcctgcaggtggtgggcatgattgcctggctgggcgcccggcccccccacagcgtgattgattatgaggagcagaggacagtggaccctgagcaggcccggggcgtgctgaagtgtgacatgtctgacctgagcctcatcggctgcctgggctacagcctgctgctgatggtgacctgcaccgtgtatgccatcaaggcccggggcgtgcctgagaccttcaatgaggccaagcccatcggcttcaccatgtacaccacctgcatcatctggctggcctttgtgcccatcttcttcggcacagcccagagcgctgagaagatctacatccagaccaccaccctgactgtgtccctgagcctgagcgcctctgtgtccctgggcatgctgtatgtgcccaagacctacgtgatcctcttccaccctgagcagaatgtgcagaagaggaagaggagcctgaaggccaccagcacagtggccgccccacccaagggagaagatgctgaggcccacaagtag

SEQ ID NO: 154005 - DNA, 2748 bp, Artificial Sequence
  Description of Artificial Sequence: Synthetic coding sequence
atggtgcagctgaggaagctgctgcgggtgctgaccctgatgaagttcccctgctgcgtgctggaggtgctgctgtgtgccctggccgctgctgcccggggccaggagatgtatgccccccacagcatcagaattgaaggagatgtgaccctgggcggcctcttccctgtgcacgccaagggccccagcggcgtgccctgtggggacatcaagagagaaaatggcatccaccggctggaggccatgctgtatgccctggaccagatcaacagcgaccccaacctgctgcccaacgtgaccctgggcgcccgcatcctggacacctgcagccgggacacctacgccctggagcagagcctgacctttgtgcaggccctgatccagaaggacaccagtgatgtgcgctgcaccaacggggagccccctgtgtttgtgaagccagagaaggtggtgggcgtcatcggggccagcggcagctctgtgtccatcatggtggccaacatcctgcggctcttccagatcccccagatctcctatgccagcacagcccctgagctgagtgatgaccggcgctatgacttcttcagccgggtggtgcccccagacagcttccaggcccaggccatggtggacatcgtgaaggccctgggctggaactacgtgtccaccctggccagcgagggcagctatggagagaagggcgtggagagcttcacccagatcagcaaggaggccggcggcctgtgcatcgcccagagcgtgcgcatcccccaggagaggaaggacaggaccatcgactttgaccgcatcatcaagcagctgctggacacccccaacagcagagctgtggtgatctttgccaatgatgaggacatcaagcagatcctggccgccgccaagagagctgaccaggtgggccacttcctgtgggtgggcagtgacagctggggcagcaagatcaaccccctgcaccagcatgaagatattgctgagggcgccatcaccatccagcccaagagggccaccgtggagggctttgatgcctacttcaccagcaggaccctggagaacaacagaagaaatgtgtggtttgctgagtactgggaggagaacttcaactgcaagctgaccatcagcggcagcaagaaggaggacacagacagaaaatgtacaggccaggagcgcatcggcaaggacagcaactatgagcaggagggcaaggtgcagtttgtgattgatgctgtgtatgccatggcccacgccctgcaccacatgaacaaggacctgtgtgccgactacagaggagtgtgcccagagatggagcaggccggcggcaagaagctgctgaagtacatcagaaatgtgaacttcaacggcagcgctggcacccctgtgatgttcaacaagaatggagatgcccctggccgctatgacatcttccagtaccagaccaccaacaccagcaaccctggctaccgcctgattggccagtggacagatgagctgcagctgaacatcgaggacatgcagtggggcaaaggagtgcgggagatcccagcctctgtgtgcaccctgccctgcaagccaggccagaggaagaagacccagaagggcaccccctgctgctggacctgtgagccctgtgatggctaccagtaccagtttgatgagatgacctgccagcactgcccctatgaccagaggcccaatgaaaatagaacaggctgccaggacatccccatcatcaagctggagtggcacagcccctgggccgtcatccctgtgttcctggccatgctgggcatcatcgccaccatctttgtgatggccaccttcatccgctacaatgacacccccatcgtgcgggccagcggccgggagctgtcctatgtgctgctgaccggcatcttcctgtgctacatcatcaccttcctgatgattgccaagccagatgtggccgtgtgcagcttccggcgggtcttcctgggcctgggcatgtgcatctcctatgctgccctgctgaccaagaccaaccgcatctaccgcatctttgagcagggcaagaagtctgtgacagcccccaggctcatcagccccaccagccagctggccatcaccagcagcctcatctctgtgcagctgctgggcgtcttcatctggtttggagtggacccccccaacatcatcatcgactatgatgagcacaagaccatgaaccctgagcaggcccggggcgtgctgaagtgtgacatcacagacctgcagatcatctgcagcctgggctacagcatcctgctgatggtgacctgcaccgtgtatgccatcaagacccggggcgtgcctgagaacttcaatgaggccaagcccatcggcttcaccatgtacaccacctgcatcgtgtggctggccttcatccccatcttctttggaacagcccagagcgctgagaagctgtacatccagaccaccaccctgaccatctccatgaacctgagcgcctctgtggccctgggcatgctgtacatgcccaaggtgtacatcatcatcttccaccctgagctgaatgtgcagaagaggaagaggagcttcaaggctgtggtgacagctgccaccatgagcagccggctgagccacaagcccagcgaccggcccaatggagaggccaagacagagctgtgtgaaaatgtggaccccaacagccctgctgccaagaagaagtatgtgtcctacaacaacctggtgatctag

SEQ ID NO: 154006 - DNA, 2721 bp, Artificial Sequence
  Description of Artificial Sequence: Synthetic coding sequence
atggtgcagctgaggaagctgctgcgggtgctgaccctgatgaagttcccctgctgcgtgctggaggtgctgctgtgtgccctggccgctgctgcccggggccaggagatgtatgccccccacagcatcagaattgaaggagatgtgaccctgggcggcctcttccctgtgcacgccaagggccccagcggcgtgccctgtggggacatcaagagagaaaatggcatccaccggctggaggccatgctgtatgccctggaccagatcaacagcgaccccaacctgctgcccaacgtgaccctgggcgcccgcatcctggacacctgcagccgggacacctacgccctggagcagagcctgacctttgtgcaggccctgatccagaaggacaccagtgatgtgcgctgcaccaacggggagccccctgtgtttgtgaagccagagaaggtggtgggcgtcatcggggccagcggcagctctgtgtccatcatggtggccaacatcctgcggctcttccagatcccccagatctcctatgccagcacagcccctgagctgagtgatgaccggcgctatgacttcttcagccgggtggtgcccccagacagcttccaggcccaggccatggtggacatcgtgaaggccctgggctggaactacgtgtccaccctggccagcgagggcagctatggagagaagggcgtggagagcttcacccagatcagcaaggaggccggcggcctgtgcatcgcccagagcgtgcgcatcccccaggagaggaaggacaggaccatcgactttgaccgcatcatcaagcagctgctggacacccccaacagcagagctgtggtgatctttgccaatgatgaggacatcaagcagatcctggccgccgccaagagagctgaccaggtgggccacttcctgtgggtgggcagtgacagctggggcagcaagatcaaccccctgcaccagcatgaagatattgctgagggcgccatcaccatccagcccaagagggccaccgtggagggctttgatgcctacttcaccagcaggaccctggagaacaacagaagaaatgtgtggtttgctgagtactgggaggagaacttcaactgcaagctgaccatcagcggcagcaagaaggaggacacagacagaaaatgtacaggccaggagcgcatcggcaaggacagcaactatgagcaggagggcaaggtgcagtttgtgattgatgctgtgtatgccatggcccacgccctgcaccacatgaacaaggacctgtgtgccgactacagaggagtgtgcccagagatggagcaggccggcggcaagaagctgctgaagtacatcagaaatgtgaacttcaacggcagcgctggcacccctgtgatgttcaacaagaatggagatgcccctggccgctatgacatcttccagtaccagaccaccaacaccagcaaccctggctaccgcctgattggccagtggacagatgagctgcagctgaacatcgaggacatgcagtggggcaaaggagtgcgggagatcccagcctctgtgtgcaccctgccctgcaagccaggccagaggaagaagacccagaagggcaccccctgctgctggacctgtgagccctgtgatggctaccagtaccagtttgatgagatgacctgccagcactgcccctatgaccagaggcccaatgaaaatagaacaggctgccaggacatccccatcatcaagctggagtggcacagcccctgggccgtcatccctgtgttcctggccatgctgggcatcatcgccaccatctttgtgatggccaccttcatccgctacaatgacacccccatcgtgcgggccagcggccgggagctgtcctatgtgctgctgaccggcatcttcctgtgctacatcatcaccttcctgatgattgccaagccagatgtggccgtgtgcagcttccggcgggtcttcctgggcctgggcatgtgcatctcctatgctgccctgctgaccaagaccaaccgcatctaccgcatctttgagcagggcaagaagtctgtgacagcccccaggctcatcagccccaccagccagctggccatcaccagcagcctcatctctgtgcagctgctgggcgtcttcatctggtttggagtggacccccccaacatcatcatcgactatgatgagcacaagaccatgaaccctgagcaggcccggggcgtgctgaagtgtgacatcacagacctgcagatcatctgcagcctgggctacagcatcctgctgatggtgacctgcaccgtgtatgccatcaagacccggggcgtgcctgagaacttcaatgaggccaagcccatcggcttcaccatgtacaccacctgcatcgtgtggctggccttcatccccatcttctttggaacagcccagagcgctgagaagctgtacatccagaccaccaccctgaccatctccatgaacctgagcgcctctgtggccctgggcatgctgtacatgcccaaggtgtacatcatcatcttccaccctgagctgaatgtgcagaagaggaagaggagcttcaaggctgtggtgacagctgccaccatgagcagccggctgagccacaagcccagcgaccggcccaatggagaggccaagacagagctgtgtgaaaatgtggaccccaacagcgagaagtgcaactgctactag

SEQ ID NO: 154007 - DNA, 2769 bp, Artificial Sequence; identical to SEQ ID NO: 153895
  Description of Artificial Sequence: Synthetic coding sequence

SEQ ID NO: 154008 - DNA, 2736 bp, Artificial Sequence
  Description of Artificial Sequence: Synthetic coding sequence
atggtgcagctgaggaagctgctgcgggtgctgaccctgatgaagttcccctgctgcgtgctggaggtgctgctgtgtgccctggccgctgctgcccggggccaggagatgtatgccccccacagcatcagaattgaaggagatgtgaccctgggcggcctcttccctgtgcacgccaagggccccagcggcgtgccctgtggggacatcaagagagaaaatggcatccaccggctggaggccatgctgtatgccctggaccagatcaacagcgaccccaacctgctgcccaacgtgaccctgggcgcccgcatcctggacacctgcagccgggacacctacgccctggagcagagcctgacctttgtgcaggccctgatccagaaggacaccagtgatgtgcgctgcaccaacggggagccccctgtgtttgtgaagccagagaaggtggtgggcgtcatcggggccagcggcagctctgtgtccatcatggtggccaacatcctgcggctcttccagatcccccagatctcctatgccagcacagcccctgagctgagtgatgaccggcgctatgacttcttcagccgggtggtgcccccagacagcttccaggcccaggccatggtggacatcgtgaaggccctgggctggaactacgtgtccaccctggccagcgagggcagctatggagagaagggcgtggagagcttcacccagatcagcaaggaggccggcggcctgtgcatcgcccagagcgtgcgcatcccccaggagaggaaggacaggaccatcgactttgaccgcatcatcaagcagctgctggacacccccaacagcagagctgtggtgatctttgccaatgatgaggacatcaagcagatcctggccgccgccaagagagctgaccaggtgggccacttcctgtgggtgggcagtgacagctggggcagcaagatcaaccccctgcaccagcatgaagatattgctgagggcgccatcaccatccagcccaagagggccaccgtggagggctttgatgcctacttcaccagcaggaccctggagaacaacagaagaaatgtgtggtttgctgagtactgggaggagaacttcaactgcaagctgaccatcagcggcagcaagaaggaggacacagacagaaaatgtacaggccaggagcgcatcggcaaggacagcaactatgagcaggagggcaaggtgcagtttgtgattgatgctgtgtatgccatggcccacgccctgcaccacatgaacaaggacctgtgtgccgactacagaggagtgtgcccagagatggagcaggccggcggcaagaagctgctgaagtacatcagaaatgtgaacttcaacggcagcgctggcacccctgtgatgttcaacaagaatggagatgcccctggccgctatgacatcttccagtaccagaccaccaacaccagcaaccctggctaccgcctgattggccagtggacagatgagctgcagctgaacatcgaggacatgcagtggggcaaaggagtgcgggagatcccagcctctgtgtgcaccctgccctgcaagccaggccagaggaagaagacccagaagggcaccccctgctgctggacctgtgagccctgtgatggctaccagtaccagtttgatgagatgacctgccagcactgcccctatgaccagaggcccaatgaaaatagaacaggctgccaggacatccccatcatcaagctggagtggcacagcccctgggccgtcatccctgtgttcctggccatgctgggcatcatcgccaccatctttgtgatggccaccttcatccgctacaatgacacccccatcgtgcgggccagcggccgggagctgtcctatgtgctgctgaccggcatcttcctgtgctacatcatcaccttcctgatgattgccaagccagatgtggccgtgtgcagcttccggcgggtcttcctgggcctgggcatgtgcatctcctatgctgccctgctgaccaagaccaaccgcatctaccgcatctttgagcagggcaagaagtctgtgacagcccccaggctcatcagccccaccagccagctggccatcaccagcagcctcatctctgtgcagctgctgggcgtcttcatctggtttggagtggacccccccaacatcatcatcgactatgatgagcacaagaccatgaaccctgagcaggcccggggcgtgctgaagtgtgacatcacagacctgcagatcatctgcagcctgggctacagcatcctgctgatggtgacctgcaccgtgtatgccatcaagacccggggcgtgcctgagaacttcaatgaggccaagcccatcggcttcaccatgtacaccacctgcatcgtgtggctggccttcatccccatcttctttggaacagcccagagcgctgagaagctgtacatccagaccaccaccctgaccatctccatgaacctgagcgcctctgtggccctgggcatgctgtacatgcccaaggtgtacatcatcatcttccaccctgagctgaatgtgcagaagaggaagaggagcttcaaggctgtggtgacagctgccaccatgagcagccggctgagccacaagcccagcgaccggcccaatggagaggccaagacagagctgtgtgaaaatgtggaccccaacatcaccagcgaggacctgagcctgcacaaggaggactag

SEQ ID NO: 154009 - DNA, 2475 bp, Artificial Sequence
  Description of Artificial Sequence: Synthetic coding sequence
atggtgcagctgaggaagctgctgcgggtgctgaccctgatgaagttcccctgctgcgtgctggaggtgctgctgtgtgccctggccgctgctgcccggggccaggagatgtatgccccccacagcatcagaattgaaggagatgtgaccctgggcggcctcttccctgtgcacgccaagggccccagcggcgtgccctgtggggacatcaagagagaaaatggcatccaccggctggaggccatgctgtatgccctggaccagatcaacagcgaccccaacctgctgcccaacgtgaccctgggcgcccgcatcctggacacctgcagccgggacacctacgccctggagcagagcctgacctttgtgcaggccctgatccagaaggacaccagtgatgtgcgctgcaccaacggggagccccctgtgtttgtgaagccagagaaggtggtgggcgtcatcggggccagcggcagctctgtgtccatcatggtggccaacatcctgcggctcttccagatcccccagatctcctatgccagcacagcccctgagctgagtgatgaccggcgctatgacttcttcagccgggtggtgcccccagacagcttccaggcccaggccatggtggacatcgtgaaggccctgggctggaactacgtgtccaccctggccagcgagggcagctatggagagaagggcgtggagagcttcacccagatcagcaaggaggccggcggcctgtgcatcgcccagagcgtgcgcatcccccaggagaggaaggacaggaccatcgactttgaccgcatcatcaagcagctgctggacacccccaacagcagagctgtggtgatctttgccaatgatgaggacatcaagcagatcctggccgccgccaagagagctgaccaggtgggccacttcctgtgggtgggcagtgacagctggggcagcaagatcaaccccctgcaccagcatgaagatattgctgagggcgccatcaccatccagcccaagagggccaccgtggagggctttgatgcctacttcaccagcaggaccctggagaacaacagaagaaatgtgtggtttgctgagtactgggaggagaacttcaactgcaagctgaccatcagcggcagcaagaaggaggacacagacagaaaatgtacaggccaggagcgcatcggcaaggacagcaactatgagcaggagggcaaggtgcagtttgtgattgatgctgtgtatgccatggcccacgccctgcaccacatgaacaaggacctgtgtgccgactacagaggagtgtgcccagagatggagcaggccggcggcaagaagctgctgaagtacatcagaaatgtgaacttcaatggagatgctggcacccctgtgatgttcaacaagaatggagatgcccctggccgctatgacatcttccagtaccagaccaccaacaccagcaaccctggctaccgcctgattggccagtggacagatgagctgcagctgaacatcgaggacatgcagtggggcaaaggagtgcgggagatcccagcctctgtgtgcaccctgccctgcaagccaggccagaggaagaagacccagaagggcaccccctgctgctggacctgtgagccctgtgatggctaccagtaccagtttgatgagatgacctgccagcactgcccctatgaccagaggcccaatgaaaatagaacaggctgccaggacatccccatcatcaagctggagtggcacagcccctgggccgtcatccctgtgttcctggccatgctgggcatcatcgccaccatctttgtgatggccaccttcatccgctacaatgacacccccatcgtgcgggccagcggccgggagctgtcctatgtgctgctgaccggcatcttcctgtgctacatcatcaccttcctgatgattgccaagccagatgtggccgtgtgcagcttccggcgggtcttcctgggcctgggcatgtgcatctcctatgctgccctgctgaccaagaccaaccgcatctaccgcatctttgagcagggcaagaagtctgtgacagcccccaggctcatcagccccaccagccagctggccatcaccagcagcctcatctctgtgcagctgctgggcgtcttcatctggtttggagtggacccccccaacatcatcatcgactatgatgagcacaagaccatgaaccctgagcaggcccggggcgtgctgaagtgtgacatcacagacctgcagatcatctgcagcctgggctacagcatcctgctgatggtgacctgcaccgtgtatgccatcaagacccggggcgtgcctgagaacttcaatgaggccaagcccatcggcttcaccatgtacaccacctgcatcgtgtggctggccttcatccccatcttctttggaacagcccagagcgctgagaaggtgatcctgtgctgcatctcctag

SEQ ID NO: 154010 - DNA, 2775 bp, Artificial Sequence
  Description of Artificial Sequence: Synthetic coding sequence
atggtgcagctgaggaagctgctgcgggtgctgaccctgatgaagttcccctgctgcgtgctggaggtgctgctgtgtgccctggccgctgctgcccggggccaggagatgtatgccccccacagcatcagaattgaaggagatgtgaccctgggcggcctcttccctgtgcacgccaagggccccagcggcgtgccctgtggggacatcaagagagaaaatggcatccaccggctggaggccatgctgtatgccctggaccagatcaacagcgaccccaacctgctgcccaacgtgaccctgggcgcccgcatcctggacacctgcagccgggacacctacgccctggagcagagcctgacctttgtgcaggccctgatccagaaggacaccagtgatgtgcgctgcaccaacggggagccccctgtgtttgtgaagccagagaaggtggtgggcgtcatcggggccagcggcagctctgtgtccatcatggtggccaacatcctgcggctcttccagatcccccagatctcctatgccagcacagcccctgagctgagtgatgaccggcgctatgacttcttcagccgggtggtgcccccagacagcttccaggcccaggccatggtggacatcgtgaaggccctgggctggaactacgtgtccaccctggccagcgagggcagctatggagagaagggcgtggagagcttcacccagatcagcaaggaggccggcggcctgtgcatcgcccagagcgtgcgcatcccccaggagaggaaggacaggaccatcgactttgaccgcatcatcaagcagctgctggacacccccaacagcagagctgtggtgatctttgccaatgatgaggacatcaagcagatcctggccgccgccaagagagctgaccaggtgggccacttcctgtgggtgggcagtgacagctggggcagcaagatcaaccccctgcaccagcatgaagatattgctgagggcgccatcaccatccagcccaagagggccaccgtggagggctttgatgcctacttcaccagcaggaccctggagaacaacagaagaaatgtgtggtttgctgagtactgggaggagaacttcaactgcaagctgaccatcagcggcagcaagaaggaggacacagacagaaaatgtacaggccaggagcgcatcggcaaggacagcaactatgagcaggagggcaaggtgcagtttgtgattgatgctgtgtatgccatggcccacgccctgcaccacatgaacaaggacctgtgtgccgactacagaggagtgtgcccagagatggagcaggccggcggcaagaagctgctgaagtacatcagaaatgtgaacttcaacggcagcgctggcacccctgtgatgttcaacaagaatggagatgcccctggccgctatgacatcttccagtaccagaccaccaacaccagcaaccctggctaccgcctgattggccagtggacagatgagctgcagctgaacatcgaggacatgcagtggggcaaaggagtgcgggagatcccagcctctgtgtgcaccctgccctgcaagccaggccagaggaagaagacccagaagggcaccccctgctgctggacctgtgagccctgtgatggctaccagtaccagtttgatgagatgacctgccagcactgcccctatgaccagaggcccaatgaaaatagaacaggctgccaggacatccccatcatcaagctggagtggcacagcccctgggccgtcatccctgtgttcctggccatgctgggcatcatcgccaccatctttgtgatggccaccttcatccgctacaatgacacccccatcgtgcgggccagcggccgggagctgtcctatgtgctgctgaccggcatcttcctgtgctacatcatcaccttcctgatgattgccaagccagatgtggccgtgtgcagcttccggcgggtcttcctgggcctgggcatgtgcatctcctatgctgccctgctgaccaagaccaaccgcatctaccgcatctttgagcagggcaagaagtctgtgacagcccccaggctcatcagccccaccagccagctggccatcaccagcagcctcatctctgtgcagctgctgggcgtcttcatctggtttggagtggacccccccaacatcatcatcgactatgatgagcacaagaccatgaaccctgagcaggcccggggcgtgctgaagtgtgacatcacagacctgcagatcatctgcagcctgggctacagcatcctgctgatggtgacctgcaccgtgtatgccatcaagacccggggcgtgcctgagaacttcaatgaggccaagcccatcggcttcaccatgtacaccacctgcatcgtgtggctggccttcatccccatcttctttggaacagcccagagcgctgagaagctgtacatccagaccaccaccctgaccatctccatgaacctgagcgcctctgtggccctgggcatgctgtacatgcccaaggtgtacatcatcatcttccaccctgagctgaatgtgcagaagaggaagaggagcttcaaggctgtggtgacagctgccaccatgagcagccggctgagccacaagcccagcgaccggcccaatggagaggccaagacagagctgtgtgaaaatgtggaccccaacatcttcttcttcggctgcaccgtggagctgggcctgcacttcaagctgaccttcagcaggaaccagagcaacctgtag

SEQ ID NO: 154011 - DNA, 2727 bp, Artificial Sequence
  Description of Artificial Sequence: Synthetic coding sequence
atggtgtgtgagggcaagaggtctgccagctgcccctgcttcttcctgctgacagccaagttctactggatcctgaccatgatgcagaggacccacagccaggagtatgcccacagcatccgggtggatggagacatcatcctgggcggcctcttccctgtgcacgccaagggggagcggggcgtgccctgtggggagctgaagaaggagaagggcatccaccggctggaggccatgctgtatgccatcgaccagatcaacaaggaccctgacctgctgagcaacatcaccctgggcgtgcgcatcctggacacctgcagccgggacacctacgccctggagcagagcctgacctttgtgcaggccctgattgagaaggatgccagtgatgtgaagtgtgccaatggagacccccccatcttcaccaagccagacaagatcagcggcgtgattggagctgctgccagctctgtgtccatcatggtggccaacatcctgcggctcttcaagatcccccagatctcctatgccagcacagcccctgagctgagtgacaacaccaggtatgacttcttcagccgggtggtgcccccagacagctaccaggcccaggccatggtggacatcgtgacagccctgggctggaactacgtgtccaccctggccagcgagggcaactatggagagagcggcgtggaggccttcacccagatcagccgggagatcggcggcgtgtgcatcgcccagagccagaagatcccccgggagcccaggcctggagaatttgagaagatcatcaagaggctgctggagaccccaaatgcccgggctgtgatcatgtttgccaatgaagatgacatccgccgcatcctggaggccgccaagaagctgaaccagagcggccacttcctgtggattggaagtgacagctggggcagcaagatcgcccctgtgtaccagcaggaggagattgctgagggcgctgtgaccatcctgcccaagagggccagcattgatggctttgaccgctacttccgcagcaggaccctggccaacaacagaagaaatgtgtggtttgctgagttctgggaggagaactttggctgcaagctgggcagccacggcaagaggaacagccacatcaagaagtgcaccggcctggagcgcatcgcccgggacagcagctatgagcaggagggcaaggtgcagtttgtgattgatgctgtgtacagcatggcctatgccctgcacaacatgcacaaggacctgtgccccggctacatcggcctgtgccccaggatgagcaccattgatggcaaggagctgctgggctacatccgggctgtgaacttcaacggcagcgctggcacccctgtgaccttcaatgaaaatggagatgcccctggccgctatgacatcttccagtaccagatcaccaacaagagcacagagtacaaggtgattggccactggaccaaccagctgcacctgaaggtggaggacatgcagtgggcccaccgggagcacacccacccagcctctgtgtgcagcctgccctgcaagccaggagagaggaagaagacagtgaagggcgtgccctgctgctggcactgtgagcgctgtgagggctacaactaccaggtggatgagctgagctgtgagctgtgccccctggaccagaggcccaacatgaacagaacaggctgccagctgatccccatcatcaagctggagtggcacagcccctgggccgtggtgcctgtgtttgtggccatcctgggcatcatcgccaccaccttcgtcatcgtgacctttgtgcgctacaatgacacccccatcgtgcgggccagcggccgggagctgtcctatgtgctgctgaccggcatcttcctgtgctacagcatcaccttcctgatgattgctgccccagacaccatcatctgcagcttcagaagagtcttcctgggcctgggcatgtgcttctcctatgctgccctgctgaccaagaccaaccgcatccaccgcatctttgagcagggcaagaagtctgtgacagcccccaagttcatcagccctgccagccagctggtgatcaccttcagcctcatctctgtgcagctgctgggcgtgtttgtgtggtttgtggtggaccccccccacatcatcattgattatggagagcagaggaccctggaccctgagaaggcccggggcgtgctgaagtgtgacatcagtgacctgagcctcatctgcagcctgggctacagcatcctgctgatggtgacctgcaccgtgtatgccatcaagacccggggcgtgcctgagaccttcaatgaggccaagcccatcggcttcaccatgtacaccacctgcatcatctggctggccttcatccccatcttcttcggcacagcccagagcgctgagaagatgtacatccagaccaccaccctgactgtgtccatgagcctgagcgcctctgtgtccctgggcatgctgtacatgcccaaggtgtacatcatcatcttccaccctgagcagaatgtgcagaagaggaagaggagcttcaaggctgtggtgacagctgccaccatgcagagcaagctgatccagaagggaaatgaccggcccaacggggaggtgaagtctgagctgtgtgagagcctggagaccaacaccagcagcaccaagaccacctacatctcctacagcaaccacagcatctag

SEQ ID NO: 154012 - DNA, 2727 bp, Artificial Sequence
  Description of Artificial Sequence: Synthetic coding sequence
atggtgtgtgagggcaagaggtctgccagctgcccctgcttcttcctgctgacagccaagttctactggatcctgaccatgatgcagaggacccacagccaggagtatgcccacagcatccgggtggatggagacatcatcctgggcggcctcttccctgtgcacgccaagggggagcggggcgtgccctgtggggagctgaagaaggagaagggcatccaccggctggaggccatgctgtatgccatcgaccagatcaacaaggaccctgacctgctgagcaacatcaccctgggcgtgcgcatcctggacacctgcagccgggacacctacgccctggagcagagcctgacctttgtgcaggccctgattgagaaggatgccagtgatgtgaagtgtgccaatggagacccccccatcttcaccaagccagacaagatcagcggcgtgattggagctgctgccagctctgtgtccatcatggtggccaacatcctgcggctcttcaagatcccccagatctcctatgccagcacagcccctgagctgagtgacaacaccaggtatgacttcttcagccgggtggtgcccccagacagctaccaggcccaggccatggtggacatcgtgacagccctgggctggaactacgtgtccaccctggccagcgagggcaactatggagagagcggcgtggaggccttcacccagatcagccgggagatcggcggcgtgtgcatcgcccagagccagaagatcccccgggagcccaggcctggagaatttgagaagatcatcaagaggctgctggagaccccaaatgcccgggctgtgatcatgtttgccaatgaagatgacatccgccgcatcctggaggccgccaagaagctgaaccagagcggccacttcctgtggattggaagtgacagctggggcagcaagatcgcccctgtgtaccagcaggaggagattgctgagggcgctgtgaccatcctgcccaagagggccagcattgatggctttgaccgctacttccgcagcaggaccctggccaacaacagaagaaatgtgtggtttgctgagttctgggaggagaactttggctgcaagctgggcagccacggcaagaggaacagccacatcaagaagtgcaccggcctggagcgcatcgcccgggacagcagctatgagcaggagggcaaggtgcagtttgtgattgatgctgtgtacagcatggcctatgccctgcacaacatgcacaaggacctgtgccccggctacatcggcctgtgccccaggatgagcaccattgatggcaaggagctgctgggctacatccgggctgtgaacttcaacggcagcgctggcacccctgtgaccttcaatgaaaatggagatgcccctggccgctatgacatcttccagtaccagatcaccaacaagagcacagagtacaaggtgattggccactggaccaaccagctgcacctgaaggtggaggacatgcagtgggcccaccgggagcacacccacccagcctctgtgtgcagcctgccctgcaagccaggagagaggaagaagacagtgaagggcgtgccctgctgctggcactgtgagcgctgtgagggctacaactaccaggtggatgagctgagctgtgagctgtgccccctggaccagaggcccaacatgaacagaacaggctgccagctgatccccatcatcaagctggagtggcacagcccctgggccgtggtgcctgtgtttgtggccatcctgggcatcatcgccaccaccttcgtcatcgtgacctttgtgcgctacaatgacacccccatcgtgcgggccagcggccgggagctgtcctatgtgctgctgaccggcatcttcctgtgctacagcatcaccttcctgatgattgctgccccagacaccatcatctgcagcttcagaagagtcttcctgggcctgggcatgtgcttctcctatgctgccctgctgaccaagaccaaccgcatccaccgcatctttgagcagggcaagaagtctgtgacagcccccaagttcatcagccctgccagccagctggtgatcaccttcagcctcatctctgtgcagctgctgggcgtgtttgtgtggtttgtggtggaccccccccacatcatcattgattatggagagcagaggaccctggaccctgagaaggcccggggcgtgctgaagtgtgacatcagtgacctgagcctcatctgcagcctgggctacagcatcctgctgatggtgacctgcaccgtgtatgccatcaagacccggggcgtgcctgagaccttcaatgaggccaagcccatcggcttcaccatgtacaccacctgcatcatctggctggccttcatccccatcttcttcggcacagcccagagcgctgagaagatgtacatccagaccaccaccctgactgtgtccatgagcctgagcgcctctgtgtccctgggcatgctgtacatgcccaaggtgtacatcatcatcttccaccctgagcagaatgtgcagaagaggaagaggagcttcaaggctgtggtgacagctgccaccatgcagagcaagctgatccagaagggaaatgaccggcccaacggggaggtgaagtctgagctgtgtgagagcctggagaccaacagcaagagctctgtggagttccccatggtgaagagcggcagcaccagctag

SEQ ID NO: 154013 - DNA, 1506 bp, Artificial Sequence
  Description of Artificial Sequence: Synthetic coding sequence
atggtgtgtgagggcaagaggtctgccagctgcccctgcttcttcctgctgacagccaagttctactggatcctgaccatgatgcagaggacccacagccaggagtatgcccacagcatccgggtggatggagacatcatcctgggcggcctcttccctgtgcacgccaagggggagcggggcgtgccctgtggggagctgaagaaggagaagggcatccaccggctggaggccatgctgtatgccatcgaccagatcaacaaggaccctgacctgctgagcaacatcaccctgggcgtgcgcatcctggacacctgcagccgggacacctacgccctggagcagagcctgacctttgtgcaggccctgattgagaaggatgccagtgatgtgaagtgtgccaatggagacccccccatcttcaccaagccagacaagatcagcggcgtgattggagctgctgccagctctgtgtccatcatggtggccaacatcctgcggctcttcaagatcccccagatctcctatgccagcacagcccctgagctgagtgacaacaccaggtatgacttcttcagccgggtggtgcccccagacagctaccaggcccaggccatggtggacatcgtgacagccctgggctggaactacgtgtccaccctggccagcgagggcaactatggagagagcggcgtggaggccttcacccagatcagccgggagatcggcggcgtgtgcatcgcccagagccagaagatcccccgggagcccaggcctggagaatttgagaagatcatcaagaggctgctggagaccccaaatgcccgggctgtgatcatgtttgccaatgaagatgacatccgccgcatcctggaggccgccaagaagctgaaccagagcggccacttcctgtggattggaagtgacagctggggcagcaagatcgcccctgtgtaccagcaggaggagattgctgagggcgctgtgaccatcctgcccaagagggccagcattgatggctttgaccgctacttccgcagcaggaccctggccaacaacagaagaaatgtgtggtttgctgagttctgggaggagaactttggctgcaagctgggcagccacggcaagaggaacagccacatcaagaagtgcaccggcctggagcgcatcgcccgggacagcagctatgagcaggagggcaaggtgcagtttgtgattgatgctgtgtacagcatggcctatgccctgcacaacatgcacaaggacctgtgccccggctacatcggcctgtgccccaggatgagcaccattgatggcaaggagctgctgggctacatccgggctgtgaacttcaacggctgcagaagaggcatccagatgagcctgccctggcccaccctcttcacccccagcttcagcagctcctgggccgtgctggccctgctgagcctgctgatgaagacagagatgctgctggatgtgatgatcagcagcagcatcaagtag

SEQ ID NO: 154014 - DNA, 63 bp, Artificial Sequence
  Description of Artificial Sequence: Synthetic coding sequence
atggtgtgtgagggcaagaggtctgccagctgcccctgcttcttcctgctgacagccaagtag

SEQ ID NO: 154015 - DNA, 2727 bp, Artificial Sequence; identical to SEQ ID NO: 154011
  Description of Artificial Sequence: Synthetic coding sequence

SEQ ID NO: 154016 - DNA, 885 bp, Artificial Sequence
  Description of Artificial Sequence: Synthetic coding sequence
atggtgtgtgagggcaagaggtctgccagctgcccctgcttcttcctgctgacagccaagttctactggatcctgaccatgatgcagaggacccacagccaggagtatgcccacagcatccgggtggatggagacatcatcctgggcggcctcttccctgtgcacgccaagggggagcggggcgtgccctgtggggagctgaagaaggagaagggcatccaccggctggaggccatgctgtatgccatcgaccagatcaacaaggaccctgacctgctgagcaacatcaccctgggcgtgcgcatcctggacacctgcagccgggacacctacgccctggagcagagcctgacctttgtgcaggccctgattgagaaggatgccagtgatgtgaagtgtgccaatggagacccccccatcttcaccaagccagacaagatcagcggcgtgattggagctgctgccagctctgtgtccatcatggtggccaacatcctgcggctcttcaagatcccccagatctcctatgccagcacagcccctgagctgagtgacaacaccaggtatgacttcttcagccgggtggtgcccccagacagctaccaggcccaggccatggtggacatcgtgacagccctgggctggaactacgtgtccaccctggccagcgagggcaactatggagagagcggcgtggaggccttcacccagatcagccgggagatcggcggcgtgtgcatcgcccagagccagaagatcccccgggagcccaggcctggagaatttgagaagatcatcaagaggctgctggagaccccaaatgcccgggctgtgatcatgtttgccaatgaagatgacatccgccgcatcctggaggccgcctag

SEQ ID NO: 154017 - DNA, 1122 bp, Artificial Sequence
  Description of Artificial Sequence: Synthetic coding sequence
atgaccaccagcgccagcagccacctgaacaagggcatcaagcaggtgtacatgagcctgccccagggcgagaaggtgcaggccatgtacatctggattgatggcaccggggagggcctgcgctgcaagaccaggaccctggacagcgagcccaagtgtgtggaggagctgcctgagtggaactttgatggcagcagcaccctgcagagcgagggcagcaacagcgacatgtacctggtgcctgctgccatgttccgggaccccttcaggaaggaccccaacaagctggtgctgtgtgaggtgttcaagtacaacagaagacctgctgagaccaacctgcggcacacctgcaagaggatcatggacatggtgagcaaccagcacccctggtttggcatggagcaggagtacaccctgatgggcacagatggccaccccttcggctggcccagcaatggcttccctggcccccagggcccctactactgcggcgtgggcgctgaccgggcctacggccgggacatcgtggaggcccactaccgggcctgcctgtatgctggggtgaagattgctggcaccaatgctgaggtgatgcctgcccagtgggagttccagatcggcccctgtgagggcatctccatgggagaccacctgtgggtggcccgcttcatcctgcaccgggtgtgtgaggactttggagtgattgccacctttgaccccaagcccatccctggcaactggaatggagctggctgccacaccaacttcagcaccaaggccatgagggaggagaatggcctgaagtacatcgaggaggccatcgagaagctgagcaagaggcaccagtaccacatccgggcctatgaccccaagggcggcctggacaatgcccggcggctgaccggcttccacgagaccagcaacatcaatgacttctctgctggggtggccaacagaagtgccagcatccgcatccccaggacagtgggccaggagaagaagggctactttgaggaccggcggcccagcgccaactgtgaccccttctctgtgacagaggccctgatccgcacctgcctgctgaatgaaacaggagatgagcccttccagtacaagaactag

SEQ ID NO: 154018 - DNA, 1122 bp, Artificial Sequence; identical to SEQ ID NO: 154017
  Description of Artificial Sequence: Synthetic coding sequence

SEQ ID NO: 154019 - DNA, 1122 bp, Artificial Sequence; identical to SEQ ID NO: 154017
  Description of Artificial Sequence: Synthetic coding sequence

SEQ ID NO: 154020 - DNA, 1122 bp, Artificial Sequence; identical to SEQ ID NO: 154017
  Description of Artificial Sequence: Synthetic coding sequence

SEQ ID NO: 154021 - DNA, 702 bp, Artificial Sequence
  Description of Artificial Sequence: Synthetic coding sequence
atgaccaccagcgccagcagccacctgaacaagggcatcaagcaggtgtacatgagcctgccccagggcgagaaggtgcaggccatgtacatctggattgatggcaccggggagggcctgcgctgcaagaccaggaccctggacagcgagcccaagtgtgtggaggagctgcctgagtggaactttgatggcagcagcaccctgcagagcgagggcagcaacagcgacatgtacctggtgcctgctgccatgttccgggaccccttcaggaaggaccccaacaagctggtgctgtgtgaggtgttcaagtacaacagaagacctgctgagaccaacctgcggcacacctgcaagaggatcatggacatggtgagcaaccagcacccctggtttggcatggagcaggagtacaccctgatgggcacagatggccaccccttcggctggcccagcaatggcttccagggcccccgggtgcacatcaccgtggtgtgggagcagacagagcccatggccggcacctcctggaggcccatcaccggccctgcctgcatgctggagagccggctgcggggcctgatgcccaggagctgcctgcccagcggcaacttccggctggacctggtgaaggagagcgcctgggagatcatcagcggctggcctgtgagcagctgcatcgtgtgtgtgaagaccctggagtag

SEQ ID NO: 154022 - DNA, 678 bp, Artificial Sequence
  Description of Artificial Sequence: Synthetic coding sequence
atggaccagcaggccatctatgcagagctgaacctgcccacagacagcggccctgagagcagcagccccagcagcctgcccagagatgtgtgccagggcagcccctggcaccagtttgccctgaagctgagctgtgccggcatcatcctgctggtgctggtggtgacaggcctgtctgtgtctgtgaccagcctcatccagaagagcagcattgaaaaatgttctgtggacatccagcagagcaggaacaagaccacagagaggcctggcctgctgaactgccccatctactggcagcagctgcgggagaagtgcctgctcttcagccacacagtgaacccctggaacaacagcctggccgactgcagcaccaaggagagcagcctgctgctgatccgggacaaggatgagctgatccacacccagaacctgatccgggacaaggccatcctcttctggattggcctgaacttcagcctgtctgagaagaactggaagtggatcaatggcagcttcctgaacagcaatgacctggagatcagaggagatgccaaggagaacagctgcatcagcatcagccagacctctgtgtacagcgagtactgcagcacagagatccgctggatctgccagaaggagctgacccctgtgaggaacaaggtgtacccagacagctag

SEQ ID NO: 154023 - DNA, 825 bp, Artificial Sequence
  Description of Artificial Sequence: Synthetic coding sequence
atgggcacagacagcagagctgccaaggccctgctggcccgggcccggaccctgcacctgcagacaggcaacctgctgaactggggccgcctgaggaagaagtgccccagcacccacagcgaggagctgcatgactgcatccagaagaccctgaatgagtggagcagccagatcaacccagacctggtgcgggagttcccagatgtgctggagtgcaccgtgtcccatgctgtggagaagatcaacccagatgagcgggaggagatgaaggtgtctgccaagctgttcatcgtggagagcaacagcagcagcagcaccaggtctgctgtggacatggcctgcagcgtgctgggcgtggcccagctggacagcgtcatcatcgccagcccccccattgaagatggagtgaacctgagcctggagcacctgcagccctactgggaggagctggagaacctggtgcagagcaagaagatcgtggccatcggcaccagtgacctggacaagacccagctggagcagctgtaccagtgggcccaggtgaagcccaacagcaaccaggtgaacctggccagctgctgcgtgatgcccccagacctgacagcctttgccaagcagtttgacatccagctgctgacccacaatgaccccaaggagctgctgtctgaggccagcttccaggaggccctgcaggagagcatcccagacatccaggcccacgagtgggtgcccctgtggctgctgcgctacagcgtgattgtgaagagccggggcatcatcaagagcaagggctacatcctgcaggccaagagaagaggcagctag

SEQ ID NO: 154024 - DNA, 1341 bp, Artificial Sequence
  Description of Artificial Sequence: Synthetic coding sequence
atggccgccaggaaaggaagaagaaggacctgtgaaacaggagagcccatggaggccgagagcggggacaccagcagcgagggccctgcccaggtgtacctgcccggccggggcccccccctgcgggagggggaggagctggtgatggatgaggaggcctacgtgctgtaccaccgggcccagacaggagccccctgcctgagctttgatattgtgcgggaccacctgggggacaacagaacagagctgcccctgaccctgtacctgtgtgccggcacccaggccgagagcgcccagagcaaccggctgatgatgctgaggatgcacaacctgcacggcaccaagcccccaccttctgagggcagtgatgaggaggaggaggaggaggatgaggaggatgaggaggagaggaagccccagctggagctggccatggtgccccactatggaggcatcaacagagtgcgggtgtcctggctgggggaggagcctgtggccggcgtgtggagcgagaagggccaggtggaggtgtttgccctgcggcggctgctgcaggtggtggaggagccccaggccctggccgccttcctgagagatgagcaggcccagatgaagcccatcttctcctttgctggccacatgggagagggctttgccctggactggagcccccgggtgacaggccgcctgctgaccggggactgccagaagaacatccacctgtggacccccacagatggcggctcctggcacgtggaccagaggccctttgtgggccacaccaggtctgtggaggacctgcagtggagccccacagaaaatacagtgtttgccagctgcagcgcagatgccagcatccgcatctgggacatccgggccgcccccagcaaggcctgcatgctgaccacagccacagcccatgatggagatgtgaatgtcatctcctggagccggcgggagcccttcctgctgtctggaggagatgatggagccctgaagatctgggacctgcggcagttcaagagcggcagccctgtggccaccttcaagcagcacgtggcccctgtgacctctgtggagtggcacccccaggacagcggcgtgtttgctgccagcggggctgaccaccagatcacccagtgggacctggccgtggagcgggaccctgaggccggagatgtggaggccgaccccggcctggccgacctgccccagcagctgctgtttgtgcaccagggcgagacagagctgaaggagctgcactggcacccccagtgccccggcctgctggtgtccacagccctgagcggcttcaccatcttccgcaccatctctgtgtag

SEQ ID NO: 154025 - DNA, 1572 bp, Artificial Sequence
  Description of Artificial Sequence: Synthetic coding sequence
atgcagagagctgctgccctggtgagaagaggctgcggccccaggacccccagctcctggggccgcagccagagcagcgctgctgctgaggccagcgctgtgctgaaggtgcggcctgagaggagcagaagagagcgcatcctgaccctggagagcatgaacccccaggtgaaggctgtggagtatgctgtgcggggccccatcgtgctgaaggccggggagattgagctggagctgcagaggggcatcaagaagcccttcacagaggtgatccgggccaacattggagatgcccaggccatgggccagcagcccatcaccttcctgcggcaggtgatggccctgtgcacctaccccaacctgctggacagccccagcttcccagaagatgccaagaagagggcccggcgcatcctgcaggcctgtggcggcaacagcctgggcagctacagcgccagccagggcgtgaactgcatcagagaagatgtggccgcctacatcaccaggagagatggaggagtgcctgctgaccctgacaacatctacctgaccactggagccagtgatggcatcagcaccatcctgaagatcctggtgtctgggggcggcaagagcaggactggagtgatgatccccatcccccagtaccccctgtacagcgctgtgatcagcgagctggatgccatccaggtgaactactacctggatgaggagaactgctgggccctgaatgtgaatgagctgcggcgggctgtgcaggaggccaaggaccactgtgaccccaaggtgctgtgcatcatcaaccctggcaaccccaccggccaggtgcagagcaggaagtgcattgaagatgtgatccactttgcctgggaggagaagctgttcctgctggctgatgaggtgtaccaggacaacgtgtacagcccagactgccgcttccacagcttcaagaaggtgctgtatgagatgggccctgagtacagcagcaatgtggagctggccagcttccacagcaccagcaagggctacatgggagaatgtggctacagaggaggctacatggaggtgatcaacctgcaccctgagatcaagggccagctggtgaagctgctgtctgtgcggctgtgcccccctgtgtctggccaggccgccatggacatcgtggtgaacccccctgtggccggggaggagagctttgagcagttcagccgggagaaggagagcgtgctgggcaacctggccaagaaggccaagctgacagaagatctcttcaaccaggtgcccggcatccactgcaaccccctgcagggcgccatgtatgccttcccccgcatcttcatcccagccaaggctgtggaggccgcccaggcccaccagatggccccagacatgttctactgcatgaagctgctggaggagaccggcatctgtgtggtgcccggcagcggcttcggccagcgggagggcacctaccacttcaggatgaccatcctgccccctgtggagaagctgaagacagtgctgcagaaggtgaaggacttccacatcaacttcctggagaagtatgcctag

SEQ ID NO: 154026 - DNA, 1272 bp, Artificial Sequence
  Description of Artificial Sequence: Synthetic coding sequence
atgggccagcagcccatcaccttcctgcggcaggtgatggccctgtgcacctaccccaacctgctggacagccccagcttcccagaagatgccaagaagagggcccggcgcatcctgcaggcctgtggcggcaacagcctgggcagctacagcgccagccagggcgtgaactgcatcagagaagatgtggccgcctacatcaccaggagagatggaggagtgcctgctgaccctgacaacatctacctgaccactggagccagtgatggcatcagcaccatcctgaagatcctggtgtctgggggcggcaagagcaggactggagtgatgatccccatcccccagtaccccctgtacagcgctgtgatcagcgagctggatgccatccaggtgaactactacctggatgaggagaactgctgggccctgaatgtgaatgagctgcggcgggctgtgcaggaggccaaggaccactgtgaccccaaggtgctgtgcatcatcaaccctggcaaccccaccggccaggtgcagagcaggaagtgcattgaagatgtgatccactttgcctgggaggagaagctgttcctgctggctgatgaggtgtaccaggacaacgtgtacagcccagactgccgcttccacagcttcaagaaggtgctgtatgagatgggccctgagtacagcagcaatgtggagctggccagcttccacagcaccagcaagggctacatgggagaatgtggctacagaggaggctacatggaggtgatcaacctgcaccctgagatcaagggccagctggtgaagctgctgtctgtgcggctgtgcccccctgtgtctggccaggccgccatggacatcgtggtgaacccccctgtggccggggaggagagctttgagcagttcagccgggagaaggagagcgtgctgggcaacctggccaagaaggccaagctgacagaagatctcttcaaccaggtgcccggcatccactgcaaccccctgcagggcgccatgtatgccttcccccgcatcttcatcccagccaaggctgtggaggccgcccaggcccaccagatggccccagacatgttctactgcatgaagctgctggaggagaccggcatctgtgtggtgcccggcagcggcttcggccagcgggagggcacctaccacttcaggatgaccatcctgccccctgtggagaagctgaagacagtgctgcagaaggtgaaggacttccacatcaacttcctggagaagtatgcctag

SEQ ID NO: 154027 - DNA, 1242 bp, Artificial Sequence
  Description of Artificial Sequence: Synthetic coding sequence
atggcccctccttctgtgtttgctgaggtgccccaggcccagcctgtgctggtgttcaagctgacagctgacttcagagaagatcctgaccccaggaaggtgaacctgggcgtgggcgcctacagaacagatgactgccacccctgggtgctgcctgtggtgaagaaggtggagcagaagatcgccaatgacaacagcctgaaccacgagtacctgcccatcctgggcctggccgagttccgcagctgtgccagccggctggccctgggagatgacagccctgccctgaaggagaagagggtgggcggcgtgcagagcctgggcggcaccggggccctgagaattggagctgacttcctggcccgctggtacaacggcaccaacaacaagaacacccctgtgtatgtgagcagccccacctgggagaaccacaatgctgtgttttctgctgctggcttcaaggacatccgcagctaccgctactgggatgctgagaagaggggcctggacctgcagggcttcctgaatgacctggagaatgcccctgagttcagcatcgtggtgctgcacgcctgtgcccacaaccccactggaattgaccccaccccagagcagtggaagcagatcgcctctgtgatgaagcaccgcttcctgttccccttctttgacagcgcctaccagggctttgccagcggcaacctggagagagatgcctgggccatccgctactttgtgtctgagggctttgagttcttctgtgcccagagcttcagcaagaactttggcctgtacaatgaaagagtgggcaacctgactgtggtgggcaaggagcctgagagcatcctgcaggtgctgagccagatggagaagatcgtgcgcatcacctggagcaaccccccagcccagggcgcccgcatcgtggccagcaccctgagcaaccctgagctgtttgaggagtggacaggaaatgtgaagaccatggctgaccgcatcctgaccatgaggtctgagctgcgggcccggctggaggccctgaagaccccaggcacctggaaccacatcacagaccagatcggcatgttctccttcaccggcctgaaccccaagcaggtggagtacctggtgaatgagaagcacatctacctgctgcccagcggccgcatcaacgtgtctggcctgaccaccaagaacctggactatgtggccaccagcatccacgaggccgtgaccaagatccagtag

SEQ ID NO: 154028 - DNA, 1101 bp, Artificial Sequence
  Description of Artificial Sequence: Synthetic coding sequence
atggcccctccttctgtgtttgctgaggtgccccaggcccagcctgtgctggtgttcaagctgacagctgacttcagagaagatcctgaccccaggaaggtgaacctgggcgtgggcgcctacagaacagatgacagccctgccctgaaggagaagagggtgggcggcgtgcagagcctgggcggcactggagccctgcgcatcggggctgacttcctggcccgctggtacaacggcaccaacaacaagaacacccctgtgtatgtgagcagccccacctgggagaaccacaatgctgtgttttctgctgctggcttcaaggacatccgcagctaccgctactgggatgctgagaagaggggcctggacctgcagggcttcctgaatgacctggagaatgcccctgagttcagcatcgtggtgctgcacgcctgtgcccacaaccccaccggcatcgaccccaccccagagcagtggaagcagatcgcctctgtgatgaagcaccgcttcctgttccccttctttgattctgcctaccagggctttgccagcggcaacctggagagagatgcctgggccatccgctactttgtgtctgagggctttgagttcttctgtgcccagagcttcagcaagaactttggcctgtacaatgaaagagtgggcaacctgactgtggtgggcaaggagcctgagagcatcctgcaggtgctgagccagatggagaagatcgtgcgcatcacctggagcaaccccccagcccagggcgccagaattgtggccagcaccctgagcaaccctgagctgtttgaggagtggacaggaaatgtgaagaccatggctgaccgcatcctgaccatgaggtctgagctgcgggcccggctggaggccctgaagaccccaggcacctggaaccacatcacagaccagatcggcatgttctccttcaccggcctgaaccccaagcaggtggagtacctggtgaatgagaagcacatctacctgctgcccagcggccgcatcaacgtgtctggcctgaccaccaagaacctggactatgtggccaccagcatccatgaagctgtgaccaagatccagtag

SEQ ID NO: 154029 - DNA, 1179 bp, Artificial Sequence
  Description of Artificial Sequence: Synthetic coding sequence
atgcaggtgtggagcccctggaagggggccatgtgcccccggccccacaagccagcctacagaacagatgactgccacccctgggtgctgcctgtggtgaagaaggtggagcagaagatcgccaatgacaacagcctgaaccacgagtacctgcccatcctgggcctggccgagttccgcagctgtgccagccggctggccctgggagatgacagccctgccctgaaggagaagagggtgggcggcgtgcagagcctgggcggcactggagccctgcgcatcggggctgacttcctggcccgctggtacaacggcaccaacaacaagaacacccctgtgtatgtgagcagccccacctgggagaaccacaatgctgtgttttctgctgctggcttcaaggacatccgcagctaccgctactgggatgctgagaagaggggcctggacctgcagggcttcctgaatgacctggagaatgcccctgagttcagcatcgtggtgctgcacgcctgtgcccacaaccccaccggcatcgaccccaccccagagcagtggaagcagatcgcctctgtgatgaagcaccgcttcctgttccccttctttgattctgcctaccagggctttgccagcggcaacctggagagagatgcctgggccatccgctactttgtgtctgagggctttgagttcttctgtgcccagagcttcagcaagaactttggcctgtacaatgaaagagtgggcaacctgactgtggtgggcaaggagcctgagagcatcctgcaggtgctgagccagatggagaagatcgtgcgcatcacctggagcaaccccccagcccagggcgccagaattgtggccagcaccctgagcaaccctgagctgtttgaggagtggacaggaaatgtgaagaccatggctgaccgcatcctgaccatgaggtctgagctgcgggcccggctggaggccctgaagaccccaggcacctggaaccacatcacagaccagatcggcatgttctccttcaccggcctgaaccccaagcaggtggagtacctggtgaatgagaagcacatctacctgctgcccagcggccgcatcaacgtgtctggcctgaccaccaagaacctggactatgtggccaccagcatccatgaagctgtgaccaagatccagtag

SEQ ID NO: 154030 - DNA, 1293 bp, Artificial Sequence
  Description of Artificial Sequence: Synthetic coding sequence
atggccctgctgcacagcggccgggtgctgcccggcattgctgctgccttccaccctggcctggccgccgccgccagcgcccgggccagctcctggtggacccacgtggagatgggccccccagaccccatcctgggcgtgacagaggccttcaagagggacaccaacagcaagaagatgaacctgggcgtgggcgcctacagagatgacaatggcaagccctacgtgctgcccagcgtgaggaaggccgaggcccagattgctgccaagaacctggacaaggagtacctgcccatcggcggcctggccgagttctgcaaggccagcgctgagctggccctgggggagaacagcgaggtgctgaagagcggccgctttgtgacagtgcagaccatctctggaactggagccctgcgcatcggggccagcttcctgcagcgcttcttcaagttcagcagagatgtgttcctgcccaagcccacctggggcaaccacacccccatcttcagagatgctggcatgcagctgcagggctaccgctactatgaccccaagacctgtggctttgacttcaccggggctgtggaggacatcagcaagatccctgagcagagcgtgctgctgctgcacgcctgtgcccacaaccccactggagtggaccccaggcctgagcagtggaaggagatcgccaccgtggtgaagaagaggaacctgtttgccttctttgacatggcctaccagggctttgccagcggagatggagacaaggatgcctgggccgtgcgccacttcatcgagcagggcatcaacgtgtgcctgtgccagagctatgccaagaacatgggcctgtatggagagcgggtgggcgccttcaccatggtgtgcaaggatgctgatgaggccaagagggtggagagccagctgaagatcctgatccggcccatgtacagcaacccccccctgaatggagccagaattgctgctgccatcctgaacaccccagacctgaggaagcagtggctgcaggaggtgaaggtgatggctgaccgcatcatcggcatgaggacccagctggtgagcaacctgaagaaggagggcagcacccacaactggcagcacatcacagaccagatcggcatgttctgcttcaccggcctgaagccagagcaggtggagcggctcatcaaggagttcagcatctacatgaccaaggatggccgcatctctgtggccggcgtgaccagcagcaatgtgggctacctggcccacgccatccaccaggtgaccaagtag

SEQ ID NO: 154031 - DNA, 570 bp, Artificial Sequence
  Description of Artificial Sequence: Synthetic coding sequence
atggccctgctgcacagcggccgggtgctgcccggcattgctgctgccttccaccctggcctggccgccgccgccagcgcccgggccagctcctggtggacccacgtggagatgggccccccagaccccatcctgggcgtgacagaggccttcaagagggacaccaacagcaagaagatgaacctgggcgtgggcgcctacagagatgacaatggcaagccctacgtgctgcccagcgtgaggaaggccgaggcccagattgctgccaagaacctggacaaggagtacctgcccatcggcggcctggccgagttctgcaaggacttcctgagcagcgctgagatgtccttctgccccaaccagcccggggagaccacccaccccagcagcggcatgctggcctgcagctacaaggtgattggcatcatgaccccccggctggccgtgctgaccagccaggccctgtggaggatcttccagaagtaccagagcagggtcttcttcttctgcatgcctgcccccaccatcccccgggagtggaccagggtgaggaacagcggcaggaagtag

SEQ ID NO: 154032 - DNA, 1164 bp, Artificial Sequence
  Description of Artificial Sequence: Synthetic coding sequence
atggccctgctgcacagcggccgggtgctgcccggcattgctgctgccttccaccctggcctggccgccgccgccagcgcccgggccagctcctggtggacccacgtggagatgggccccccagaccccatcctgggcgtgacagaggccttcaagagggacaccaacagcaagaagatgaacctgggcgtgggcgcctacagagatgacaatggcaagccctacgtgctgcccagcgtgaggaagtttgtgacagtgcagaccatcagcggcaccggggccctgagaattggagccagcttcctgcagcgcttcttcaagttcagcagagatgtgttcctgcccaagcccacctggggcaaccacacccccatcttcagagatgctggcatgcagctgcagggctaccgctactatgaccccaagacctgtggctttgacttcaccggggctgtggaggacatcagcaagatccctgagcagagcgtgctgctgctgcacgcctgtgcccacaaccccaccggggtggaccccaggcctgagcagtggaaggagatcgccaccgtggtgaagaagaggaacctgtttgccttctttgacatggcctaccagggctttgccagcggagatggagacaaggatgcctgggccgtgcgccacttcatcgagcagggcatcaacgtgtgcctgtgccagagctatgccaagaacatgggcctgtatggagagcgggtgggcgccttcaccatggtgtgcaaggatgctgatgaggccaagagggtggagagccagctgaagatcctgatccggcccatgtacagcaacccccccctgaatggagccagaattgctgctgccatcctgaacaccccagacctgaggaagcagtggctgcaggaggtgaaggtgatggctgaccgcatcatcggcatgaggacccagctggtgagcaacctgaagaaggagggcagcacccacaactggcagcacatcacagaccagatcggcatgttctgcttcaccggcctgaagccagagcaggtggagcggctcatcaaggagttcagcatctacatgaccaaggatggccgcatctctgtggccggcgtgaccagcagcaatgtgggctacctggcccacgccatccaccaggtgaccaagtag

SEQ ID NO: 154033 - DNA, 1491 bp, Artificial Sequence
  Description of Artificial Sequence: Synthetic coding sequence
atggccagcagcactggagacaggagccaggccgtgcgccacggcctgcgggccaaggtgctgaccctggatggcatgaacccccgggtgagaagagtggagtatgctgtgcggggccccatcgtgcagagggccctggagctggagcaggagctgcggcagggcgtgaagaagcccttcacagaggtgatccgggccaacattggagatgcccaggccatgggccagaggcccatcaccttcctgcggcaggtgctggccctgtgtgtgaacccagacctgctgagcagccccaacttcccagatgatgccaagaagagagctgagcgcatcctgcaggcctgtggcggccacagcctgggcgcctacagcgtgagcagcggcatccagctgatccgggaggatgtggcccgctacatcgagaggagagatggcggcatcccagctgaccccaacaacgtgttcctgagcactggagccagtgatgccatcgtgacagtgctgaagctgctggtggccggggagggccacaccaggactggagtgctgatccccatcccccagtaccccctgtacagcgccaccctggccgagctgggcgctgtgcaggtggactactacctggatgaggagcgggcctgggccctggatgtggccgagctgcaccgggccctgggccaggcccgggaccactgccggccccgggccctgtgtgtgatcaaccctggcaaccccaccggccaggtgcagaccagagaatgtattgaagctgtgatccgctttgcctttgaggagcggctcttcctgctggctgatgaggtgtaccaggacaacgtgtatgctgctggcagccagttccacagcttcaagaaggtgctgatggagatgggccccccctatgccggccagcaggagctggccagcttccacagcaccagcaagggctacatgggagaatgtggcttccggggcggctacgtggaggtggtgaacatggatgctgctgtgcagcagcagatgctgaagctgatgtctgtgcggctgtgcccccctgtgcccggccaggccctgctggacctggtggtgagccccccagcccccacagaccccagctttgcccagttccaggccgagaagcaggccgtgctggccgagctggccgccaaggccaagctgacagagcaggtgttcaatgaggcccctggcatcagctgcaaccctgtgcagggcgccatgtacagcttcccccgggtgcagctgccccccagggctgtggagcgggcccaggagctgggcctggccccagacatgttcttctgcctgcggctgctggaggagaccggcatctgtgtggtgcccggcagcggcttcggccagcgggagggcacctaccacttcaggatgaccatcctgccccccctggagaagctgcggctgctgctggagaagctgagccgcttccacgccaagttcaccctggagtacagctag

SEQ ID NO: 154034 - DNA, 1491 bp, Artificial Sequence; identical to SEQ ID NO: 154033
  Description of Artificial Sequence: Synthetic coding sequence

SEQ ID NO: 154035 - DNA, 2010 bp, Artificial Sequence
  Description of Artificial Sequence: Synthetic coding sequence
atgatgaggctgcggggcagcggcatgctgcgggacctgctgctgcggagccctgctggggtgtctgccaccctgcggcgggcccagcccctggtgaccctgtgccggcggccccggggcggcggccggcctgctgctggccctgctgctgctgcccggctgcacccctggtggggcggcggcggctggccagctgagcccctggcccggggcctgagcagcagccccagcgagatcctgcaggagctgggcaagggcagcacccacccccagcccggggtgagccccccagctgccccagctgcccctggccccaaggatggccctggagaaacagatgcctttggaaacagcgagggcaaggagctggtggccagcggggagaacaagatcaagcagggcctgctgcccagcctggaggacctgctcttctacaccatcgccgagggccaggagaagatccctgtgcacaagttcatcacagccctgaagagcacaggcctgcggaccagtgacccccggctgaaggagtgcatggacatgctgcggctgaccctgcagaccaccagtgatggagtgatgctggacaaggacctcttcaagaagtgtgtgcagagcaacatcgtgctgctgacccaggccttccggaggaagtttgtgatcccagacttcatgtccttcaccagccacattgatgagctgtatgaaagtgccaagaagcagagcggcggcaaggtggccgactacatcccccagctggccaagttctccccagacctgtggggcgtgtctgtgtgcaccgtggatggccagaggcacagcactggagacaccaaggtgcccttctgcctgcagagctgtgtgaagcccctgaagtatgccatcgctgtgaatgacctgggcacagaatatgtgcaccgctacgtgggcaaggagcccagcggcctgcgcttcaacaagctgttcctgaatgaagatgacaagccccacaaccccatggtgaatgctggggccatcgtggtgaccagcctcatcaagcagggcgtgaacaatgctgagaagtttgattatgtgatgcagttcctgaacaagatggctggaaatgaatatgtgggcttcagcaatgccaccttccagagcgagcgggagagcggggacaggaactttgccatcggctactacctgaaggagaagaagtgcttccctgagggcacagacatggtgggcatcctggacttctacttccagctgtgcagcattgaggtgacctgtgagagcgcctctgtgatggccgccaccctggccaacggcggcttctgccccatcactggagagcgggtgctgagccctgaggccgtgaggaacaccctgagcctgatgcacagctgtggcatgtatgacttcagcggccagtttgccttccacgtgggcctgcctgccaagagcggcgtggccggcggcatcctgctggtggtgcccaacgtgatgggcatgatgtgctggagcccccccctggacaagatgggcaacagcgtgaagggcatccacttctgccacgacctggtgtccctgtgcaacttccacaactatgacaacctgcggcactttgccaagaagctggacccccggcgggagggcggggaccagagggtgaagagcgtcatcaacctgctgtttgctgcctacacaggagatgtgtctgccctgcggagatttgccctgagcgccatggacatggagcagagggactatgacagcaggacagccctgcacgtggccgctgctgagggccacgtggaggtggtgaagttcctgctggaggcctgcaaggtgaaccccttccccaaggaccgctggaacaacacccccatggatgaggccctgcacttcggccaccatgatgtgttcaagatcctgcaggagtaccaggtgcagtacaccccccagggcgacagcgacaacgggaaggagaaccagacagtgcacaagaacctggatggcctgctgtag

SEQ ID NO: 154036 - DNA, 1797 bp, Artificial Sequence
  Description of Artificial Sequence: Synthetic coding sequence
atgatgaggctgcggggcagcggcatgctgcgggacctgctgctgcggagccctgctggggtgtctgccaccctgcggcgggcccagcccctggtgaccctgtgccggcggccccggggcggcggccggcctgctgctggccctgctgctgctgcccggctgcacccctggtggggcggcggcggctggccagctgagcccctggcccggggcctgagcagcagccccagcgagatcctgcaggagctgggcaagggcagcacccacccccagcccggggtgagccccccagctgccccagctgcccctggccccaaggatggccctggagaaacagatgcctttggaaacagcgagggcaaggagctggtggccagcggggagaacaagatcaagcagggcctgctgcccagcctggaggacctgctcttctacaccatcgccgagggccaggagaagatccctgtgcacaagttcatcacagccctgaagagcacaggcctgcggaccagtgacccccggctgaaggagtgcatggacatgctgcggctgaccctgcagaccaccagtgatggagtgatgctggacaaggacctcttcaagaagtgtgtgcagagcaacatcgtgctgctgacccaggccttccggaggaagtttgtgatcccagacttcatgtccttcaccagccacattgatgagctgtatgaaagtgccaagaagcagagcggcggcaaggtggccgactacatcccccagctggccaagttctccccagacctgtggggcgtgtctgtgtgcaccgtggatggccagaggcacagcactggagacaccaaggtgcccttctgcctgcagagctgtgtgaagcccctgaagtatgccatcgctgtgaatgacctgggcacagaatatgtgcaccgctacgtgggcaaggagcccagcggcctgcgcttcaacaagctgttcctgaatgaagatgacaagccccacaaccccatggtgaatgctggggccatcgtggtgaccagcctcatcaagcagggcgtgaacaatgctgagaagtttgattatgtgatgcagttcctgaacaagatggctggaaatgaatatgtgggcttcagcaatgccaccttccagagcgagcgggagagcggggacaggaactttgccatcggctactacctgaaggagaagaagtgcttccctgagggcacagacatggtgggcatcctggacttctacttccagctgtgcagcattgaggtgacctgtgagagcgcctctgtgatggccgccaccctggccaacggcggcttctgccccatcactggagagcgggtgctgagccctgaggccgtgaggaacaccctgagcctgatgcacagctgtggcatgtatgacttcagcggccagtttgccttccacgtgggcctgcctgccaagagcggcgtggccggcggcatcctgctggtggtgcccaacgtgatgggcatgatgtgctggagcccccccctggacaagatgggcaacagcgtgaagggcatccacttctgccacgacctggtgtccctgtgcaacttccacaactatgacaacctgcggcactttgccaagaagctggacccccggcgggagggcggggaccagaggcacagctttggccccctggactatgagagcctgcagcaggagctggccctgaaggagaccgtgtggaagaaggtgtccccagagagcaatgaagacatcagcaccaccgtggtgtacaggatggagagcctgggggagaagagctag

SEQ ID NO: 154037 - DNA, 525 bp, Artificial Sequence
  Description of Artificial Sequence: Synthetic coding sequence
atgggcatgatgtgctggagcccccccctggacaagatgggcaacagcgtgaagggcatccacttctgccacgacctggtgtccctgtgcaacttccacaactatgacaacctgcggcactttgccaagaagctggacccccggcgggagggcggggaccagagggtgaagagcgtcatcaacctgctgtttgctgcctacacaggagatgtgtctgccctgcggagatttgccctgagcgccatggacatggagcagagggactatgacagcaggacagccctgcacgtggccgctgctgagggccacgtggaggtggtgaagttcctgctggaggcctgcaaggtgaaccccttccccaaggaccgctggaacaacacccccatggatgaggccctgcacttcggccaccatgatgtgttcaagatcctgcaggagtaccaggtgcagtacaccccccagggcgacagcgacaatggcaaggagaaccagacagtgcacaagaacctggatggcctgctgtag

SEQ ID NO: 154038 - DNA, 1809 bp, Artificial Sequence
  Description of Artificial Sequence: Synthetic coding sequence
atgaggtccatgaaggccctgcagaaggccctgagccgggccggcagccactgcggccggggcggctggggccaccccagccgcagccccctgctgggcggcggcgtgcgccaccacctgtctgaggccgccgcccagggccgggagaccccccacagccaccagccccagcaccaggaccatgacagcagcgagagcggcatgctgagccggctgggggacctgctcttctacaccatcgccgagggccaggagcgcatccccatccacaagttcaccacagccctgaaggccaccggcctgcagaccagtgacccccggctgcgggactgcatgtctgagatgcaccgggtggtgcaggagagcagcagcggcggcctgctggaccgggacctcttcagaaaatgtgtgagcagcaacatcgtgctgctgacccaggccttcaggaagaagtttgtgatcccagactttgaggagttcaccggccacgtggaccgcatctttgaagatgtgaaggagctgactggaggcaaggtggccgcctacatcccccagctggccaagagcaacccagacctgtggggcgtgtccctgtgcaccgtggatggccagaggcacagcgtgggccacaccaagatccccttctgcctgcagagctgtgtgaagcccctgacctacgccatcagcatcagcaccctgggcacagattatgtgcacaagtttgtgggcaaggagcccagcggcctgcgctacaacaagctgagcctgaatgaggagggcatcccccacaaccccatggtgaatgctggggccatcgtggtgagcagcctcatcaagatggactgcaacaaggccgagaagtttgattttgtgctgcagtacctgaacaagatggctggaaatgagtacatgggcttcagcaatgccaccttccagagcgagaaggagactggagacaggaactatgccatcggctactacctgaaggagaagaagtgcttccccaagggcgtggacatgatggccgccctggacctgtacttccagctgtgcagcgtggaggtgacctgtgagagcggctctgtgatggccgccaccctggccaatggaggcatctgccccatcaccggggagagcgtgctgtctgctgaggccgtgaggaacaccctgagcctgatgcacagctgtggcatgtatgacttcagcggccagtttgccttccacgtgggcctgcctgccaagtctgctgtgtctggggccatcctgctggtggtgcccaacgtgatgggcatgatgtgcctgagcccccccctggacaagctgggcaacagccaccggggcaccagcttctgccagaagctggtgtccctcttcaacttccacaactatgacaacctgcggcactgtgccaggaagctggacccccggcgggagggcgctgagatccggaacaagacagtggtgaacctgctgtttgctgcctacagcggagatgtgtctgccctgcggagatttgccctgagcgccatggacatggagcagaaggactatgacagcaggacagccctgcacgtggccgctgctgagggccacatcgaggtggtgaagttcctgattgaggcctgcaaggtgaacccctttgccaaggaccgctggggcaacatccccctggatgatgctgtgcagttcaaccacctggaggtggtgaagctgctgcaggactaccaggacagctacaccctgtctgagacccaggccgaggccgctgctgaggccctgagcaaggagaacctggagagcatggtgtag

SEQ ID NO: 154039 - DNA, 534 bp, Artificial Sequence
  Description of Artificial Sequence: Synthetic coding sequence
atgaggtccatgaaggccctgcagaaggccctgagccgggccggcagccactgcggccggggcggctggggccaccccagccgcagccccctgctgggcggcggcgtgcgccaccacctgtctgaggccgccgcccagggccgggagaccccccacagccaccagccccagcaccaggaccatgacagcagcgagagcggcatgctgagccggctgggggacctgctcttctacaccatcgccgagggccaggagcgcatccccatccacaagttcaccacagccctgaaggccaccggcctgcagaccagtgacccccggctgcgggactgcatgtctgagatgcaccgggtggtgcaggagagcagcagcggcggcctgctggaccgggacctcttcaggaagtggcagcccaccagcctgtcctggcccagccagacccagacctgtggggtgagcccctgtgccctgtggatggtgaatggcaccctgtgggccacccagaggagccccagcgcctgcagccctgtgtag

SEQ ID NO: 154040 - DNA, 2049 bp, Artificial Sequence
  Description of Artificial Sequence: Synthetic coding sequence
atgtgtggcatctttgcctacatgaactacagagtgcccaggaccaggaaggagatctttgagaccctcatcaagggcctgcagaggctggagtaccggggctatgattctgctggggtggccattgatggcaacaaccacgaggtgaaggagcggcacatccagctggtgaagaagaggggcaaggtgaaggccctggatgaggagctgtacaagcaggacagcatggacctgaaggtggagtttgagacccacttcggcatcgcccacacccgctgggccacccacggcgtgcccagcgctgtgaacagccacccccagaggagtgacaagggaaatgaatttgtggtgatccacaacggcatcatcaccaactacaaggacctgaggaagttcctggagagcaagggctatgaatttgagagcgagacagacacagagaccatcgccaagctgatcaagtatgtgtttgacaaccgggagacagaggacatcaccttcagcaccctggtggagagggtcatccagcagctggagggcgcctttgccctggtgttcaagtctgtgcactacccaggagaggccgtggccacccggcggggcagccccctgctgattggagtgcgcagcaagtacaagctgagcacagagcagatccccatcctgtaccgcacctgcaccctggagaatgtgaagaacatctgcaagaccaggatgaagaggctggacagcagcgcctgcctgcatgctgtgggggacaaggctgtggagttcttctttgccagtgatgccagcgccatcatcgagcacaccaacagagtcatcttcctggaggatgatgacattgctgctgtggctgatggcaagctgagcatccaccgggtgaagaggtctgccagtgatgaccccagccgggccatccagaccctgcagatggagctgcagcagatcatgaagggcaacttcagcgccttcatgcagaaggagatctttgagcagcctgagagcgtcttcaacaccatgaggggccgggtgaactttgagaccaacacagtgctgctgggcggcctgaaggaccacctgaaggagatccgccgctgccggcggctgattgtgattggctgcggcaccagctaccacgccgctgtggccacccggcaggtgctggaggagctgacagagctgcctgtgatggtggagctggccagtgacttcctggacaggaacacccctgtgttcagagatgatgtgtgcttcttcatcagccagagcggggagacagctgacaccctgctggccctgcgctactgcaaggacagaggagccctgactgtgggcgtgaccaacacagtgggcagcagcatcagccgggagacagactgtggggtgcacatcaatgccggccctgagattggagtggccagcaccaaggcctacaccagccagttcatcagcctggtgatgtttggcctgatgatgtctgaagatcgcatcagcctgcagaacagacggcaggagatcatccggggcctgcggagcctgcctgagctgatcaaggaggtgctgagcctggaggagaagatccatgacctggccctggagctgtacacccagaggagcctgctggtgatgggccggggctacaactatgccacctgcctggagggcgccctgaagatcaaggagatcacctacatgcacagcgagggcatcctggccggggagctgaagcacggccccctggccctgattgacaagcagatgcctgtgatcatggtgatcatgaaggacccctgctttgccaagtgccagaatgccctgcagcaggtgacagcccggcagggccggcccatcatcctgtgcagcaaggatgacacagagagcagcaagtttgcctacaagaccatcgagctgccccacacagtggactgcctgcagggcatcctgagcgtcatccccctgcagctgctgtccttccacctggccgtgctgcggggctatgatgtggacttccccaggaacctggccaagtctgtgacagtggagtag

SEQ ID NO: 154041 - DNA, 1086 bp, Artificial Sequence
  Description of Artificial Sequence: Synthetic coding sequence
atggccggcggccgccacagaagagtggtgggcaccctgcacctgctgctgctggtggccgccctgccctgggccagccggggcgtgagccccagcgccagcgcctggccagaggagaagaactaccaccagcctgccatcctgaacagcagcgccctgcggcagattgctgagggcaccagcatcagcgagatgtggcagaatgacctgcagcccctgctgattgagcgctacccaggcagccctggcagctatgctgcccggcagcacatcatgcagaggatccagaggctgcaggccgactgggtgctggagattgacaccttcctgagccagaccccctacggctaccgctccttcagcaacatcatcagcaccctgaaccccacagccaagaggcacctggtgctggcctgccactatgacagcaagtacttcagccactggaacaacagagtgtttgtgggcgccacagacagcgctgtgccctgtgccatgatgctggagctggcccgggccctggacaagaagctgctgagcctgaagacagtgtctgacagcaagccagacctgagcctgcagctgatcttctttgatggagaggaggccttcctgcactggagcccccaggacagcctgtatggcagccgccacctggccgccaagatggccagcaccccccaccccccaggggcccggggcaccagccagctgcacggcatggacctgctggtgctgctggacctgattggagcccccaaccccaccttccccaacttcttccccaacagcgcccgctggtttgagcggctgcaggccatcgagcacgagctgcacgagctgggcctgctgaaggaccacagcctggagggccgctacttccagaactacagctatggaggagtcatccaggatgaccacatccccttcctgcggcggggcgtgcctgtgctgcacctgatccccagccccttccctgaggtgtggcacaccatggatgacaatgaggagaacctggatgagagcaccatcgacaacctgaacaagatcctgcaggtgtttgtgctggagtacctgcacctgtag

SEQ ID NO: 154042 - DNA, 939 bp, Artificial Sequence
  Description of Artificial Sequence: Synthetic coding sequence
atggccggcggccgccacagaagagtggtgggcaccctgcacctgctgctgctggtggccgccctgccctgggccagccggggcgtgagccccagcgccagcgcctggccagaggagaagcacatcatgcagaggatccagaggctgcaggccgactgggtgctggagattgacaccttcctgagccagaccccctacggctaccgctccttcagcaacatcatcagcaccctgaaccccacagccaagaggcacctggtgctggcctgccactatgacagcaagtacttcagccactggaacaacagagtgtttgtgggcgccacagattctgctgtgccctgtgccatgatgctggagctggcccgggccctggacaagaagctgctgagcctgaagacagtgtctgacagcaagccagacctgagcctgcagctgatcttctttgatggagaggaggccttcctgcactggagcccccaggacagcctgtatggcagccgccacctggccgccaagatggccagcaccccccaccccccaggggcccggggcaccagccagctgcacggcatggacctgctggtgctgctggacctgattggagcccccaaccccaccttccccaacttcttccccaacagcgcccgctggtttgagcggctgcaggccattgaacatgagctgcacgagctgggcctgctgaaggaccacagcctggagggccgctacttccagaactacagctatggaggagtcatccaggatgaccacatccccttcctgcggcggggcgtgcctgtgctgcacctgatccccagccccttccctgaggtgtggcacaccatggatgacaatgaggagaacctggatgagagcaccatcgacaacctgaacaagatcctgcaggtgtttgtgctggagtacctgcacctgtag

SEQ ID NO: 154043 - DNA, 2328 bp, Artificial Sequence
  Description of Artificial Sequence: Synthetic coding sequence
atggccgccctggacagcctgagcctcttcaccagcctgggcctgtctgagcagaaggcccgggagaccctgaagaacagcgccctgagcgcccagctgcgggaggccgccacccaggcccagcagaccctgggcagcaccatcgacaaggccaccggcatcctgctgtatggcctggccagccggctgcgggacacccggcggctgtccttcctggtgtcctacatcgccagcaagaagatccacacagagccccagctgtctgctgccctggagtatgtgcgcagccaccccctggaccccatcgacacagtggactttgagcgggagtgtggggtgggcgtcatcgtgaccccagagcagatcgaggaggccgtggaggccgccatcaacagacaccggccccagctgctggtggagcgctaccacttcaacatgggcctgctgatgggagaggcccgggctgtgctgaagtgggcagatggcaagatgatcaagaatgaggtggacatgcaggtgctgcacctgctgggccccaagctggaggccgacctggagaagaagttcaaggtggccaaggcccggctggaggagacagacagaagaacagccaaggatgtggtggagaatggagaaacagctgaccagaccctgagcctgatggagcagctgcggggggaggccctgaagttccacaagccaggagagaactacaagaccccaggctacgtggtgaccccccacaccatgaacctgctgaagcagcacctggagatcaccggcggccaggtgaggacccgcttccccccagagcccaacggcatcctgcacatcggccacgccaaggccatcaacttcaactttggctacgccaaggccaacaacggcatctgcttcctgcgctttgatgacaccaaccctgagaaggaggaggccaagttcttcaccgccatctgtgacatggtggcctggctgggctacaccccctacaaggtgacctacgccagtgactactttgaccagctgtatgcctgggccgtggagctgatcagaagaggcctggcctacgtgtgccaccagagaggagaggagctgaagggccacaacaccctgcccagcccctggagggaccggcccatggaggagagcctgctgctgtttgaggccatgaggaagggcaagttcagcgagggggaggccaccctgaggatgaagctggtgatggaggatggcaagatggaccctgtggcctacagagtgaagtacaccccccaccacaggactggagacaagtggtgcatctaccccacctatgactacacccactgcctgtgtgacagcattgagcacatcacccacagcctgtgcaccaaggagttccaggcccggcgcagcagctacttctggctgtgcaatgccctggatgtgtactgccctgtgcagtgggagtatggccgcctgaacctgcactatgctgtggtgtccaagaggaagatcctgcagctggtggccactggagctgtgcgggactgggatgaccccaggctcttcaccctgacagccctgcggcggcggggcttccccccagaggccatcaacaacttctgtgcccgggtgggcgtgacagtggcccagaccaccatggagccccacctgctggaggcctgtgtgagagatgtgctgaatgacacagccccccgggccatggctgtgctggagagcctgcgggtcatcatcaccaacttccctgctgccaagagcctggacatccaggtgcccaacttcccagcagatgagaccaagggcttccaccaggtgccctttgcccccatcgtgttcatcgagaggacagacttcaaggaggagcctgagcccggcttcaagaggctggcctggggccagcctgtgggcctgcggcacacaggctacgtgattgagctgcagcacgtggtgaagggccccagcggctgtgtggagagcctggaggtgacctgccggcgggcagatgctggggagaagcccaaggccttcatccactgggtgtcccagcccctgatgtgtgaggtgcggctgtatgaaagactcttccagcacaagaaccctgaggaccccacagaggtgcctgggggcttcctgagtgacctgaacctggccagcctgcacgtggtggatgctgccctggtggactgcagcgtggccctggccaagccctttgacaagttccagtttgagcggctgggctacttctctgtggaccctgacagccaccagggcaagctggtgttcaacagaacagtgaccctgaaggaggaccccgggaaggtgtag

SEQ ID NO: 154044 - DNA, 2295 bp, Artificial Sequence
  Description of Artificial Sequence: Synthetic coding sequence
atggccgccctggacagcctgagcctcttcaccagcctgggcctgtctgagcagaaggcccgggagaccctgaagaacagcgccctgagcgcccagctgcgggaggccgccacccaggcccagcagaccctgggcagcaccatcgacaaggccaccggcatcctgctgtatggcctggccagccggctgcgggacacccggcggctgtccttcctggtgtcctacatcgccacagccctggagtatgtgcgcagccaccccctggaccccatcgacacagtggactttgaaagagaatgtggggtgggcgtgattgtgaccccagagcagatcgaggaggccgtggaggccgccatcaacagacaccggccccagctgctggtggagcgctaccacttcaacatgggcctgctgatgggagaggcccgggctgtgctgaagtgggcagatggcaagatgatcaagaatgaggtggacatgcaggtgctgcacctgctgggccccaagctggaggccgacctggagaagaagttcaaggtggccaaggcccggctggaggagacagacagaagaacagccaaggatgtggtggagaatggagaaacagctgaccagaccctgagcctgatggagcagctgcggggggaggccctgaagttccacaagccaggagagaactacaagaccccaggctacgtggtgaccccccacaccatgaacctgctgaagcagcacctggagatcactggaggccaggtgaggacccgcttccccccagagcccaacggcatcctgcacatcggccacgccaaggccatcaacttcaactttggctacgccaaggccaacaacggcatctgcttcctgcgctttgatgacaccaaccctgagaaggaggaggccaagttcttcaccgccatctgtgacatggtggcctggctgggctacaccccctacaaggtgacctacgccagtgactactttgaccagctgtatgcctgggccgtggagctgatccggcggggcctggcctacgtgtgccaccagagaggagaggagctgaagggccacaacaccctgcccagcccctggagggaccggcccatggaggagagcctgctgctgtttgaggccatgaggaagggcaagttcagcgagggggaggccaccctgaggatgaagctggtgatggaggatggcaagatggaccctgtggcctacagagtgaagtacaccccccaccacaggactggagacaagtggtgcatctaccccacctatgactacacccactgcctgtgtgacagcattgagcacatcacccacagcctgtgcaccaaggagttccaggcccggcgcagcagctacttctggctgtgcaatgccctggatgtgtactgccctgtgcagtgggagtatggccgcctgaacctgcactatgctgtggtgtccaagaggaagatcctgcagctggtggccaccggggctgtgcgggactgggatgaccccaggctcttcaccctgacagccctgcggcggcggggcttccccccagaggccatcaacaacttctgtgcccgggtgggcgtgacagtggcccagaccaccatggagccccacctgctggaggcctgtgtgagagatgtgctgaatgacacagccccccgggccatggctgtgctggagagcctgcgggtcatcatcaccaacttccctgctgccaagagcctggacatccaggtgcccaacttcccagcagatgagaccaagggcttccaccaggtgccctttgcccccatcgtgttcattgaaagaacagacttcaaggaggagcctgagcccggcttcaagaggctggcctggggccagcctgtgggcctgcggcacacaggctacgtgattgagctgcagcacgtggtgaagggccccagcggctgtgtggagagcctggaggtgacctgcagaagagcagatgctggggagaagcccaaggccttcatccactgggtgtcccagcccctgatgtgtgaggtgcggctgtatgagcggctcttccagcacaagaaccctgaggaccccacagaggtgcctgggggcttcctgagtgacctgaacctggccagcctgcacgtggtggatgctgccctggtggactgcagcgtggccctggccaagccctttgacaagttccagtttgagcggctgggctacttctctgtggaccctgacagccaccagggcaagctggtgttcaacagaacagtgaccctgaaggaggaccccgggaaggtgtag

SEQ ID NO: 154045 - DNA, 849 bp, Artificial Sequence
  Description of Artificial Sequence: Synthetic coding sequence
atgcccacctgccgcctgggccccaagttcctgctggtgtctggagtgtctgccatggccgccctggacagcctgagcctcttcaccagcctgggcctgtctgagcagaaggcccgggagaccctgaagaacagcgccctgagcgcccagctgcgggaggccgccacccaggcccagcagaccctgggcagcaccatcgacaaggccaccggcatcctgctgtatggcctggccagccggctgcgggacacccggcggctgtccttcctggtgtcctacatcgccagcaagaagatccacacagagccccagctgtctgctgccctggagtatgtgcgcagccaccccctggaccccatcgacacagtggactttgagcgggagtgtggggtgggcgtcatcgtgaccccagagcagatcgaggaggccgtggaggccgccatcaacagacaccggccccagctgctggtggagcgctaccacttcaacatgggcctgctgatgggagaggcccgggctgtgctgaagtgggcagatggcaagatgatcaagaatgaggtggacatgcaggtgctgcacctgctgggccccaagctggaggccgacctggagaagaagttcaaggtggccaaggcccggctggaggagacagacagaagaacagccaaggatgtggtggagaatggagaaacagctgaccagaccctgagcctgatggagcagctgcggggggaggccctgaagttccacaagccaggcacctaccctgtgcctgcccggacccagtggaacccagcctactggacctgccagagccaccagttccagctgtggctgtgccaggtgtag

SEQ ID NO: 154046 - DNA, 2874 bp, Artificial Sequence
  Description of Artificial Sequence: Synthetic coding sequence
atgaactttgctgagcgggagggcagcaagcgctactgcatccagaccaagcacgtggccatcctgtgtgctgtggtggtgggcgtgggcctcatcgtgggcctggccgtgggcctgaccaggagctgtgacagcagtggagatggcggccctggaacagccccagcccccagccacctgcccagcagcacagccagccccagcggccccccagcccaggaccaggacatctgcccagcctctgaagatgaaagtggccagtggaagaacttccggctgcctgactttgtgaaccctgtgcactatgacctgcacgtgaagcccctgctggaggaggacacctacacaggcaccgtgtccatcagcatcaacctgagcgcccccacccgctacctgtggctgcacctgcgggagacccgcatcacccggctgcctgagctgaagaggccttctggggaccaggtgcaggtgcggcgctgctttgagtacaagaagcaggagtatgtggtggtggaggccgaggaggagctgacccccagcagtggagatggcctgtacctgctgaccatggagtttgctggctggctgaatggcagcctggtgggcttctaccgcaccacctacacagaaaatggccaggtgaagagcatcgtggccacagaccacgagcccacagatgccaggaagagcttcccctgctttgatgagcccaacaagaaggccacctacaccatcagcatcacccaccccaaggagtatggagccctgagcaacatgcctgtggccaaggaggagagcgtggatgacaagtggaccaggaccacctttgagaagtctgtgcccatgagcacctacctggtgtgctttgctgtgcaccagtttgacagcgtgaagaggatcagcaacagcggcaagcccctgaccatctacgtgcagcctgagcagaagcacacagcagaatatgctgccaacatcaccaagtctgtgtttgactactttgaggagtactttgccatgaactacagcctgcccaagctggacaagatcgccatcccagactttggcaccggggccatggagaactggggcctcatcacctaccgggagaccaacctgctgtatgaccccaaggagagcgccagcagcaaccagcagagggtggccaccgtggtggcccacgagctggtgcaccagtggtttggaaatattgtgaccatggactggtgggaggacctgtggctgaatgaaggatttgccagcttctttgagttcctgggcgtgaaccacgccgagacagactggcagatgagggaccagatgctgctggaggatgtgctgcctgtgcaggaggatgacagcctgatgagcagccaccccatcatcgtgacagtgaccaccccagatgagatcacctctgtgtttgatggcatctcctacagcaagggcagcagcatcctgaggatgctggaggactggatcaagccagagaacttccagaagggctgccagatgtacctggagaagtaccagttcaagaatgccaagaccagtgacttctgggccgccctggaggaggccagccggctgcctgtgaaggaggtgatggacacctggacccggcagatgggctaccctgtgctgaatgtgaatggagtgaagaacatcacccagaagcgcttcctgctggacccccgggccaaccccagccagcccccaagtgacctgggctacacctggaacatccctgtgaagtggacagaggacaacatcaccagctctgtgctcttcaacagaagtgagaaggagggcatcaccctgaacagcagcaaccccagcggaaatgccttcctgaagatcaacccagaccacatcggcttctacagagtgaactatgaggtggccacctgggacagcatcgccacagccctgagcctgaaccacaagaccttcagcagcgctgaccgggccagcctgattgatgatgcctttgccctggcccgggcccagctgctggactacaaggtggccctgaacctgaccaagtacctgaagcgggaggagaacttcctgccctggcagagggtcatctctgctgtgacctacatcatctccatgtttgaagatgacaaggagctgtaccccatgattgaggagtacttccagggccaggtgaagcccatcgctgacagcctgggctggaatgatgctggggaccacgtgaccaagctgctgcggagctctgtgctgggctttgcctgcaagatgggagaccgggaggccctgaacaatgccagcagcctgtttgagcagtggctgaatggaacagtgtccctgcctgtgaacctgcggctgctggtgtaccgctatggcatgcagaacagcggaaatgagatctcctggaactacaccctggagcagtaccagaagaccagcctggcccaggagaaggagaagctgctgtatggcctggcctctgtgaagaatgtgaccctgctgagccgctacctggacctgctgaaggacaccaacctgatcaagacccaggatgtgttcaccgtcatccgctacatctcctacaacagctatggcaagaacatggcctggaactggatccagctgaactgggactacctggtgaaccgctacaccctgaacaacagaaacctgggccgcatcgtgaccatcgccgagcccttcaacacagagctgcagctgtggcagatggagagcttctttgccaagtacccccaggccggggccggggagaagccccgggagcaggtgctggagaccgtgaagaacaacatcgagtggctgaagcagcacaggaacaccatccgggagtggttcttcaacctgctggagagcggctag

SEQ ID NO: 154047 - DNA, 4539 bp, Artificial Sequence
  Description of Artificial Sequence: Synthetic coding sequence
atggccaccctgagcctgactgtgaacagcggggacccccccctgggcgccctgctggccgtggagcacgtgaaggatgatgtgtccatctctgtggaggagggcaaggagaacatcctgcacgtgtctgaaaatgtcatcttcacagatgtgaacagcatcctgcgctacctggcccgggtggccaccacagctggcctgtatggcagcaacctgatggagcacacagaaattgaccactggctggagttcagcgccaccaagctgagcagctgtgacagcttcaccagcaccatcaatgagctgaaccactgcctgagcctgcggacctacctggtgggcaacagcctgagcctggccgacctgtgtgtgtgggccaccctgaagggaaatgctgcctggcaggagcagctgaagcagaagaaggcccctgtgcacgtgaagcgctggtttggcttcctggaggcccagcaggccttccagagcgtgggcaccaagtgggatgtgtccaccaccaaggcccgggtggcccctgagaagaagcaggatgtgggcaagtttgtggagctgcctggagctgagatgggcaaggtgacagtgcgcttccccccagaggccagcggctacctgcacatcggccacgccaaggccgccctgctgaaccagcactaccaggtgaacttcaagggcaagctgatcatgagatttgatgacaccaaccctgagaaggagaaggaggactttgagaaggtgatcctggaggatgtggccatgctgcacatcaagccagaccagttcacctacaccagtgaccactttgagaccatcatgaagtatgcagagaagctgatccaggagggcaaggcctacgtggatgacaccccagctgagcagatgaaggccgagcgggagcagagaattgacagcaagcacaggaagaaccccatcgagaagaacctgcagatgtgggaggagatgaagaagggcagccagtttggccagagctgctgcctgcgggccaagattgacatgagcagcaacaacggctgcatgagggaccccaccctgtaccgctgcaagatccagccccaccccaggactggaaacaagtacaacgtgtaccccacctatgactttgcctgccccatcgtggacagcattgaaggagtgacccacgccctgcggaccacagagtaccatgacagagatgagcagttctactggatcatcgaggccctgggcatcaggaagccctacatctgggagtacagccggctgaacctgaacaacacagtgctgagcaagaggaagctgacctggtttgtgaatgaaggcctggtggatggctgggatgacccccgcttccccaccgtgcggggcgtgctgcggcggggcatgacagtggagggcctgaagcagttcatcgccgcccagggcagcagccgctctgtggtgaacatggagtgggacaagatctgggccttcaacaagaaggtgattgatcctgtggcccccaggtatgtggccctgctgaagaaggaggtgattcctgtgaatgtgcctgaggcccaggaggagatgaaggaggtggccaagcaccccaagaaccctgaggtgggcctgaagcctgtgtggtacagccccaaggtgttcatcgagggcgcagatgctgagaccttcagcgagggggagatggtgaccttcatcaactggggcaacctgaacatcaccaagatccacaagaatgctgatggcaagatcatcagcctggatgccaagctgaacctggagaacaaggactacaagaagaccaccaaggtgacctggctggccgagaccacccacgccctgcccatccctgtgatctgtgtgacctatgagcacctgatcaccaagcctgtgctgggcaaggatgaggacttcaagcagtatgtgaacaagaacagcaagcatgaggagctgatgctgggggacccctgcctgaaggacctgaagaagggggacatcatccagctgcagaggcggggcttcttcatctgtgaccagccctatgagcctgtgagcccctacagctgcaaggaggccccctgtgtgctgatctacatcccagatggccacaccaaggagatgcccaccagcggcagcaaggagaagaccaaggtggaggccaccaagaatgagaccagcgcccccttcaaggagcggcccacccccagcctgaacaacaactgcaccaccagcgaggacagcctggtgctgtacaacagagtggccgtgcagggagatgtggtgcgggagctgaaggccaagaaggcccccaaggaggatgtggatgctgctgtgaagcagctgctgagcctgaaggccgagtacaaggagaagacaggccaggagtacaagccaggcaaccccccagctgagatcggccagaacatcagcagcaacagcagcgccagcatcctggagagcaagagcctgtatgatgaggtggccgcccagggcgaggtggtgaggaagctgaaggccgagaagagccccaaggccaagatcaatgaagctgtggagtgcctgctgagcctgaaggcccagtacaaggagaagacaggcaaggagtacatccctggccagccccccctgagccagagcagtgacagcagccccaccagaaattctgagcccgccggcctggagaccccagaggccaaggtgctgtttgacaaggtggccagccagggcgaggtggtgaggaagctgaagacagagaaggcccccaaggaccaggtggacattgctgtgcaggagctgctgcagctgaaggcccagtacaagagcctcatcggcgtggagtacaagcctgtgtctgccaccggggctgaggacaaggacaagaagaagaaggagaaggagaacaagtctgagaagcagaacaagccccagaagcagaatgatggccagaggaaggaccccagcaagaaccagggcggcggcctgagcagcagcggggccggggagggccagggccccaagaagcagacccggctgggcctggaggccaagaaggaggagaacctggccgactggtacagccaggtgatcaccaagtctgagatgattgagtaccatgacatcagcggctgctacatcctgcggccctgggcctatgccatctgggaggccatcaaggacttctttgatgctgagatcaagaagctgggcgtggagaactgctacttccccatgtttgtgtcccagagcgccctggagaaggagaagacccacgtggccgactttgcccctgaggtggcctgggtgaccaggtctgggaagacagagctggccgagcccatcgccatccggcccaccagcgagaccgtgatgtacccagcctatgccaagtgggtgcagagccaccgggacctgcccatcaagctgaaccagtggtgcaatgtggtgcgctgggagttcaagcacccccagcccttcctgcggacccgggagttcctgtggcaggagggccacagcgcctttgccaccatggaggaggccgctgaggaggtgctgcagatcctggacctgtatgcccaggtgtatgaggagctgctggccatccctgtggtgaagggcaggaagacagagaaggagaagtttgctggaggagactacaccaccaccatcgaggccttcatcagcgccagcggccgggccatccagggcggcaccagccaccacctgggccagaacttcagcaagatgtttgagatcgtgtttgaggaccccaagatccctggagagaagcagtttgcctaccagaacagctggggcctgaccaccaggaccatcggcgtgatgaccatggtgcatggagacaacatgggcctggtgctgcccccccgggtggcctgtgtgcaggtggtgatcatcccctgtggcatcaccaatgccctgtctgaggaggacaaggaggccctgattgccaagtgcaatgactacagaagaaggctgctgtctgtgaacatccgggtgcgggctgacctgcgggacaactacagccctggctggaagttcaaccactgggagctgaagggcgtgcccatccggctggaggtgggcccccgggacatgaagagctgccagtttgtggccgtgagaagagacaccggggagaagctgactgtggccgagaatgaagctgagaccaagctgcaggccatcctggaggacatccaggtgaccctcttcacccgggccagcgaggacctgaagacccacatggtggtggccaacaccatggaggacttccagaagatcctggacagcggcaagatcgtgcagatccccttctgtggggagattgactgtgaggactggatcaagaagaccacagcccgggaccaggacctggagcccggggcccccagcatgggcgccaagagcctgtgcatccccttcaagcccctgtgtgagctgcagcccggggccaagtgtgtgtgtgggaagaacccagccaagtactacaccctgtttggccgcagctactag

SEQ ID NO: 154048 - DNA, 2964 bp, Artificial Sequence
  Description of Artificial Sequence: Synthetic coding sequence
atggccaccctgagcctgactgtgaacagcggggacccccccctgggcgccctgctggccgtggagcacgtgaaggatgatgtgtccatctctgtggaggagggcaaggagaacatcctgcacgtgtctgaaaatgtcatcttcacagatgtgaacagcatcctgcgctacctggcccgggtggccaccacagctggcctgtatggcagcaacctgatggagcacacagaaattgaccactggctggagttcagcgccaccaagctgagcagctgtgacagcttcaccagcaccatcaatgagctgaaccactgcctgagcctgcggacctacctggtgggcaacagcctgagcctggccgacctgtgtgtgtgggccaccctgaagggaaatgctgcctggcaggagcagctgaagcagaagaaggcccctgtgcacgtgaagcgctggtttggcttcctggaggcccagcaggccttccagagcgtgggcaccaagtgggatgtgtccaccaccaaggcccgggtggcccctgagaagaagcaggatgtgggcaagtttgtggagctgcctggagctgagatgggcaaggtgacagtgcgcttccccccagaggccagcggctacctgcacatcggccacgccaaggccgccctgctgaaccagcactaccaggtgaacttcaagggcaagctgatcatgagatttgatgacaccaaccctgagaaggagaaggaggactttgagaaggtgatcaagtctgtggtgatgaccctgtgccagaagagcatcaaggtgacaggcctgcccaacaccttcatggtgatcctggaggatgtggccatgctgcacatcaagccagaccagttcacctacaccagtgaccactttgagaccatcatgaagtatgcagagaagctgatccaggagggcaaggcctacgtggatgacaccccagctgagcagatgaaggccgagcgggagcagagaattgacagcaagcacaggaagaaccccatcgagaagaacctgcagatgtgggaggagatgaagaagggcagccagtttggccagagctgctgcctgcgggccaagattgacatgagcagcaacaacggctgcatgagggaccccaccctgtaccgctgcaagatccagccccaccccaggactggaaacaagtacaacgtgtaccccacctatgactttgcctgccccatcgtggacagcattgaaggagtgacccacgccctgcggaccacagagtaccatgacagagatgagcagttctactggatcatcgaggccctgggcatcaggaagccctacatctgggagtacagccggctgaacctgaacaacacagtgctgagcaagaggaagctgacctggtttgtgaatgaaggcctggtggatggctgggatgacccccgcttccccaccgtgcggggcgtgctgcggcggggcatgacagtggagggcctgaagcagttcatcgccgcccagggcagcagccgctctgtggtgaacatggagtgggacaagatctgggccttcaacaagaaggtgattgatcctgtggcccccaggtatgtggccctgctgaagaaggaggtgattcctgtgaatgtgcctgaggcccaggaggagatgaaggaggtggccaagcaccccaagaaccctgaggtgggcctgaagcctgtgtggtacagccccaaggtgttcatcgagggcgcagatgctgagaccttcagcgagggggagatggtgaccttcatcaactggggcaacctgaacatcaccaagatccacaagaatgctgatggcaagatcatcagcctggatgccaagctgaacctggagaacaaggactacaagaagaccaccaaggtgacctggctggccgagaccacccacgccctgcccatccctgtgatctgtgtgacctatgagcacctgatcaccaagcctgtgctgggcaaggatgaggacttcaagcagtatgtgaacaagaacagcaagcatgaggagctgatgctgggggacccctgcctgaaggacctgaagaagggggacatcatccagctgcagaggcggggcttcttcatctgtgaccagccctatgagcctgtgagcccctacagctgcaaggaggccccctgtgtgctgatctacatcccagatggccacaccaaggagatgcccaccagcggcagcaaggagaagaccaaggtggaggccaccaagaatgagaccagcgcccccttcaaggagcggcccacccccagcctgaacaacaactgcaccaccagcgaggacagcctggtgctgtacaacagagtggccgtgcagggagatgtggtgcgggagctgaaggccaagaaggcccccaaggaggatgtggatgctgctgtgaagcagctgctgagcctgaaggccgagtacaaggagaagacaggccaggagtacaagccaggcaaccccccagctgagatcggccagaacatcagcagcaacagcagcgccagcatcctggagagcaagagcctgtatgatgaggtggccgcccagggcgaggtggtgaggaagctgaaggccgagaagagccccaaggccaagatcaatgaagctgtggagtgcctgctgagcctgaaggcccagtacaaggagaagacaggcaaggagtacatccctggccagccccccctgagccagagcagtgacagcagccccaccagaaattctgagcccgccggcctggagaccccagaggccaaggtgctgtttgacaaggtggccagccagggcgaggtggtgaggaagctgaagacagagaaggcccccaaggaccaggtggacattgctgtgcaggagctgctgcagctgaaggcccagtacaagagcctcatcggcgtggagtacaagcctgtgtctgccaccggggctgaggacaaggacaagtag

SEQ ID NO: 154049 - DNA, 2928 bp, Artificial Sequence
  Description of Artificial Sequence: Synthetic coding sequence
atggccaccctgagcctgactgtgaacagcggggacccccccctgggcgccctgctggccgtggagcacgtgaaggatgatgtgtccatctctgtggaggagggcaaggagaacatcctgcacgtgtctgaaaatgtcatcttcacagatgtgaacagcatcctgcgctacctggcccgggtggccaccacagctggcctgtatggcagcaacctgatggagcacacagaaattgaccactggctggagttcagcgccaccaagctgagcagctgtgacagcttcaccagcaccatcaatgagctgaaccactgcctgagcctgcggacctacctggtgggcaacagcctgagcctggccgacctgtgtgtgtgggccaccctgaagggaaatgctgcctggcaggagcagctgaagcagaagaaggcccctgtgcacgtgaagcgctggtttggcttcctggaggcccagcaggccttccagagcgtgggcaccaagtgggatgtgtccaccaccaaggcccgggtggcccctgagaagaagcaggatgtgggcaagtttgtggagctgcctggagctgagatgggcaaggtgacagtgcgcttccccccagaggccagcggctacctgcacatcggccacgccaaggccgccctgctgaaccagcactaccaggtgaacttcaagggcaagctgatcatgagatttgatgacaccaaccctgagaaggagaaggaggactttgagaaggtgatcctggaggatgtggccatgctgcacatcaagccagaccagttcacctacaccagtgaccactttgagaccatcatgaagtatgcagagaagctgatccaggagggcaaggcctacgtggatgacaccccagctgagcagatgaaggccgagcgggagcagagaattgacagcaagcacaggaagaaccccatcgagaagaacctgcagatgtgggaggagatgaagaagggcagccagtttggccagagctgctgcctgcgggccaagattgacatgagcagcaacaacggctgcatgagggaccccaccctgtaccgctgcaagatccagccccaccccaggactggaaacaagtacaacgtgtaccccacctatgactttgcctgccccatcgtggacagcattgaaggagtgacccacgccctgcggaccacagagtaccatgacagagatgagcagttctactggatcatcgaggccctgggcatcaggaagccctacatctgggagtacagccggctgaacctgaacaacacagtgctgagcaagaggaagctgacctggtttgtgaatgaaggcctggtggatggctgggatgacccccgcttccccaccgtgcggggcgtgctgcggcggggcatgacagtggagggcctgaagcagttcatcgccgcccagggcagcagccgctctgtggtgaacatggagtgggacaagatctgggccttcaacaagaagctgcgggccctgtgcaagaaggtgattgatcctgtggccccccgctacgtggccctgctgaagaaggaggtgattcctgtgaatgtgcctgaggcccaggaggagatgaaggaggtggccaagcaccccaagaaccctgaggtgggcctgaagcctgtgtggtacagccccaaggtgttcattgaaggagcagatgctgagaccttcagcgagggggagatggtgaccttcatcaactggggcaacctgaacatcaccaagatccacaagaatgctgatggcaagatcatcagcctggatgccaagctgaacctggagaacaaggactacaagaagaccaccaaggtgacctggctggccgagaccacccacgccctgcccatccctgtgatctgtgtgacctatgagcacctgatcaccaagcctgtgctgggcaaggatgaggacttcaagcagtatgtgaacaagaacagcaagcatgaggagctgatgctgggggacccctgcctgaaggacctgaagaagggggacatcatccagctgcagaggcggggcttcttcatctgtgaccagccctatgagcctgtgagcccctacagctgcaaggaggccccctgtgtgctgatctacatcccagatggccacaccaaggagatgcccaccagcggcagcaaggagaagaccaaggtggaggccaccaagaatgagaccagcgcccccttcaaggagcggcccacccccagcctgaacaacaactgcaccaccagcgaggacagcctggtgctgtacaacagagtggccgtgcagggagatgtggtgcgggagctgaaggccaagaaggcccccaaggaggatgtggatgctgctgtgaagcagctgctgagcctgaaggccgagtacaaggagaagacaggccaggagtacaagccaggcaaccccccagctgagatcggccagaacatcagcagcaacagcagcgccagcatcctggagagcaagagcctgtatgatgaggtggccgcccagggcgaggtggtgaggaagctgaaggccgagaagagccccaaggccaagatcaatgaggccgtggagtgcctgctgagcctgaaggcccagtacaaggagaagacaggcaaggagtacatccctggccagccccccctgagccagagcagtgacagcagccccaccaggaacagcgagcctgctggcctggagaccccagaggccaaggtgctgtttgacaaggtggccagccagggcgaggtggtgaggaagctgaagacagagaaggcccccaaggaccaggtggacattgctgtgcaggagctgctgcagctgaaggcccagtacaagagcctgattggagtggagtacaagcctgtgtctgccactggagctgaggacaaggacaagaagaagaaggagaagtag

SEQ ID NO: 154050 - DNA, 1572 bp, Artificial Sequence
  Description of Artificial Sequence: Synthetic coding sequence
atggccgccctgctgcggcggctgctgcagcgggagcggcccagcgctgccagcggccggcctgtgggccggcgggaggccaacctgggcacagatgctggggtggccgtgcgggtgcgctttgcccccagccccaccggcttcctgcacctgggcggcctgaggacagccctgtacaactacatctttgccaagaagtaccagggcagcttcatcctgcggctggaggacacagaccagaccagggtggtgcctggagctgctgaaaatattgaggacatgctggagtgggccggcatccccccagatgagagccccaggagaggaggccctgctggcccctaccagcagagccagaggctggagctgtatgcccaggccacagaggccctgctgaagacaggagctgcctacccctgcttctgcagcccccagaggctggagctgctgaagaaggaggccctgaggaaccaccagacccccaggtatgacaaccgctgcaggaacatgagccaggagcaggtggcccagaagctggccaaggaccccaagccagccatccgcttccggctggagcaggtggtgcctgccttccaggacctggtgtatggctggaacagacatgaggtggcctctgtggagggggaccctgtgatcatgaagagtgatggcttccccacctaccacctggcctgtgtggtggatgaccaccacatgggcatcagccacgtgctgcggggcagcgagtggctggtgtccacagccaagcacctgctgctgtaccaggccctgggctggcagcccccccactttgcccacctgcccctgctgctgaacagagatggcagcaagctgagcaagaggcagggagatgtgttcctggagcactttgctgctgatggcttcctgcctgacagcctgctggacatcatcaccaactgtggcagcggctttgctgagaaccagatgggccgcaccctgcctgagctgatcacccagttcaacctgacccaggtgacctgccacagcgccctgctggacctggagaagctgcctgagttcaaccggctgcacctgcagaggctggtgtccaatgaaagccagaggcggcagctggtgggcaagctgcaggtgctggtggaggaggccttcggctgccagctgcagaacagagatgtgctgaaccctgtgtatgtggagcgcatcctgctgctgcggcagggccacatctgccgcctgcaggacctggtgtcccctgtgtacagctacctgtggaccaggcctgctgtgggccgggcccagctggatgccatcagcgagaaggtggatgtgattgccaagagggtgctgggcctgctggagaggagctccatgagcctgacccaggacatgctgaatggagagctgaagaagctgtctgagggcctggagggcaccaagtacagcaatgtgatgaagctgctgaggatggccctgagcggccagcagcagggcccccctgtggccgagatgatgctggccctgggccccaaggaggtgcgggagcgcatccagaaggtggtgagcagctag

SEQ ID NO: 154051 - DNA, 1572 bp, Artificial Sequence; identical to SEQ ID NO: 154050
  Description of Artificial Sequence: Synthetic coding sequence

SEQ ID NO: 154052 - DNA, 321 bp, Artificial Sequence
  Description of Artificial Sequence: Synthetic coding sequence
atggcccaggagtttgtgaactgcaagatccagcccgggaaggtggtggtgttcatcaagcccacctgcccctactgcagaagagcccaggagatcctgagccagctgcccatcaagcagggcctgctggagtttgtggacatcacagccaccaaccacaccaatgagatccaggactacctgcagcagctgactggagccaggacagtgcccagggtcttcatcggcaaggactgcatcggcggctgcagcgacctggtgtccctgcagcagagcggggagctgctgacccggctgaagcagatcggggccctgcagtag

SEQ ID NO: 154053 - DNA, 321 bp, Artificial Sequence; identical to SEQ ID NO: 154052
  Description of Artificial Sequence: Synthetic coding sequence

SEQ ID NO: 154054 - DNA, 321 bp, Artificial Sequence; identical to SEQ ID NO: 154052
  Description of Artificial Sequence: Synthetic coding sequence

SEQ ID NO: 154055 - DNA, 321 bp, Artificial Sequence; identical to SEQ ID NO: 154052
  Description of Artificial Sequence: Synthetic coding sequence

SEQ ID NO: 154056 - DNA, 321 bp, Artificial Sequence; identical to SEQ ID NO: 154052
  Description of Artificial Sequence: Synthetic coding sequence

SEQ ID NO: 154057 - DNA, 495 bp, Artificial Sequence
  Description of Artificial Sequence: Synthetic coding sequence
atgatctggaggcgggccgccctggccggcacccggctggtgtggagccgcagcggcagcgctggctggctggacagagctgctggagctgctggagctgctgctgctgctgccagcggcatggagagcaacaccagcagcagcctggagaacctggccacagcccctgtgaaccagatccaggagaccatcagtgacaactgtgtggtgatcttcagcaagaccagctgcagctactgcaccatggccaagaagctgttccatgacatgaatgtgaactacaaggtggtggagctggacctgctggagtatggcaaccagttccaggatgccctgtacaagatgaccggggagaggacagtgccccgcatctttgtgaatggcaccttcatcggcggggccacagacacccaccggctgcacaaggagggcaagctgctgcccctggtgcaccagtgctacctgaagaagagcaagaggaaggagttccagtag

SEQ ID NO: 154058 - DNA, 498 bp, Artificial Sequence
  Description of Artificial Sequence: Synthetic coding sequence
atgaacccccgggacaagcaggtgagccgcttcagccccctgaaggatgtgtacacctgggtggccctggccggcatccagaggagcggcagccctggccgcaccaggtctgctgcccggaggatggagagcaacaccagcagcagcctggagaacctggccacagcccctgtgaaccagatccaggagaccatcagtgacaactgtgtggtgatcttcagcaagaccagctgcagctactgcaccatggccaagaagctgttccatgacatgaatgtgaactacaaggtggtggagctggacctgctggagtatggcaaccagttccaggatgccctgtacaagatgactggagagaggacagtgccccgcatctttgtgaatggcaccttcatcggcggggccacagacacccaccggctgcacaaggagggcaagctgctgcccctggtgcaccagtgctacctgaagaagagcaagaggaaggagttccagtag

SEQ ID NO: 154059 - DNA, 1008 bp, Artificial Sequence
  Description of Artificial Sequence: Synthetic coding sequence
atggctgctggagctgctgaggccgctgtggccgctgtggaggaggtgggcagcgctggccagtttgaggagctgctgcggctgaaggccaagagcctgctggtggtgcacttctgggccccctgggccccccagtgtgcccagatgaatgaggtgatggccgagctggccaaggagctgccccaggtgtcctttgtgaagctggaggccgagggcgtgcctgaggtgtctgagaagtatgagatcagctctgtgcccaccttcctgttcttcaagaacagccagaagattgaccggctggatggagcccacgcccctgagctgaccaagaaggtgcagagacatgccagcagcggcagcttcctgcccagcgccaatgagcacctgaaggaggacctgaacctgcggctgaagaagctgacccatgctgccccctgcatgctgttcatgaagggcaccccccaggagccccgctgtggcttcagcaagcagatggtggagatcctgcacaagcacaacatccagttcagcagctttgacatcttcagtgatgaggaggtgcggcagggcctgaaggcctacagctcctggcccacctacccccagctgtatgtgtctggagagctgattggaggcctggacatcatcaaggagctggaggccagcgaggagctggacaccatctgccccaaggcccccaagctggaggagcggctgaaggtgctgaccaacaaggcctctgtgatgctgttcatgaagggcaacaagcaggaggccaagtgtggcttcagcaagcagatcctggagatcctgaacagcactggagtggagtatgagacctttgacatcctggaggatgaggaggtgcggcagggcctgaaggcctacagcaactggcccacctacccccagctgtatgtgaagggggagctggtgggcggcctggacatcgtgaaggagctgaaggaaaatggagagctgctgcccatcctgcggggggagaactag

SEQ ID NO: 154060 - DNA, 1008 bp, Artificial Sequence; identical to SEQ ID NO: 154059
  Description of Artificial Sequence: Synthetic coding sequence

SEQ ID NO: 154061 - DNA, 1008 bp, Artificial Sequence; identical to SEQ ID NO: 154059
  Description of Artificial Sequence: Synthetic coding sequence

SEQ ID NO: 154062 - DNA, 474 bp, Artificial Sequence
  Description of Artificial Sequence: Synthetic coding sequence
atgagcggcagcctgggccgggctgctgctgccctgctgcgctggggcagaggagctgggggcggcggcctgtggggccctggggtgcgggccgccggcagcggggccggcggcggcggcagcgctgagcagctggatgccctggtgaagaaggacaaggtggtggtgttcctgaagggcaccccagagcagccccagtgtggcttcagcaatgctgtggtgcagatcctgcggctgcacggcgtgcgggactatgctgcctacaacgtgctggatgatcctgagctgcggcagggcatcaaggactacagcaactggcccaccatcccccaggtgtacctgaatggagaatttgtgggcggctgtgacatcctgctgcagatgcaccagaatggagacctggtggaggagctgaagaagctgggcatccacagcgccctgctggatgagaagaaggaccaggacagcaagtag

SEQ ID NO: 154063 - DNA, 873 bp, Artificial Sequence
  Description of Artificial Sequence: Synthetic coding sequence
atgctgaagcgggagatgaagccagagagtgaccggcccaggaaggtgcgcttccgcatcgccagcagccacagcggccgggtgctgaaggaggtgtatgaagatggccagcccagcggcagcctggacagtgaatgtgccagcatctgtggcattgatggcctgggggacagtgatggccagcagaatggccacatcgagagtgaaggagatgaaaatgaaaatgaccaggacagcctgctggtgctggcccgggccgccagcgagaagggcttcggcaccaggagagtgaacatcctgagcaagaatggaacagtgcggggcgtgaagtacaaggtgtctgctggccaggccctcttcaacaacctgaccaaggtgctgcagcagcccagcacagacctggagtttgacagagtggtgatctacaccacctgcctgcgggtggtgaggaccacctttgagcgctgtgagctggtgaggaagatcttccagaaccaccgggtgaagtttgaggagaagaacatcgccctgaatggagaatatggcaaggagctggatgagcgctgccggcgggtgtctgaggcccccagcctgcctgtggtgttcattgatggccactacctgggcggcgctgagaagatcctgtccatgaatgaaagtggagagctgcaggacatcctgaccaagattgaaagagtgcagcacccccatgagtgccccagctgtggcggcttcggcttcctgccctgcagcgtgtgccacggcagcaagatgtccatgttcaggaactgcttcacagacagcttcaaggccctgaagtgcacagcctgcaatgaaaatggcctgcagcgctgcaagaactgtgccggctag

SEQ ID NO: 154064 - DNA, 828 bp, Artificial Sequence; identical to SEQ ID NO: 145811
  Description of Artificial Sequence: Synthetic coding sequence

SEQ ID NO: 154065 - DNA, 987 bp, Artificial Sequence
  Description of Artificial Sequence: Synthetic coding sequence
atggccctgcggggcgtgtctgtgcggctgctgagccggggccctggcctgcacgtgctgcggacctgggtgagcagcgctgcccagacagccagcaggcctgagtttgactggcaggaccccctggtgctggaggagcagctgaccacagatgagatcctgatccgggacaccttccgcacctactgccaggagcggctgatgccccgcatcctgctggccaacagaaatgaaggctacggctgtgccggcgtgtcctctgtggcctacggcctgctggcccgggagctggagcgggtggacagcggctaccgcagcgccatgtctgtgcagagcagcctggtgatgcaccccatctatgcctacggcagcgaggagcagaggcagaagtacctgccccagctggccaagggggagctgctgggctgcttcggcctgacagagcccaacagcggcagtgaccccagctccatggagacccgggcccactacaacagcagcaacaagagctacaccctgaatggcaccaagacctggatcaccaacagccccatggctgacctgtttgtggtgtgggcccgctgtgaagatggctgcatccggggcttcctgctggagaagggcatgaggggcctgagcgccccccgcatccagggcaagttcagcctgcgggccagcgccaccggcatgatcatcatggatggagtggaggtgcctgaagaaaatgtgctgcccggggccagcagcctgggcggccccttcggctgcctgaacaatgcccgctatggcatcgcctggggcgtgctgggcgccagcgagttctgcctgcacacagcccggcagtatgccctggacaggatgcagtttggagtgcccctggccaggaaccagctgatccagaagaagctggccgacatgctgacagagatcaccctgggcctgcacgcctgcctgcagctgggccgcctgaaggaccaggacaagtag

SEQ ID NO: 154066 - DNA, 1185 bp, Artificial Sequence
  Description of Artificial Sequence: Synthetic coding sequence
atgaggagcagcagcggcaccccatctgcccccacagcccggcgggacagctgcctggccagctgctggcccatcgccaccaagagcctggccctgctgccccggctggagtgcagcggcaccatcctggcccactgcaagttctgcctgcccggcagcagtgacagccctgccagcacccccctggtggccggcatcaccggctacggctgtgccggcgtgtcctctgtggcctacggcctgctggcccgggagctggagcgggtggacagcggctacagaagtgccatgtctgtgcagagcagcctggtgatgcaccccatctatgcctacggcagcgaggagcagaggcagaagtacctgccccagctggccaagggggagctgctgggctgcttcggcctgacagagcccaacagcggcagtgaccccagctccatggagacccgggcccactacaacagcagcaacaagagctacaccctgaatggcaccaagacctggatcaccaacagccccatggctgacctgtttgtggtgtgggcccgctgtgaagatggctgcatccggggcttcctgctggagaagggcatgaggggcctgagcgccccccgcatccagggcaagttcagcctgcgggccagcgccaccggcatgatcatcatggatggagtggaggtgcctgaggagaatgtgctgcccggggccagcagcctgggcggccccttcggctgcctgaacaatgcccgctatggaattgcctggggcgtgctgggcgccagcgagttctgcctgcacacagcccggcagtatgccctggacaggatgcagtttggagtgcccctggccaggaaccagctgatccagaagaagctggccgacatgctgacagagatcaccctgggcctgcacgcctgcctgcagctgggccgcctgaaggaccaggacaaggccgcccctgagatggtgtccctgctgaagaggaacaactgtgggaaggccctggacatcgcccggcaggcccgggacatgctgggcggcaatggcatcagtgatgagtaccacgtgatcagacatgccatgaacctggaggccgtgaacacctatgagggcacccatgacatccacgccctgatcctgggccgggccatcaccggcatccaggccttcaccgccagcaagtag

SEQ ID NO: 154067 - DNA, 1287 bp, Artificial Sequence
  Description of Artificial Sequence: Synthetic coding sequence
atggccctgcggggcgtgtctgtgcggctgctgagccggggccctggcctgcacgtgctgcggacctgggtgagcagcgctgcccagacagagaagggcggccgcacccagagccagctggccaagagcagcaggcctgagtttgactggcaggaccccctggtgctggaggagcagctgaccacagatgagatcctgatccgggacaccttccgcacctactgccaggagcggctgatgccccgcatcctgctggccaacagaaatgaggtgttccaccgggagatcatcagcgagatgggagagctgggcgtgctgggccccaccatcaagggctacggctgtgccggcgtgtcctctgtggcctacggcctgctggcccgggagctggagcgggtggacagcggctacagaagtgccatgtctgtgcagagcagcctggtgatgcaccccatctatgcctacggcagcgaggagcagaggcagaagtacctgccccagctggccaagggggagctgctgggctgcttcggcctgacagagcccaacagcggcagtgaccccagctccatggagacccgggcccactacaacagcagcaacaagagctacaccctgaatggcaccaagacctggatcaccaacagccccatggctgacctgtttgtggtgtgggcccgctgtgaagatggctgcatccggggcttcctgctggagaagggcatgaggggcctgagcgccccccgcatccagggcaagttcagcctgcgggccagcgccaccggcatgatcatcatggatggagtggaggtgcctgaggagaatgtgctgcccggggccagcagcctgggcggccccttcggctgcctgaacaatgcccgctatggaattgcctggggcgtgctgggcgccagcgagttctgcctgcacacagcccggcagtatgccctggacaggatgcagtttggagtgcccctggccaggaaccagctgatccagaagaagctggccgacatgctgacagagatcaccctgggcctgcacgcctgcctgcagctgggccgcctgaaggaccaggacaaggccgcccctgagatggtgtccctgctgaagaggaacaactgtgggaaggccctggacatcgcccggcaggcccgggacatgctgggcggcaatggcatcagtgatgagtaccacgtgatcagacatgccatgaacctggaggccgtgaacacctatgaggtggtgcagatgtgcagcctgaagaggcgctggaacagcctgtag

SEQ ID NO: 154068 - DNA, 291 bp, Artificial Sequence
  Description of Artificial Sequence: Synthetic coding sequence
atgtgtgccgcccggctggccgctgctgctgctgctgcccagagcgtgtatgccttcagcgcccggcccctggccggcggggagcctgtgtccctgggcagcctgcggggcaaggtgctgctgattgaaaatgtggccagcctgaccaccgtgcgggactacacccagatgaatgagctgcagaggcggctgggcccccggggcctggtggtgctgggcttcccctgcaaccagtttggccaccaggtgcggcgggcagagcggggcggggccggggctgatgtgcagtag

SEQ ID NO: 154069 - DNA, 606 bp, Artificial Sequence
  Description of Artificial Sequence: Synthetic coding sequence
atgtgtgccgcccggctggccgctgctgctgctgctgcccagagcgtgtatgccttcagcgcccggcccctggccggcggggagcctgtgtccctgggcagcctgcggggcaaggtgctgctgattgaaaatgtggccagcctgaccaccgtgcgggactacacccagatgaatgagctgcagaggcggctgggcccccggggcctggtggtgctgggcttcccctgcaaccagtttggccaccaggagaatgccaagaatgaggagatcctgaacagcctgaagtatgtgcggcctgggggcggctttgagcccaacttcatgctgtttgagaagtgtgaggtgaatggagctggggcccaccccctgtttgccttcctgcgggaggccctgcctgcccccagtgatgatgccacagccctgatgacagaccccaagctgatcacctggagccctgtgtgcagaaatgatgtggcctggaactttgagaagttcctggtgggcccagatggagtgcccctgcggcgctacagccgccgcttccagaccatcgacatcgagccagacatcgaggccctgctgagccagggccccagctgtgcctag

SEQ ID NO: 154070 - DNA, 567 bp, Artificial Sequence
  Description of Artificial Sequence: Synthetic coding sequence
atggccttcatcgccaagagcttctatgacctgagcgccatcagcctggatggagagaaggtggacttcaacaccttccggggccgggctgtgctgattgaaaatgtggccagcggcaccaccacccgggacttcacccagctgaatgagctgcagtgccgcttcccccggcggctggtggtgctgggcttcccctgcaaccagtttggccaccaggagaactgccagaatgaggagatcctgaacagcctgaagtatgtgcggcctgggggcggctaccagcccaccttcaccctggtgcagaagtgtgaggtgaatggccagaatgagcaccctgtgtttgcctacctgaaggacaagctgccctacccctatgatgaccccttcagcctgatgacagaccccaagctgatcatctggagccctgtgcggcggagtgatgtggcctggaactttgagaagttcctgattggccctgagggggagcccttccgccgctacagcaggaccttccccaccatcaacatcgagccagacatcaagaggctgctgaaggtggccatctag

SEQ ID NO: 154071 - DNA, 588 bp, Artificial Sequence
  Description of Artificial Sequence: Synthetic coding sequence
atgagcctgggccgcctgtgccgcctgctgaagccagccctgctgtgtggggccctggccgcccctggcctggccggcaccatgtgtgccagcagagatgactggaggtgtgcccgctccatgcatgagttcagcgccaaggacattgatggccacatggtgaacctggacaagtaccggggctttgtgtgcatcgtgaccaacgtggccagccagaagacagaggtgaactacacccagctggtggacctgcacgcccgctatgcagaatgtggcctgcgcatcctggccttcccctgcaaccagtttgggaagcaggagcccggcagcaatgaggagatcaaggagtttgctgctggctacaacgtgaagtttgacatgttcagcaagatctgtgtgaatggagatgatgcccaccccctgtggaagtggatgaagatccagcccaagggcaagggcatcctgggcaatgccatcaagtggaacttcaccaagttcctgattgacaagaatggctgtgtggtgaagagatatggccccatggaggagcccctggtgattgagaaggacctgccccactacttctag

SEQ ID NO: 154072 - DNA, 666 bp, Artificial Sequence
  Description of Artificial Sequence: Synthetic coding sequence
atgaccacccagctgcgggtggtgcacctgctgcccctgctgctggcctgctttgtgcagaccagccccaagcaggagaagatgaagatggactgccacaaggatgagaagggcaccatctatgactatgaggccatcgccctgaacaagaatgaatatgtgtccttcaagcagtatgtgggcaagcacatcctgtttgtgaatgtggccacctactgcggcctgacagcccagtacccagagctgaatgccctgcaggaggagctgaagccctacggcctggtggtgctgggcttcccctgcaaccagtttgggaagcaggagcccggggacaacaaggagatcctgcccggcctgaagtatgtgcggcctgggggcggctttgtgcccagcttccagctgtttgagaagggagatgtgaatggagagaaggagcagaaggtgttctccttcctgaagcacagctgcccccaccccagcgagatcctgggcaccttcaagagcatctcctgggaccctgtgaaggtgcatgacatccgctggaactttgagaagttcctggtgggcccagatggcatccctgtgatgcgctggagccaccgggccaccgtgtcctctgtgaagacagacatcctggcctacctgaagcagttcaagaccaagtag

SEQ ID NO: 154073 - DNA, 303 bp, Artificial Sequence
  Description of Artificial Sequence: Synthetic coding sequence
atgaccacccagctgcgggtggtgcacctgctgcccctgctgctggcctgctttgtgcagaccagccccaagcaggagaagatgaagatggactgccacaaggatgagaagggcaccatctatgactatgaggccatcgccctgaacaagaatgaatatgtgtccttcaagcagtatgtgggcaagcacatcctgtttgtgaatgtggccacctactgcggcctgacagcccagtacccaggcatgtctgtgcagggagaagatctctacctggtgagcagcttcctgaggaagggcatgtag

SEQ ID NO: 154074 - DNA, 573 bp, Artificial Sequence
  Description of Artificial Sequence: Synthetic coding sequence
atggccgagaagacccagaagtctgtgaagatcgcccctggagctgtggtgtgtgtggagagcgagatcagaggagatgtgaccatcggccccaggacagtcatccaccccaaggcccgcatcatcgccgaggccggccccatcgtcatcggggagggcaacctgattgaggagcaggccctgatcatcaatgcctacccagacaacatcaccccagacacagaagatcctgagcccaagcccatgatcatcggcaccaacaacgtgtttgaggtgggctgctacagccaggccatgaagatgggagacaacaacgtgattgagagcaaggcctacgtgggcagaaatgtcatcctgaccagcggctgcatcattggagcctgctgcaacctgaacacctttgaggtgatcccagaaaatacagtcatctacggggctgactgcctgcggcgggtgcagacagagcggccccagccccagaccctgcagctggacttcctgatgaagatcctgcccaactaccaccacctgaagaagaccatgaagggcagcagcacccctgtgaagaactag

SEQ ID NO: 154075 - DNA, 1440 bp, Artificial Sequence
  Description of Artificial Sequence: Synthetic coding sequence
atggcctgccggcaggagccccagccccagggccccccacctgctgctggagctgtggccagctatgactacctggtgattggaggcggcagcggcggcctggccagcgcccggcgggctgctgagctgggcgcccgggctgctgtggtggagagccacaagctgggcggcacctgtgtgaatgtgggctgtgtgcccaagaaggtgatgtggaacacagctgtgcacagcgagttcatgcatgaccacgccgactatggcttccccagctgtgagggcaagttcaactggagggtcatcaaggagaagagagatgcctacgtgtcccggctgaatgccatctaccagaacaacctgaccaagagccacatcgagatcatccggggccatgctgccttcaccagtgaccccaagcccaccatcgaggtgtctgggaagaagtacacagccccccacatcctgattgccactggaggcatgcccagcacccctcatgagagccagatccctggggccagcctgggcatcaccagtgatggcttcttccagctggaggagctgcccggccgctctgtgattgtgggcgccggctacatcgctgtggagatggccggcatcctgagcgccctgggcagcaagaccagcctgatgatcagacatgacaaggtgctgcggagctttgacagcatgatcagcaccaactgcacagaggagctggagaatgctggggtggaggtgctgaagttcagccaggtgaaggaggtgaagaagaccctgagcggcctggaggtgtccatggtgacagctgtgcccggccgcctgcctgtgatgaccatgatcccagatgtggactgcctgctgtgggccatcggccgggtgcccaacaccaaggacctgagcctgaacaagctgggcatccagacagatgacaagggccacatcatcgtggatgagttccagaacaccaacgtgaagggcatctatgctgtgggagatgtgtgtgggaaggccctgctgacccctgtggccatcgccgccggcaggaagctggcccaccggctgtttgagtacaaggaggacagcaagctggactacaacaacatccccaccgtggtgttcagccacccccccatcggcaccgtgggcctgacagaagatgaggccatccacaagtatggaattgaaaatgtgaagacctacagcaccagcttcacccccatgtaccacgctgtgaccaagaggaagaccaagtgtgtgatgaagatggtgtgtgccaacaaggaggagaaggtggtgggcatccacatgcagggcctgggctgtgatgagatgctgcagggctttgctgtggccgtgaagatgggcgccaccaaggctgactttgacaacacagtggccatccaccccaccagcagcgaggagctggtgaccctgaggtag

SEQ ID NO: 154076 - DNA, 1323 bp, Artificial Sequence
  Description of Artificial Sequence: Synthetic coding sequence
atggccctgctgccccgggccctgtctgctggggccggccccagctggaggagagctgcccgggccttccggggcttcctgctgctgctgcctgagcctgctgccctgacccgggccctgagccgggccatggcctgccggcaggagccccagccccagggccccccacctgctgctggagctgtggccagctatgactacctggtgattggaggcggcagcggcggcctggccagcgccaggagagctgctgagctgggcgcccgggctgctgtggtggagagccacaagctgggcggcacctgtgtgaatgtgggctgtgtgcccaagaaggtgatgtggaacacagctgtgcacagcgagttcatgcatgaccatgctgactatggcttccccagctgtgagggcaagttcaactggagggtcatcaaggagaagagagatgcctacgtgtcccggctgaatgccatctaccagaacaacctgaccaagagccacatcgagatcatccggggccacgccgccttcaccagtgaccccaagcccaccatcgaggtgtctgggaagaagtacacagccccccacatcctgattgccaccggcggcatgcccagcacccctcatgagagccagatccctggggccagcctgggcatcaccagtgatggcttcttccagctggaggagctgcccggccgcagcgtcatcgtgggcgccggctacatcgctgtggagatggccggcatcctgagcgccctgggcagcaagaccagcctgatgatcagacatgacaagggcatccagacagatgacaagggccacatcatcgtggatgagttccagaacaccaacgtgaagggcatctatgctgtgggagatgtgtgtgggaaggccctgctgacccctgtggccatcgctgctggcaggaagctggcccaccggctgtttgagtacaaggaggacagcaagctggactacaacaacatccccaccgtggtgttcagccacccccccatcggcaccgtgggcctgacagaagatgaggccatccacaagtatggaattgaaaatgtgaagacctacagcaccagcttcacccccatgtaccacgctgtgaccaagaggaagaccaagtgtgtgatgaagatggtgtgtgccaacaaggaggagaaggtggtgggcatccacatgcagggcctgggctgtgatgagatgctgcagggctttgctgtggccgtgaagatgggcgccaccaaggctgactttgacaacacagtggccatccaccccaccagcagcgaggagctggtgaccctgaggtag

SEQ ID NO: 154077 - DNA, 1410 bp, Artificial Sequence
  Description of Artificial Sequence: Synthetic coding sequence
atggccctgctgccccgggccctgtctgctggggccggccccagctggaggagagctgcccgggccttccggggcttcctgctgctgctgcctgagcctgctgccctgacccgggccctgagccgggccatggcctgccggcaggagccccagccccagggccccccacctgctgctggagctgtggccagctatgactacctggtgattggaggcggcagcggcggcctggccagcgccaggagagctgctgagctgggcgcccgggctgctgtggtggagagccacaagctgggcggcacctgtgtgaatgtgggctgtgtgcccaagaaggtgatgtggaacacagctgtgcacagcgagttcatgcatgaccatgctgactatggcttccccagctgtgagggcaagttcaactggagggtcatcaaggagaagagagatgcctacgtgtcccggctgaatgccatctaccagaacaacctgaccaagagccacatcgagatcatccggggccacgccgccttcaccagtgaccccaagcccaccatcgaggtgtctgggaagaagtacacagccccccacatcctgattgccaccggcggcatgcccagcacccctcatgagagccagatccctggggccagcctgggcatcaccagtgatggcttcttccagctggaggagctgcccggccgcagcgtcatcgtgggcgccggctacatcgctgtggagatggccggcatcctgagcgccctgggcagcaagaccagcctgatgatcagacatgacaaggtgctgcggagctttgacagcatgatcagcaccaactgcacagaggagctggagaatgccggcgtggaggtgctgaagttcagccagggcatccagacagatgacaagggccacatcatcgtggatgagttccagaacaccaacgtgaagggcatctatgctgtgggagatgtgtgtgggaaggccctgctgacccctgtggccatcgccgccggcaggaagctggcccaccggctgtttgagtacaaggaggacagcaagctggactacaacaacatccccaccgtggtgttcagccacccccccatcggcaccgtgggcctgacagaagatgaggccatccacaagtatggaattgaaaatgtgaagacctacagcaccagcttcacccccatgtaccacgctgtgaccaagaggaagaccaagtgtgtgatgaagatggtgtgtgccaacaaggaggagaaggtggtgggcatccacatgcagggcctgggctgtgatgagatgctgcagggctttgctgtggccgtgaagatgggcgccaccaaggctgactttgacaacacagtggccatccaccccaccagcagcgaggagctggtgaccctgaggtag

SEQ ID NO: 154078 - DNA, 1482 bp, Artificial Sequence
  Description of Artificial Sequence: Synthetic coding sequence
atggccctgctgccccgggccctgtctgctggggccggccccagctggaggagagctgcccgggccttccggggcttcctgctgctgctgcctgagcctgctgccctgacccgggccctgagccgggccatggcctgccggcaggagccccagccccagggccccccacctgctgctggagctgtggccagctatgactacctggtgattggaggcggcagcggcggcctggccagcgccaggagagctgctgagctgggcgcccgggctgctgtggtggagagccacaagctgggcggcacctgtgtgaatgtgggctgtgtgcccaagaaggtgatgtggaacacagctgtgcacagcgagttcatgcatgaccatgctgactatggcttccccagctgtgagggcaagttcaactggagggtcatcaaggagaagagagatgcctacgtgtcccggctgaatgccatctaccagaacaacctgaccaagagccacatcgagatcatccggggccacgccgccttcaccagtgaccccaagcccaccatcgaggtgtctgggaagaagtacacagccccccacatcctgattgccaccggcggcatgcccagcacccctcatgagagccagatccctggggccagcctgggcatcaccagtgatggcttcttccagctggaggagctgcccggccgcagcgtcatcgtgggcgccggctacatcgctgtggagatggccggcatcctgagcgccctgggcagcaagaccagcctgatgatcagacatgacaaggtgaaggaggtgaagaagaccctgagcggcctggaggtgtccatggtgacagctgtgcccggccgcctgcctgtgatgaccatgatcccagatgtggactgcctgctgtgggccatcggccgggtgcccaacaccaaggacctgagcctgaacaagctgggcatccagacagatgacaagggccacatcatcgtggatgagttccagaacaccaacgtgaagggcatctatgctgtgggagatgtgtgtgggaaggccctgctgacccctgtggccatcgccgccggcaggaagctggcccaccggctgtttgagtacaaggaggacagcaagctggactacaacaacatccccaccgtggtgttcagccacccccccatcggcaccgtgggcctgacagaagatgaggccatccacaagtatggaattgaaaatgtgaagacctacagcaccagcttcacccccatgtaccacgctgtgaccaagaggaagaccaagtgtgtgatgaagatggtgtgtgccaacaaggaggagaaggtggtgggcatccacatgcagggcctgggctgtgatgagatgctgcagggctttgctgtggccgtgaagatgggcgccaccaaggctgactttgacaacacagtggccatccaccccaccagcagcgaggagctggtgaccctgaggtag

SEQ ID NO: 154079 - DNA, 669 bp, Artificial Sequence
  Description of Artificial Sequence: Synthetic coding sequence
atggccgagaagcccaagctgcactacttcaatgcccggggccgcatggagagcacccgctggctgctggccgccgccggcgtggagtttgaggagaagttcatcaagtctgctgaggacctggacaagctgagaaatgatggctacctgatgttccagcaggtgcccatggtggagattgatggcatgaagctggtgcagacccgggccatcctgaactacatcgccagcaagtacaacctgtatggcaaggacatcaaggagcgggccctgattgacatgtacatcgagggcattgctgacctgggggagatgatcctgctgctgcctgtgtgccccccagaggagaaggatgccaagctggccctgatcaaggagaagatcaagaaccgctacttccctgcctttgagaaggtgctgaagagccacggccaggactacctggtgggcaacaagctgagcagagctgacatccacctggtggagctgctgtactacgtggaggagctggacagcagcctcatcagcagcttccccctgctgaaggccctgaagacccgcatcagcaacctgcccaccgtgaagaagttcctgcagcccggcagccccaggaagccacccatggatgagaagagcctggaggaggccaggaagatcttccgcttctag

SEQ ID NO: 154080 - DNA, 669 bp, Artificial Sequence
  Description of Artificial Sequence: Synthetic coding sequence
atggccgagaagcccaagctgcactacagcaacatccggggccgcatggagagcatccgctggctgctggccgccgccggcgtggagtttgaggagaagttcatcaagtctgctgaggacctggacaagctgagaaatgatggctacctgatgttccagcaggtgcccatggtggagattgatggcatgaagctggtgcagacccgggccatcctgaactacatcgccagcaagtacaacctgtatggcaaggacatcaaggagaaggccctgattgacatgtacatcgagggcattgctgacctgggggagatgatcctgctgctgcccttcagccagcctgaggagcaggatgccaagctggccctgatccaggagaagaccaagaaccgctacttccctgcctttgagaaggtgctgaagagccacggccaggactacctggtgggcaacaagctgagcagagctgacatccacctggtggagctgctgtactacgtggaggagctggacagcagcctcatcagcagcttccccctgctgaaggccctgaagacccgcatcagcaacctgcccaccgtgaagaagttcctgcagcccggcagccccaggaagccacccatggatgagaagagcctggaggagagcaggaagatcttccgcttctag

SEQ ID NO: 154081 - DNA, 729 bp, Artificial Sequence
  Description of Artificial Sequence: Synthetic coding sequence
atgctgctgctggccccccagatgctgagcctgctgctgctggccctgcctgtgctggccagccctgcctacgtggccccagcccctggccaggccctgcagcagacaggcatcgtgggcggccaggaggcccccaggagcaagtggccctggcaggtgtccctgcgggtgcggggcccctactggatgcacttctgtggcggcagcctcatccacccccagtgggtgctgacagctgcccactgtgtggagccagacatcaaggacctggccgccctgcgggtgcagctgcgggagcagcacctgtactaccaggaccagctgctgcctgtgagccgcatcatcgtgcacccccagttctacatcatccagacaggagctgacatcgccctgctggagctggaggagcctgtgaacatcagcagccacatccacacagtgaccctgcccccagccagcgagaccttccccccaggcatgccctgctgggtgacaggctggggagatgtggacaacaacgtgcacctgcccccaccctaccccctgaaggaggtggaggtgcctgtggtggagaaccacctgtgcaatgctgagtaccacacaggcctgcacacaggccacagcttccagatcgtgagagatgacatgctgtgtgccggcagcgagaaccacgacagctgccagggcgacagcggcggccccctggtgtgcaaggtgaatggcacctag

SEQ ID NO: 154082 - DNA, 519 bp, Artificial Sequence
  Description of Artificial Sequence: Synthetic coding sequence
atgttccagcaggtgcccatggtggagattgatggcatgaagctggtgcagacccgggccatcctgaactacatcgccagcaagtacaacctgtatggcaaggacatcaaggagcgggccctgattgacatgtacacagagggcatggctgacctgaatgagatgatcctgctgctgcccctgtgcaggcctgaggagaaggatgccaagatcgccctgatcaaggagaagaccaagagccgctacttccctgcctttgagaaggtgctgcagagccacggccaggactacctggtgggcaacaagctgagcagagctgacatcagcctggtggagctgctgtactacgtggaggagctggacagcagcctcatcagcaacttccccctgctgaaggccctgaagacccgcatcagcaacctgcccaccgtgaagaagttcctgcagcccggcagccccaggaagcccccagcagatgccaaggccctggaggaggccaggaagatcttccgcttctag

SEQ ID NO: 154083 - DNA, 327 bp, Artificial Sequence
  Description of Artificial Sequence: Synthetic coding sequence
atgttccagcaggtgcccatggtggagattgatggcatgaagctggtgcagacccgggccatcctgaactacatcgccagcaagtacaacctgtatggcaaggacatcaaggagcgggccctgattgacatgtacacagagggcatggctgacctgaatgagatgatcctgctgctgcccctgtgcaggcctgaggagaaggatgccaagatcgccctgatcaaggagaagaccaagagccgctacttccctgcctttgaggccgacatcagcctggtggagctgctgtactacgtggaggagctggacagcagcctcatctcctag

SEQ ID NO: 154084 - DNA, 669 bp, Artificial Sequence
  Description of Artificial Sequence: Synthetic coding sequence
atggccgcccggcccaagctgcactacccaaatggccggggccgcatggagagcgtgcgctgggtgctggccgccgccggcgtggagtttgatgaggagttcctggagaccaaggagcagctgtacaagctgcaggacggcaaccacctgctcttccagcaggtgcccatggtggagattgatggcatgaagctggtgcagaccaggagcatcctgcactacatcgctgacaagcacaacctgtttgggaagaacctgaaggagaggaccctgattgacatgtatgtggagggcaccctggacctgctggagctgctgatcatgcaccccttcctgaagccagatgaccagcagaaggaggtggtgaacatggcccagaaggccatcatccgctacttccctgtgtttgagaagatcctgcggggccacggccagagcttcctggtgggcaaccagctgagcctggctgatgtgatcctgctgcagaccatcctggccctggaggagaagatccccaacatcctgagcgccttccccttcctgcaggagtacacagtgaagctgagcaacatccccaccatcaagcgcttcctggagcccggcagcaagaagaagcccccaccagatgagatctacgtgaggacagtgtacaacatcttccggccctag

SEQ ID NO: 154085 - DNA, 390 bp, Artificial Sequence
  Description of Artificial Sequence: Synthetic coding sequence
atgtatgtggagggcaccctggacctgctggagctgctgatcatgcaccccttcctgaagccagatgaccagcagaaggaggtggtgaacatggcccagaaggccatcatccgctacttccctgtgtttgagaagatcctgcggggccacggccagagcttcctggtgggcaaccagctgagcctggctgatgtgatcctgctgcagaccatcctggccctggaggagaagatccccaacatcctgagcgccttccccttcctgcaggagtacacagtgaagctgagcaacatccccaccatcaagcgcttcctggagcccggcagcaagaagaagcccccaccagatgagatctacgtgaggacagtgtacaacatcttccggccctag

SEQ ID NO: 154086 - DNA, 669 bp, Artificial Sequence; identical to SEQ ID NO: 154084
  Description of Artificial Sequence: Synthetic coding sequence

SEQ ID NO: 154087 - DNA, 270 bp, Artificial Sequence
  Description of Artificial Sequence: Synthetic coding sequence
atgtatgtggagggcaccctggacctgctggagctgctgatcatgcaccccttcctgaagccagatgaccagcagaaggaggtggtgaacatggcccagaaggccatcatccgctacttccctgtgtttgagaagatcctgcggggccacggccagagcttcctggtgggcaaccagctgagcctggctgatgtgatcctgctgcagaccatcctggccctggaggagaagatccccaacatcctgagcgccttccccttcctgcagtag

SEQ ID NO: 154088 - DNA, 390 bp, Artificial Sequence; identical to SEQ ID NO: 154085
  Description of Artificial Sequence: Synthetic coding sequence

SEQ ID NO: 154089 - DNA, 669 bp, Artificial Sequence
  Description of Artificial Sequence: Synthetic coding sequence
atggccgagaagcccaagctgcactacagcaatgcccggggctccatggagagcatccgctggctgctggccgccgccggcgtggagctggaggagaagttcctggagagcgctgaggacctggacaagctgagaaatgatggcagcctgctcttccagcaggtgcccatggtggagattgatggcatgaagctggtgcagacccgggccatcctgaactacatcgccagcaagtacaacctgtatggcaaggacatgaaggagcgggccctgattgacatgtacacagagggcatcgtggacctgacagagatgatcctgctgctgctgatctgccagcctgaggagagagatgccaagacagccctggtgaaggagaagatcaagaaccgctacttccctgcctttgagaaggtgctgaagagccaccggcaggactacctggtgggcaacaagctgtcctgggccgacatccacctggtggagctgttctactacgtggaggagctggacagcagcctcatcagcagcttccccctgctgaaggccctgaagacccgcatcagcaacctgcccaccgtgaagaagttcctgcagcccggcagccagaggaagccacccatggatgagaagagcctggaggaggccaggaagatcttccgcttctag

SEQ ID NO: 154090 - DNA, 669 bp, Artificial Sequence; identical to SEQ ID NO: 154089
  Description of Artificial Sequence: Synthetic coding sequence

SEQ ID NO: 154091 - DNA, 657 bp, Artificial Sequence
  Description of Artificial Sequence: Synthetic coding sequence
atgcccatgatcctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaacctgccctacctgattgatggagcccacaagatcacccagagcaatgccatcctgtgctacatcgccaggaagcacaacctgtgtggggagacagaggaggagaagatccgggtggacatcctggagaaccagaccatggacaaccacatgcagctgggcatgatctgctacaaccctgagtttgagaagctgaagcccaagtacctggaggagctgcctgagaagctgaagctgtacagcgagttcctgggcaagaggccctggtttgctggcaacaagatcacctttgtggacttcctggtgtatgatgtgctggacctgcaccgcatctttgagcccaagtgcctggatgccttccccaacctgaaggacttcatcagcagatttgagggcctggagaagatcagcgcctacatgaagagcagccgcttcctgcccaggcctgtgttcagcaagatggctgtgtggggcaacaagtag

SEQ ID NO: 154092 - DNA, 546 bp, Artificial Sequence
  Description of Artificial Sequence: Synthetic coding sequence
atgcccatgatcctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaacctgccctacctgattgatggagcccacaagatcacccagagcaatgccatcctgtgctacatcgccaggaagcacaacctgtgtggggagacagaggaggagaagatccgggtggacatcctggagaaccagaccatggacaaccacatgcagctgggcatgatctgctacaaccctgagtttgagaagctgaagcccaagtacctggaggagctgcctgagaagctgaagctgtacagcgagttcctgggcaagaggccctggtttgctggcaacaagggcctggagaagatcagcgcctacatgaagagcagccgcttcctgcccaggcctgtgttcagcaagatggctgtgtggggcaacaagtag

SEQ ID NO: 154093 - DNA, 450 bp, Artificial Sequence
  Description of Artificial Sequence: Synthetic coding sequence
atgcccatgatcctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaacctgccctacctgattgatggagcccacaagatcacccagagcaatgccatcctgtgctacatcgccaggaagcacaacctgtgtggggagacagaggaggagaagatccgggtggacatcctggagaaccagaccatggacaaccacatgcagctgggcatgatctgctacaaccctgagtttggcctggagaagatcagcgcctacatgaagagcagccgcttcctgcccaggcctgtgttcagcaagatggctgtgtggggcaacaagtag

SEQ ID NO: 154094 - DNA, 714 bp, Artificial Sequence
  Description of Artificial Sequence: Synthetic coding sequence
atgcccatgatcctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaacggcatgctgggcagcctggtggcccagctgagctttgctggcttccccagcatccagctgccctacctgattgatggagcccacaagatcacccagagcaatgccatcctgtgctacatcgccaggaagcacaacctgtgtggggagacagaggaggagaagatccgggtggacatcctggagaaccagaccatggacaaccacatgcagctgggcatgatctgctacaaccctgagtttgagaagctgaagcccaagtacctggaggagctgcctgagaagctgaagctgtacagcgagttcctgggcaagaggccctggtttgctggcaacaagatcacctttgtggacttcctggtgtatgatgtgctggacctgcaccgcatctttgagcccaagtgcctggatgccttccccaacctgaaggacttcatcagcagatttgagggcctggagaagatcagcgcctacatgaagagcagccgcttcctgcccaggcctgtgttcagcaagatggctgtgtggggcaacaagtag

SEQ ID NO: 154095 - DNA, 657 bp, Artificial Sequence
  Description of Artificial Sequence: Synthetic coding sequence
atgcccatgaccctgggctactggaacatccggggcctggcccacagcatccggctgctgctggagtacacagacagcagctatgaggagaagaagtacaccatgggagatgccccagactatgacaggagccagtggctgaatgagaagttcaagctgggcctggacttccccaacctgccctacctgattgatggcacccacaagatcacccagagcaatgccatcctgcgctacatcgccaggaagcacaacctgtgtggggagagcgagaaggagcagatccgggaggacatcctggagaaccagttcatggacagcaggatgcagctggccaagctgtgctatgaccctgactttgagaagctgaagccagagtacctgcaggccctgcctgagatgctgaagctgtacagccagttcctgggcaagcagccctggttcctgggggacaagatcacctttgtggacttcatcgcctatgatgtgctggagaggaaccaggtgtttgagcccagctgcctggatgccttccccaacctgaaggacttcatcagcagatttgagggcctggagaagatcagcgcctacatgaagagcagccgcttcctgcccaggcctgtgttcaccaagatggctgtgtggggcaacaagtag

SEQ ID NO: 154096 - DNA, 540 bp, Artificial Sequence
  Description of Artificial Sequence: Synthetic coding sequence
atgaccctgggctactggaacatccggggcctggcccacagcatccggctgctgctggagtacacagacagcagctatgaggagaagaagtacaccatgggagatgccccagactatgacaggagccagtggctgaatgagaagttcaagctgggcctggacttccccaacctgccctacctgattgatggcacccacaagatcacccagagcaatgccatcctgcgctacatcgccaggaagcacaacctgtgtggggagagcgagaaggagcagatccgggaggacatcctggagaaccagttcatggacagcaggatgcagctggccaagctgtgctatgaccctgactttgagaagctgaagccagagtacctgcaggccctgcctgagatgctgaagctgtacagccagttcctgggcaagcagccctggttcctgggggacaagggcctggagaagatcagcgcctacatgaagagcagccgcttcctgcccaggcctgtgttcaccaagatggctgtgtggggcaacaagtag

SEQ ID NO: 154097 - DNA, 264 bp, Artificial Sequence
  Description of Artificial Sequence: Synthetic coding sequence
atggacagcaggatgcagctggccaagctgtgctatgaccctgactttgagaagctgaagccagagtacctgcaggccctgcctgagatgctgaagctgtacagccagttcctgggcaagcagccctggttcctgggggacaagatcacctttgtggacttcatcgcctatgatgtgctggagaggaaccaggtgtttgagcccagctgcctggatgccttccccaacctgaaggacttcatcagcagatttgagcacagctag

SEQ ID NO: 154098 - DNA, 576 bp, Artificial Sequence
  Description of Artificial Sequence: Synthetic coding sequence
atgcccatgaccctgggctactggaacatccggggcctggcccacagcatccggctgctgctggagtacacagacagcagctatgaggagaagaagtacaccatgggagatgccccagactatgacaggagccagtggctgaatgagaagttcaagctgggcctggacttccccaacctgccctacctgattgatggcacccacaagatcacccagagcaatgccatcctgcgctacatcgccaggaagcacaacctgtgtggggagagcgagaaggagcagatccgggaggacatcctggagaaccagttcatggacagcaggatgcagctggccaagctgtgctatgaccctgactttgagaagctgaagccagagtacctgcaggccctgcctgagatgctgaagctgtacagccagttcctgggcaagcagccctggttcctgggggacaagatcacctttgtggacttcatcgcctatgatgtgctggagaggaaccaggtgtttgagcccagctgcctggatgccttccccaacctgaaggacttcatcagcagatttgagcacagctag

SEQ ID NO: 154099 - DNA, 576 bp, Artificial Sequence; identical to SEQ ID NO: 154098
  Description of Artificial Sequence: Synthetic coding sequence

SEQ ID NO: 154100 - DNA, 678 bp, Artificial Sequence
  Description of Artificial Sequence: Synthetic coding sequence
atgagctgtgagagctccatggtgctgggctactgggacatccggggcctggcccacgccatccggctgctgctggagttcacagacaccagctatgaggagaagcgctacacctgtggggaggccccagactatgacaggagccagtggctggatgtgaagttcaagctggacctggacttccccaacctgccctacctgctggatggcaagaacaagatcacccagagcaatgccatcctgcgctacatcgccaggaagcacaacatgtgtggggagacagaggaggagaagatccgggtggacatcatcgagaaccaggtgatggacttccgcacccagctgatccggctgtgctacagcagtgaccacgagaagctgaagccccagtacctggaggagctgcccggccagctgaagcagttctccatgttcctgggcaagttctcctggtttgctggggagaagctgacctttgtggacttcctgacctatgacatcctggaccagaaccgcatctttgaccccaagtgcctggatgagttccccaacctgaaggccttcatgtgccgctttgaggccctggagaagattgctgcctacctgcagagcgaccagttctgcaagatgcccatcaacaacaagatggcccagtggggcaacaagcctgtgtgctag

SEQ ID NO: 154101 - DNA, 678 bp, Artificial Sequence; identical to SEQ ID NO: 154100
  Description of Artificial Sequence: Synthetic coding sequence

SEQ ID NO: 154102 - DNA, 678 bp, Artificial Sequence; identical to SEQ ID NO: 154100
  Description of Artificial Sequence: Synthetic coding sequence

SEQ ID NO: 154103 - DNA, 588 bp, Artificial Sequence
  Description of Artificial Sequence: Synthetic coding sequence
atgtccatgaccctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaacctgccctacctgattgatggagcccacaagatcacccagagcaatgccatcctgtgctacatcgccaggaagcacaacctgtgtggggagacagaggaggagaagatccgggtggacatcctggagaaccaggccatggatgtgagcaaccagctggcccgggtgtgctacagcccagactttgagaagctgaagccagagtacctggaggagctgcccaccatgatgcagcacttcagccagttcctgggcaagaggccctggtttgtgggggacaagatcacctttgtggacttcctggcctatgatgtgctggacctgcaccgcatctttgagcccaactgcctggatgccttccccaacctgaaggacttcatcagcagatttgaggtgtcctgtggcatcatgtag

SEQ ID NO: 154104 - DNA, 474 bp, Artificial Sequence
  Description of Artificial Sequence: Synthetic coding sequence
atgtccatgaccctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaatgagaagctgaagccagagtacctggaggagctgcccaccatgatgcagcacttcagccagttcctgggcaagaggccctggtttgtgggggacaagatcacctttgtggacttcctggcctatgatgtgctggacctgcaccgcatctttgagcccaactgcctggatgccttccccaacctgaaggacttcatcagcagatttgagggcctggagaagatcagcgcctacatgaagagcagccgcttcctgcccaagcccctgtacaccagggtggccgtgtggggcaacaagtag

SEQ ID NO: 154105 - DNA, 609 bp, Artificial Sequence
  Description of Artificial Sequence: Synthetic coding sequence
atgctgggcagcctgctggcccagctgtccttccctggcttccccagcatccagctgccctacctgattgatggagcccacaagatcacccagagcaatgccatcctgtgctacatcgccaggaagcacaacctgtgtggggagacagaggaggagaagatccgggtggacatcctggagaaccaggccatggatgtgagcaaccagctggcccgggtgtgctacagcccagactttgagaagctgaagccagagtacctggaggagctgcccaccatgatgcagcacttcagccagttcctgggcaagaggccctggtttgtgggggacaagatcacctttgtggacttcctggcctatgatgtgctggacctgcaccgcatctttgagcccaactgcctggatgccttccccaacctgaaggacttcatcagcagatttgaggtgatgccacccagcagcttcctgtttgatgccccctgcagcgtgaccagcttccagatgctgagccagagctggagctacatcaagaacaacctgcacctgctgtctgctggcttcatgcctggcaccctgcccagcaccctgtacctgagctgtggcatctag

SEQ ID NO: 154106 - DNA, 657 bp, Artificial Sequence
  Description of Artificial Sequence: Synthetic coding sequence
atgtccatgaccctgggctactgggacatccggggcctggcccacgccatccggctgctgctggagtacacagacagcagctatgaggagaagaagtacaccatgggagatgccccagactatgacaggagccagtggctgaatgagaagttcaagctgggcctggacttccccaacctgccctacctgattgatggagcccacaagatcacccagagcaatgccatcctgtgctacatcgccaggaagcacaacctgtgtggggagacagaggaggagaagatccgggtggacatcctggagaaccaggccatggatgtgagcaaccagctggcccgggtgtgctacagcccagactttgagaagctgaagccagagtacctggaggagctgcccaccatgatgcagcacttcagccagttcctgggcaagaggccctggtttgtgggggacaagatcacctttgtggacttcctggcctatgatgtgctggacctgcaccgcatctttgagcccaactgcctggatgccttccccaacctgaaggacttcatcagcagatttgagggcctggagaagatcagcgcctacatgaagagcagccgcttcctgcccaagcccctgtacaccagggtggccgtgtggggcaacaagtag

SEQ ID NO: 154107 - DNA, 657 bp, Artificial Sequence
  Description of Artificial Sequence: Synthetic coding sequence
atgcccatgaccctgggctactgggacatccggggcctggcccacgccatccggctgctgctggagtacacagacagcagctatgtggagaagaagtacaccctgggagatgccccagactatgacaggagccagtggctgaatgagaagttcaagctgggcctggacttccccaacctgccctacctgattgatggagcccacaagatcacccagagcaatgccatcctgcgctacatcgccaggaagcacaacctgtgtggggagacagaggaggagaagatccgggtggacatcctggagaaccaggtgatggacaaccacatggagctggtgcggctgtgctatgaccctgactttgagaagctgaagcccaagtacctggaggagctgcctgagaagctgaagctgtacagcgagttcctgggcaagaggccctggtttgctggggacaagatcacctttgtggacttcctggcctatgatgtgctggacatgaagaggatctttgagcccaagtgcctggatgccttcctgaacctgaaggacttcatcagcagatttgagggcctgaagaagatcagcgcctacatgaagagcagccagttcctgcggggcctgctgtttgggaagagcgccacctggaacagcaagtag

SEQ ID NO: 154108 - DNA, 714 bp, Artificial Sequence
  Description of Artificial Sequence: Synthetic coding sequence
atgcccatgaccctgggctactgggacatccggggcctggcccacgccatccggctgctgctggagtacacagacagcagctatgtggagaagaagtacaccctgggagatgccccagactatgacaggagccagtggctgaatgagaagttcaagctgggcctggacttccccaacggcatgctgggcagcctggtggcccagctgtccttccctggcttccccagcatccagctgccctacctgattgatggagcccacaagatcacccagagcaatgccatcctgcgctacatcgccaggaagcacaacctgtgtggggagacagaggaggagaagatccgggtggacatcctggagaaccaggtgatggacaaccacatggagctggtgcggctgtgctatgaccctgactttgagaagctgaagcccaagtacctggaggagctgcctgagaagctgaagctgtacagcgagttcctgggcaagaggccctggtttgctggggacaagatcacctttgtggacttcctggcctatgatgtgctggacatgaagaggatctttgagcccaagtgcctggatgccttcctgaacctgaaggacttcatcagcagatttgagggcctgaagaagatcagcgcctacatgaagagcagccagttcctgcggggcctgctgtttgggaagagcgccacctggaacagcaagtag

SEQ ID NO: 154109 - DNA, 609 bp, Artificial Sequence
  Description of Artificial Sequence: Synthetic coding sequence
atgctgggcagcctggtggcccagctgtccttccctggcttccccagcatccagctgccctacctgattgatggagcccacaagatcacccagagcaatgccatcctgcgctacatcgccaggaagcacaacctgtgtggggagacagaggaggagaagatccgggtggacatcctggagaaccaggtgatggacaaccacatggagctggtgcggctgtgctatgaccctgactttgagaagctgaagcccaagtacctggaggagctgcctgagaagctgaagctgtacagcgagttcctgggcaagaggccctggtttgctggggacaagatcacctttgtggacttcctggcctatgatgtgctggacatgaagaggatctttgagcccaagtgcctggatgccttcctgaacctgaaggacttcatcagcagatttgaggtgatgccacccagcagcttcctgtttgatgccccctgcagcttcctgtccttccagatgctgagccagagctggagctacaccaagaacaacagctatgtgctgagcacaggcttcatgcctggcatcatgcccagcaccctgtacctgagctgccgcatctag

SEQ ID NO: 154110 - DNA, 627 bp, Artificial Sequence
  Description of Artificial Sequence: Synthetic coding sequence
atgtctggagagagcgcccggagcctgggcaaaggaagtgcccctcctggccctgtgcctgagggcagcatccgcatctacagcatgaggttctgcccctttgctgagaggacccggctggtgctgaaggccaagggcatcagacatgaagtcatcaacatcaacctgaagaacaagccagagtggttcttcaagaagaaccccttcggcctggtgcctgtgctggagaacagccagggccagctgatctatgagagcgccatcacctgtgagtacctggatgaggcctacccaggcaagaagctgctgcctgatgacccctatgagaaggcctgccagaagatgatcctggagctgttcagcaaggtgctgaccaacaagaagaccaccttcttcggcggcaacagcatctccatgattgactacctgatctggccctggtttgagcggctggaggccatgaagctgaatgaatgtgtggaccacacccccaagctgaagctgtggatggccgccatgaaggaggaccccaccgtgtctgccctgctgaccagcgagaaggactggcagggcttcctggagctgtacctgcagaacagccctgaggcctgtgactatggcctgtag

SEQ ID NO: 154111 - DNA, 726 bp, Artificial Sequence
  Description of Artificial Sequence: Synthetic coding sequence
atgtctggagagagcgcccggagcctgggcaaaggaagtgcccctcctggccctgtgcctgagggcagcatccgcatctacagcatgaggttctgcccctttgctgagaggacccggctggtgctgaaggccaagggcatcagacatgaagtcatcaacatcaacctgaagaacaagccagagtggttcttcaagaagaaccccttcggcctggtgcctgtgctggagaacagccagggccagctgatctatgagagcgccatcacctgtgagtacctggatgaggcctacccaggcaagaagctgctgcctgatgacccctatgagaaggcctgccagaagatgatcctggagctgttcagcaaggtgcccagcctggtgggcagcttcatccgcagccagaacaaggaggactatgccggcctgaaggaggagttcaggaaggagttcaccaagctggaggaggtgctgaccaacaagaagaccaccttctttggaggcaacagcatctccatgattgactacctgatctggccctggtttgagcggctggaggccatgaagctgaatgaatgtgtggaccacacccccaagctgaagctgtggatggccgccatgaaggaggaccccaccgtgtctgccctgctgaccagcgagaaggactggcagggcttcctggagctgtacctgcagaacagccctgaggcctgtgactatggcctgtag

SEQ ID NO: 154112 - DNA, 543 bp, Artificial Sequence
  Description of Artificial Sequence: Synthetic coding sequence
atgaggttctgcccctttgctgagaggacccggctggtgctgaaggccaagggcatcagacatgaagtcatcaacatcaacctgaagaacaagccagagtggttcttcaagaagaaccccttcggcctggtgcctgtgctggagaacagccagggccagctgatctatgagagcgccatcacctgtgagtacctggatgaggcctacccaggcaagaagctgctgcctgatgacccctatgagaaggcctgccagaagatgatcctggagctgttcagcaaggtgctgaccaacaagaagaccaccttcttcggcggcaacagcatctccatgattgactacctgatctggccctggtttgagcggctggaggccatgaagctgaatgaatgtgtggaccacacccccaagctgaagctgtggatggccgccatgaaggaggaccccaccgtgtctgccctgctgaccagcgagaaggactggcagggcttcctggagctgtacctgcagaacagccctgaggcctgtgactatggcctgtag

SEQ ID NO: 154113 - DNA, 603 bp, Artificial Sequence
  Description of Artificial Sequence: Synthetic coding sequence
atgaggttctgcccctttgctgagaggacccggctggtgctgaaggccaagggcatcagacatgaagtcatcaacatcaacctgaagaacaagccagagtggttcttcaagaagaaccccttcggcctggtgcctgtgctggagaacagccagggccagctgatctatgagagcgccatcacctgtgagtacctggatgaggcctacccaggcaagaagctgctgcctgatgacccctatgagaaggcctgccagaagatgatcctggagctgttcagcaaggtgcccagcctggtgggcagcttcatccgcagccagaacaaggaggactatgccggcctgaaggaggagttcaggaaggagttcaccaagctggaggaggtgctgaccaacaagaagaccaccttctttggaggcaacagcatctccatgattgactacctgatctggccctggtttgagcggctggaggccatgaagctgaatgaatgtgtggaccacacccccaagctgaagctgtggatggccgccatgaaggaggaccccaccgtgtctgccctgctgaccagcgagaaggactggcagggcttcctggagctgtag

SEQ ID NO: 154114 - DNA, 642 bp, Artificial Sequence
  Description of Artificial Sequence: Synthetic coding sequence
atgaggttctgcccctttgctgagaggacccggctggtgctgaaggccaagggcatcagacatgaagtcatcaacatcaacctgaagaacaagccagagtggttcttcaagaagaaccccttcggcctggtgcctgtgctggagaacagccagggccagctgatctatgagagcgccatcacctgtgagtacctggatgaggcctacccaggcaagaagctgctgcctgatgacccctatgagaaggcctgccagaagatgatcctggagctgttcagcaaggtgcccagcctggtgggcagcttcatccgcagccagaacaaggaggactatgccggcctgaaggaggagttcaggaaggagttcaccaagctggaggaggtgctgaccaacaagaagaccaccttctttggaggcaacagcatctccatgattgactacctgatctggccctggtttgagcggctggaggccatgaagctgaatgaatgtgtggaccacacccccaagctgaagctgtggatggccgccatgaaggaggaccccaccgtgtctgccctgctgaccagcgagaaggactggcagggcttcctggagctgtacctgcagaacagccctgaggcctgtgactatggcctgtag

SEQ ID NO: 154115 - DNA, 732 bp, Artificial Sequence
  Description of Artificial Sequence: Synthetic coding sequence
atgtctggagatgccaccaggaccctgggcaagggcagccagcccccaggccctgtgcctgagggcctcatccgcatctacagcatgaggttctgcccctacagccacaggacccggctggtgctgaaggccaaggacatcagacatgaggtggtgaacatcaacctgaggaacaagccagagtggtactacaccaagcaccccttcggccacatccctgtgctggagaccagccagtgccagctgatctatgagagcgtcatcgcctgtgagtacctggatgatgcctacccaggcaggaagctgttcccctatgacccctatgaaagagcccggcagaagatgctgctggagctgttctgcaaggtgccccacctgaccaaggaatgtctggtggccctgcgctgtggcagagaatgtaccaacctgaaggccgccctgcggcaggagttcagcaacctggaggagatcctggagtaccagaacaccaccttcttcggcggcacctgcatctccatgattgactacctgctgtggccctggtttgagcggctggatgtgtatggcatcctggactgtgtgagccacaccccagccctgcggctgtggatcagcgccatgaagtgggaccccaccgtgtgtgccctgctgatggacaagagcatcttccagggcttcctgaacctgtacttccagaacaaccccaatgcctttgattttggcctgtgctag

SEQ ID NO: 154116 - DNA, 648 bp, Artificial Sequence
  Description of Artificial Sequence: Synthetic coding sequence
atgaggttctgcccctacagccacaggacccggctggtgctgaaggccaaggacatcagacatgaggtggtgaacatcaacctgaggaacaagccagagtggtactacaccaagcaccccttcggccacatccctgtgctggagaccagccagtgccagctgatctatgagagcgtcatcgcctgtgagtacctggatgatgcctacccaggcaggaagctgttcccctatgacccctatgaaagagcccggcagaagatgctgctggagctgttctgcaaggtgccccacctgaccaaggaatgtctggtggccctgcgctgtggcagagaatgtaccaacctgaaggccgccctgcggcaggagttcagcaacctggaggagatcctggagtaccagaacaccaccttcttcggcggcacctgcatctccatgattgactacctgctgtggccctggtttgagcggctggatgtgtatggcatcctggactgtgtgagccacaccccagccctgcggctgtggatcagcgccatgaagtgggaccccaccgtgtgtgccctgctgatggacaagagcatcttccagggcttcctgaacctgtacttccagaacaaccccaatgcctttgattttggcctgtgctag

SEQ ID NO: 154117 - DNA, 732 bp, Artificial Sequence; identical to SEQ ID NO: 154115
  Description of Artificial Sequence: Synthetic coding sequence

SEQ ID NO: 154118 - DNA, 501 bp, Artificial Sequence
  Description of Artificial Sequence: Synthetic coding sequence
atgtctggagatgccaccaggaccctgggcaagggcagccagcccccaggccctgtgcctgagggcctcatccgcatctacagcatgaggttctgcccctacagccacaggacccggctggtgctgaaggccaaggacatcagacatgaggtggtgaacatcaacctgaggaacaagccagagtggtactacaccaagcaccccttcggccacatccctgtgctggagaccagccagtgccagctgatctatgagagcgtcatcgcctgtgagtacctggatgatgcctacccaggcaggaagctgttcccctatgacccctatgaaagagcccggcagaagatgctgctggagctgttctgcaaggtgccccacctgaccaaggaatgtctggtggccctgcgctgtggcagagaatgtaccaacctgaaggccgccctgcggcaggagttcagcaacctggaggaggacaggaagaagaggaagttcatccctggatag

SEQ ID NO: 154119 - DNA, 366 bp, Artificial Sequence
  Description of Artificial Sequence: Synthetic coding sequence
atgaggttctgcccctacagccacaggacccggctggtgctgaaggccaaggacatcagacatgaggtggtgaacatcaacctgaggaacaagccagagtggtactacaccaagcaccccttcggccacatccctgtgctggagaccagccagtgccagctgatctatgagagcgtcatcgcctgtgagtacctggatgatgcctacccaggcaggaagctgttcccctatgacccctatgaaagagcccggcagaagatgctgctggagctgttctgcaagctgtgtgagccccacgccagccctgctgccctggacatcagccatgaggtgggcccccacagcctgtgcagcagccacggctag

SEQ ID NO: 154120 - DNA, 630 bp, Artificial Sequence
  Description of Artificial Sequence: Synthetic coding sequence
atgtctggagatgccaccaggaccctgggcaagggcagccagcccccaggccctgtgcctgagggcctcatccgcatctacagcatgaggttctgcccctacagccacaggacccggctggtgctgaaggccaaggacatcagacatgaggtggtgaacatcaacctgaggaacaagccagagtggtactacaccaagcaccccttcggccacatccctgtgctggagaccagccagtgccagctgatctatgagagcgtcatcgcctgtgagtacctggatgatgcctacccaggcaggaagctgttcccctatgacccctatgaaagagcccggcagaagatgctgctggagctgttctgcaagatcctggagtaccagaacaccaccttcttcggcggcacctgcatctccatgattgactacctgctgtggccctggtttgagcggctggatgtgtatggcatcctggactgtgtgagccacaccccagccctgcggctgtggatcagcgccatgaagtgggaccccaccgtgtgtgccctgctgatggacaagagcatcttccagggcttcctgaacctgtacttccagaacaaccccaatgcctttgattttggcctgtgctag

SEQ ID NO: 154121 - DNA, 723 bp, Artificial Sequence
  Description of Artificial Sequence: Synthetic coding sequence
atgggcctggagctgtacctggacctgctgagccagccctgcagagctgtgtacatctttgccaagaagaatgacatcccctttgagctgcgcatcgtggacctgatcaagggccagcacctgagtgatgcctttgcccaggtgaaccccctgaagaaggtgcctgccctgaaggatggagacttcaccctgacagaatctgtggccatcctgctgtacctgaccaggaagtacaaggtgcctgactactggtacccccaggacctgcaggcccgggcccgggtggatgagtacctggcctggcagcacaccaccctgcggcgcagctgcctgcgggccctgtggcacaaggtgatgtttcctgtgttcctgggggagcctgtgagcccccagaccctggccgccaccctggccgagctggatgtgaccctgcagctgctggaggacaagttcctgcagaacaaggccttcctgaccggcccccacatcagcctggccgacctggtggccatcacagagctgatgcaccctgtgggcgccggctgccaggtgtttgagggccggcccaagctggccacctggaggcagagggtggaggccgctgtgggggaggacctcttccaggaggcccatgaagtcatcctgaaggccaaggacttccccccagctgaccccaccatcaagcagaagctgatgccctgggtgctggccatgatcagatag

SEQ ID NO: 154122 - DNA, 486 bp, Artificial Sequence
  Description of Artificial Sequence: Synthetic coding sequence
atgggcctggagctgtacctggacctgctgagccagccctgcagagctgtgtacatctttgccaagaagaatgacatcccctttgagctgcgcatcgtggacctgatcaagggcgtgatgtttcctgtgttcctgggggagcctgtgagcccccagaccctggccgccaccctggccgagctggatgtgaccctgcagctgctggaggacaagttcctgcagaacaaggccttcctgaccggcccccacatcagcctggccgacctggtggccatcacagagctgatgcaccctgtgggcgccggctgccaggtgtttgagggccggcccaagctggccacctggaggcagagggtggaggccgctgtgggagaagatctcttccaggaggcccacgaggtgatcctgaaggccaaggacttccccccagctgaccccaccatcaagcagaagctgatgccctgggtgctggccatgatcagatag

SEQ ID NO: 154123 - DNA, 369 bp, Artificial Sequence
  Description of Artificial Sequence: Synthetic coding sequence
atgtttcctgtgttcctgggggagcctgtgagcccccagaccctggccgccaccctggccgagctggatgtgaccctgcagctgctggaggacaagttcctgcagaacaaggccttcctgaccggcccccacatcagcctggccgacctggtggccatcacagagctgatgcaccctgtgggcgccggctgccaggtgtttgagggccggcccaagctggccacctggaggcagagggtggaggccgctgtgggggaggacctcttccaggaggcccatgaagtcatcctgaaggccaaggacttccccccagctgaccccaccatcaagcagaagctgatgccctgggtgctggccatgatcagatag

SEQ ID NO: 154124 - DNA, 198 bp, Artificial Sequence
  Description of Artificial Sequence: Synthetic coding sequence
atgggcctggagctgtacctggacctgctgagccagccctgcagagctgtgtacatctttgccaagaagaatgacatcccctttgagctgcgcatcgtggacctgatcaagggccagcacctgagtgatgcctttgcccaggtgaaccccctgaagaaggtgcctgccctgaaggatggagacttcaccctgacctag

SEQ ID NO: 154125 - DNA, 219 bp, Artificial Sequence
  Description of Artificial Sequence: Synthetic coding sequence
atgggcctggagctgtacctggacctgctgagccagccctgcagagctgtgtacatctttgccaagaagaatgacatcccctttgagctgcgcatcgtggacctgatcaaggcccggggctgctggctgcccagcctgcggcggcccacccaggccggccacatggctgctgcccggggcggcagcagcggcggcggccccctgcccggcggcccctag

SEQ ID NO: 154126 - DNA, 405 bp, Artificial Sequence
  Description of Artificial Sequence: Synthetic coding sequence
atgcccttcctggagctggacaccaacctgcctgccaacagagtgcctgctggcctggagaagaggctgtgtgccgctgctgccagcatcctgggcaagccagctgacagagtgaatgtgacagtgcggcccggcctggccatggccctgagcggcagcacagagccctgtgcccagctgagcatcagcagcattggagtggtgggcacagctgaggacaacagaagccacagcgcccacttctttgagttcctgaccaaggagctggccctgggccaggaccgcttccccaccgtgctgagcaccagccctgctgcccatggaggcccccgctgccctggagagatcatcgagggcaagaagagctgcctgaatgaggaggccctcttcatctacttcatctag

SEQ ID NO: 154127 - DNA, 831 bp, Artificial Sequence
  Description of Artificial Sequence: Synthetic coding sequence
atgcctgtgcctgcctcctggccccaccccccaggccccttcctgctgctgaccctgctgctgggcctgacagaggtggccggggaggaggagctgcagatgatccagcctgagaagctgctgctggtgacagtgggcaagacagccaccctgcactgcaccgtgaccagcctgctgcctgtgggccctgtgctgtggttccggggcgtgggccctggccgggagctgatctacaaccagaaggagggccacttcccccgggtgaccaccgtgtctgacctgaccaagaggaacaacatggacttcagcatccgcatcagcagcatcaccccagcagatgtgggcacctactactgtgtgaagttcaggaagggcagcccagaaaatgtggagttcaagagcggccctggaacagagatggccctgggcgccaagcccagcgcccctgtggtgctgggccctgctgcccggaccaccccagagcacacagtgtccttcacctgtgagagccacggcttcagcccccgggacatcaccctgaagtggttcaagaatggaaatgagctgagtgacttccagaccaacgtggaccccaccggccagagcgtggcctacagcatccgcagcacagcccgggtggtgctggacccctgggatgtgcgcagccaggtgatctgtgaggtggcccacgtgaccctgcagggcgaccccctgcggggcacagccaacctgtctgaggccatccggggccctgccagcagcctgacagccctgctgctgattgctgtgctgctgggccccatctacgtgccctggaagcagaagacctag

SEQ ID NO: 154128 - DNA, 1092 bp, Artificial Sequence
  Description of Artificial Sequence: Synthetic coding sequence
atggccaccaactggggcagcctgctgcaggacaagcagcagctggaggagctggcccggcaggccgtggaccgggccctggccgagggcgtgctgctgcggaccagccaggagcccaccagcagcgaggtggtgtcctatgcccccttcaccctcttccccagcctggtgcccagcgccctgctggagcaggcctatgctgtgcagatggacttcaacctgctggtggatgctgtgtcccagaatgctgccttcctggagcagaccctgagcagcgccctggtgctgctgattgcccaggagaaggagaggaacatctttgaccagagggccattgaaaatgagctgctggccaggaacatccacgtgatccggaggacctttgaggacatcagcgagaagggcagcctggaccaggacagaagactctttgtggatggccaggagattgctgtggtgtacttcagagatggctacatgccccggcagtacagcctgcagaactgggaggcccggctgctgctggagaggagccacgccgccaagtgcccagacatcgccacccagctggccggcaccaagaaggtgcagcaggagctgagcaggcctggcatgctggagatgctgctgcccggccagcctgaggccgtggcccggctgcgggccacctttgctggcctgtacagcctggatgtgggggaggagggggaccaggccatcgccgaggccctggccgcccccagcagatttgtgctgaagccccagcgggagggcggcggcaacaacctgtatggagaggagatggtgcaggccctgaagcagctgaaggacagcgaggagcgggccagctacatcctgatggagaagattgagcctgagccctttgagaactgcctgctgcggcccggcagccctgcccgggtggtgcagtgcatcagcgagctgggcatcttcggcgtgtatgtgcggcaggagaagaccctggtgatgaacaagcacgtgggccacctgctgcggaccaaggccattgaacatgctgatggaggagtggccgccggcgtggccgtgctggacaacccctaccctgtgtag

SEQ ID NO: 154129 - DNA, 1041 bp, Artificial Sequence
  Description of Artificial Sequence: Synthetic coding sequence
atgttccagaggtctgcagatggcagccctgccctgaagcagatcgagatcaacaccatcagcgccagctttggaggcctggccagcaggaccccagctgtgcacagacatgtgctgtctgtgctgagcaagaccaaggaggccggcaagatcctgagcaacaaccccagcaagggcctggccctgggcatcgccaaggcctgggagctgtatggcagccccaatgccctggtgctgctgattgcccaggagaaggagaggaacatctttgaccagagggccattgaaaatgagctgctggccaggaacatccacgtgatccggaggacctttgaggacatcagcgagaagggcagcctggaccaggaccggcggctgtttgtggatggccaggagattgctgtggtgtacttcagagatggctacatgccccggcagtacagcctgcagaactgggaggcccggctgctgctggagaggagccatgctgccaagtgcccagacatcgccacccagctggccggcaccaagaaggtgcagcaggagctgagccggcccggcatgctggagatgctgctgcccggccagcctgaggccgtggcccggctgcgggccacctttgctggcctgtacagcctggatgtgggggaggagggggaccaggccatcgccgaggccctggccgcccccagcagatttgtgctgaagccccagcgggagggcggcggcaacaacctgtatggagaggagatggtgcaggccctgaagcagctgaaggacagcgaggagcgggccagctacatcctgatggagaagattgagcctgagccctttgagaactgcctgctgcggcccggcagccctgcccgggtggtgcagtgcatcagcgagctgggcatctttggagtgtatgtgcggcaggagaagaccctggtgatgaacaagcacgtgggccacctgctgcggaccaaggccatcgagcacgcagatggcggcgtggccgccggcgtggccgtgctggacaacccctaccctgtgtag

SEQ ID NO: 154130 - DNA, 768 bp, Artificial Sequence
  Description of Artificial Sequence: Synthetic coding sequence
atgagcagcatcggcaccggctatgacctgagcgccagcaccttctccccagatggccgggtcttccaggtggagtatgccatgaaggctgtggagaacagcagcacagccatcggcatccgctgcaaggatggagtggtgtttggagtggagaagctggtgctgagcaagctgtatgaggagggcagcaacaagaggctcttcaacgtggacagacatgtgggcatggctgtggccggcctgctggctgatgcccggagcctggccgacatcgcccgggaggaggccagcaacttccgcagcaactttggctacaacatccccctgaagcacctggccgacagagtggccatgtatgtgcacgcctacaccctgtacagcgctgtgcggcccttcggctgcagcttcatgctgggcagctacagcgtgaatgatggagcccagctgtacatgattgaccccagcggcgtgtcctatggctactggggctgtgccatcggcaaggcccggcaggccgccaagacagaaattgagaagctgcagatgaaggagatgacctgccgggacatcgtgaaggaggtggccaagatcatctacatcgtgcatgatgaggtgaaggacaaggcctttgagctggagctgtcctgggtgggggagctgaccaacggcagacatgaaattgtgcccaaggacatccgggaggaggccgagaagtatgccaaggagagcctgaaggaggaggatgaaagtgatgatgacaacatgtag

SEQ ID NO: 154131 - DNA, 525 bp, Artificial Sequence
  Description of Artificial Sequence: Synthetic coding sequence
atgcaggccggcaagcccatcctgtacagctacttccgcagcagctgctcctggagggtgcgcatcgccctggccctgaagggcattgattatgaaacagtgcccatcaacctgatcaaggatggcggccagcagttcagcaaggacttccaggccctgaaccccatgaagcaggtgcccaccctgaagattgatggcatcaccatccaccagagcaacctgtctgtgctgaagcaggtgggggaggagatgcagctgacctgggcccagaatgccatcacctgtggcttcaatgccctggagcagatcctgcagagcacagctggcatctactgtgtgggagatgaggtgaccatggctgacctgtgcctggtgccccaggtggccaatgctgagcgcttcaaggtggacctgaccccctaccccaccatcagcagcatcaacaagaggctgctggtgctggaggccttccaggtgagccacccctgccggcagcctgacacccccacagagctgcgggcctag

SEQ ID NO: 154132 - DNA, 486 bp, Artificial Sequence
  Description of Artificial Sequence: Synthetic coding sequence
atgaagcaggtgcccaccctgaagattgatggcatcaccatccaccagagcctggccatcatcgagtacctggaggagatgaggcccaccccccggctgctgccccaggaccccaagaagagggcctctgtgaggatgatcagtgacctgattgctgggggcatccagcccctgcagaacctgtctgtgctgaagcaggtgggggaggagatgcagctgacctgggcccagaatgccatcacctgtggcttcaatgccctggagcagatcctgcagagcacagctggcatctactgtgtgggagatgaggtgaccatggctgacctgtgcctggtgccccaggtggccaatgctgagcgcttcaaggtggacctgaccccctaccccaccatcagcagcatcaacaagaggctgctggtgctggaggccttccaggtgagccacccctgccggcagcctgacacccccacagagctgcgggcctag

SEQ ID NO: 154133 - DNA, 486 bp, Artificial Sequence; identical to SEQ ID NO: 154132
  Description of Artificial Sequence: Synthetic coding sequence

SEQ ID NO: 154134 - DNA, 180 bp, Artificial Sequence
  Description of Artificial Sequence: Synthetic coding sequence
atgaagcaggtgcccaccctgaagattgatggcatcaccatccaccagagcctggccatcatcgagtacctggaggagatgaggcccaccccccggctgctgccccaggaccccaagaagagggcctctgtgaggatgatcagtgacctgattgctgggggcatccagcccctgcagtag

SEQ ID NO: 154135 - DNA, 117 bp, Artificial Sequence
  Description of Artificial Sequence: Synthetic coding sequence
atgaagcaggtgcccaccctgaagattgatggcatcaccatccaccagagcctggccatcatcgagtacctggaggagatgaggcccaccccccggctgctgccccaggacccctag

SEQ ID NO: 154136 - DNA, 486 bp, Artificial Sequence; identical to SEQ ID NO: 154132
  Description of Artificial Sequence: Synthetic coding sequence

SEQ ID NO: 154137 - DNA, 387 bp, Artificial Sequence
  Description of Artificial Sequence: Synthetic coding sequence
atggccggcaacctgctgtctggagctggaagaaggctgtgggactgggtgcccctggcctgccgctccttcagcctgggcgtgcccaggctcatcggcatccggctgaccctgcccccacccaaggtggtggaccgctggaatgagaagagggccatgtttggagtgtatgacaacatcggcatcctgggcaactttgagaagcaccccaaggagctgatccggggccccatctggctgcggggctggaagggaaatgagctgcagcgctgcatcaggaagaggaagatggtgggcagcaggatgtttgctgatgacctgcacaacctgaacaagaggatccgctacctgtacaagcacttcaacagacatggcaagttcagatag

SEQ ID NO: 154138 - DNA, 783 bp, Artificial Sequence
  Description of Artificial Sequence: Synthetic coding sequence
atggaggagatgagggaccccagcaagatcaagtggggagatgctggagcagaatatgtggtggagagcactggagtcttcaccaccatggagaaggccggggcccacctgcagggcggggccaagagggtcatcatcagcgcccccagcgcagatgcccccatgtttgtgatgggcgtgaaccacgagaagtatgacaacagcctgaagatcatcagcaatgccagctgcaccaccaactgcctggcccccctggccaaggtgattcatgacaactttggaattgtggagggcctgatgaccaccgtgcacgccatcacagccacccagaagacagtggatggccccagcggcaagctgtggagagatggccgcggggccctgcagaacatcatcccagccagcactggagctgccaaggctgtgggcaaggtgattcctgagctgaatggcaagctgaccggcatggccttccgggtgcccacagccaacgtgtctgtggtggacctgacctgccgcctggagaagccagccaagtatgatgacatcaagaaggtggtgaagcaggccagcgagggccccctgaagggcatcctgggctacacagagcaccaggtggtgtccagtgacttcaacagcgacacccacagcagcacctttgatgctggggccggcatcgccctgaatgaccactttgtgaagctgatctcctggtatgacaatgaatttggctacagcaacagagtggtggacctgatggcccacatggccagcaaggagtag

SEQ ID NO: 154139 - DNA, 882 bp, Artificial Sequence
  Description of Artificial Sequence: Synthetic coding sequence
atggtgtacatgttccagtatgacagcacccacggcaagttccatggaacagtgaaggcagaaaatggcaagctggtgatcaatggaaaccccatcaccatcttccaggagcgggaccccagcaagatcaagtggggagatgctggagcagaatatgtggtggagagcactggagtcttcaccaccatggagaaggccggggcccacctgcagggcggggccaagagggtcatcatcagcgcccccagcgcagatgcccccatgtttgtgatgggcgtgaaccacgagaagtatgacaacagcctgaagatcatcagcaatgccagctgcaccaccaactgcctggcccccctggccaaggtgattcatgacaactttggcatcgtggagggcctgatgaccaccgtgcacgccatcacagccacccagaagacagtggatggccccagcggcaagctgtggagagatggccgcggggccctgcagaacatcatcccagccagcactggagctgccaaggctgtgggcaaggtgattcctgagctgaatggcaagctgaccggcatggccttccgggtgcccacagccaacgtgtctgtggtggacctgacctgccgcctggagaagccagccaagtatgatgacatcaagaaggtggtgaagcaggccagcgagggccccctgaagggcatcctgggctacacagagcaccaggtggtgtccagtgacttcaacagcgacacccacagcagcacctttgatgctggagctggcatcgccctgaatgaccactttgtgaagctgatctcctggtatgacaatgaatttggctacagcaacagagtggtggacctgatggcccacatggccagcaaggagtag

SEQ ID NO: 154140 - DNA, 1008 bp, Artificial Sequence
  Description of Artificial Sequence: Synthetic coding sequence
atgggcaaggtgaaggtgggcgtgaatggatttggccgcatcggccgcctggtgaccagggctgccttcaacagcggcaaggtggacatcgtggccatcaatgaccccttcatcgacctgaactacatggtgtacatgttccagtatgacagcacccacggcaagttccatggaacagtgaaggcagaaaatggcaagctggtgatcaatggaaaccccatcaccatcttccaggagcgggaccccagcaagatcaagtggggagatgctggagcagaatatgtggtggagagcactggagtcttcaccaccatggagaaggccggggcccacctgcagggcggggccaagagggtcatcatcagcgcccccagcgcagatgcccccatgtttgtgatgggcgtgaaccacgagaagtatgacaacagcctgaagatcatcagcaatgccagctgcaccaccaactgcctggcccccctggccaaggtgattcatgacaactttggcatcgtggagggcctgatgaccaccgtgcacgccatcacagccacccagaagacagtggatggccccagcggcaagctgtggagagatggccgcggggccctgcagaacatcatcccagccagcactggagctgccaaggctgtgggcaaggtgattcctgagctgaatggcaagctgaccggcatggccttccgggtgcccacagccaacgtgtctgtggtggacctgacctgccgcctggagaagccagccaagtatgatgacatcaagaaggtggtgaagcaggccagcgagggccccctgaagggcatcctgggctacacagagcaccaggtggtgtccagtgacttcaacagcgacacccacagcagcacctttgatgctggagctggcatcgccctgaatgaccactttgtgaagctgatctcctggtatgacaatgaatttggctacagcaacagagtggtggacctgatggcccacatggccagcaaggagtag

SEQ ID NO: 154141 - DNA, 1008 bp, Artificial Sequence; identical to SEQ ID NO: 154140
  Description of Artificial Sequence: Synthetic coding sequence

SEQ ID NO: 154142 - DNA, 648 bp, Artificial Sequence
  Description of Artificial Sequence: Synthetic coding sequence
atgggcaaggtgaaggtgggcgtgaatggatttggccgcatcggccgcctggtgaccagggctgccttcaacagcggcaaggtggacatcgtggccatcaatgaccccttcatcgacctgaactacatggtgtacatgttccagtatgacagcacccacggcaagttccatggaacagtgaaggcagaaaatggcaagctggtgatcaatggaaaccccatcaccatcttccaggagcgggaccccagcaagatcaagtggggagatgctggagcagaatatgtggtggagagcactggagtcttcaccaccatggagaaggccggggcccacctgcagggcggggccaagagggtcatcatcagcgcccccagcgcagatgcccccatgtttgtgatgggcgtgaaccacgagaagtatgacaacagcctgaagatcatcagcaatgccagctgcaccaccaactgcctggcccccctggccaaggtgattcatgacaactttggcatcgtggagggcctgatgaccaccgtgcacgccatcacagccacccagcgggaggcccactggcacggcctgccctgcccccactgccagagggtgtctgggggccctgacctgcccagcaggaagacctgccagatctag

SEQ ID NO: 154143 - DNA, 675 bp, Artificial Sequence
  Description of Artificial Sequence: Synthetic coding sequence
atgaccctcttccacttcggcaactgctttgccctggcctacttcccctacttcatcacctacaagtgcagcggcctgtctgagtacaatgccttctggaagtgtgtgcaggccggcgtgacctacctgtttgtgcagctgtgcaagatgctgttcctggccaccttcttccccacctgggagggcggcatctatgacttcatcggggagttcatgaaggcctctgtggatgtggccgacctgattggcctgaacctggtgatgagcagaaatgctgggaagggggagtacaagatcatggtggccgccctgggctgggccacagctgagctgatcatgagccgctgcatccccctgtgggtgggcgcccggggcatcgagtttgactggaagtacatccagatgagcattgacagcaacatcagcctggtgcactacatcgtggccagcgcccaggtgtggatgatcaccaggtatgacctgtaccacaccttccggcctgctgtgctgctgctgatgttcctgtctgtgtacaaggcctttgtgatggagacctttgtgcacctgtgcagcctgggctcctgggccgccctgctggcccgggctgtggtgacaggcctgctggccctgagcaccctggccctgtatgtggccgtggtgaatgtgcacagctag

SEQ ID NO: 154144 - DNA, 1104 bp, Artificial Sequence
  Description of Artificial Sequence: Synthetic coding sequence
atggctgctgccctgcaggtgctgccccggctggcccgggcccccctgcaccccctgctgtggaggggctctgtggcccggctggccagctccatggccctggccgagcaggcccggcagctgtttgagagcgctgtgggcgctgtgctgcccggccccatgctgcaccgggccctgagcctggaccccggcggccggcagctgaaggtgcgggacaggaacttccagctgcggcagaacctgtacctggtgggctttgggaaggctgtgctgggcatggctgctgctgctgaggagctgctgggccagcacctggtgcagggcgtcatctctgtgcccaagggcatccgggccgccatggagagagctgggaagcaggagatgctgctgaagccccacagccgggtgcaggtgtttgaaggagctgaggacaacctgcctgacagagatgccctgcgggccgccctggccatccagcagctggccgagggcctgacagcagatgacctgctgctggtgctgatcagcggcggcggcagcgccctgctgcctgcccccatcccccctgtgaccctggaggagaagcagaccctgacccggctgctggccgcccggggggccaccatccaggagctgaacaccatcaggaaggccctgagccagctgaagggcggcggcctggcccaggccgcctacccagcccaggtggtgtccctcatcctgagtgatgtggtgggggaccctgtggaggtgattgccagcggccccaccgtggccagcagccacaacgtgcaggactgcctgcacatcctgaacagatatggcctgcgggccgccctgcccaggtctgtgaagacagtgctgagcagagctgacagcgacccccacggcccccacacctgtggccacgtgctgaatgtcatcatcggcagcaatgtgctggccctggccgaggcccagaggcaggccgaggccctgggctaccaggccgtggtgctgtctgctgccatgcagggctggggcaccccagctgcccacagagatgaccgctaccagtgccacggccacccccccctggtgcctgctgcctctgtgatggcctag

SEQ ID NO: 154145 - DNA, 705 bp, Artificial Sequence
  Description of Artificial Sequence: Synthetic coding sequence
atggctgctgccctgcaggtgctgccccggctggcccgggcccccctgcaccccctgctgtggaggggctctgtggcccggctggccagctccatggccctggccgagcaggcccggcagctgtttgagagcgctgtgggcgctgtgctgcccggccccatgctgcaccgggccctgagcctggaccccggcggccggcagctgaaggtgcgggacaggaacttccagctgcggcagaacctgtacctggtgggctttgggaaggctgtgctgggcatggctgctgctgctgaggagctgctgggccagcacctggtgcagggcgtcatctctgtgcccaagggcatccgggccgccatggagagagctgggaagcaggagatgctgctgaagccccacagccgggtgcaggtgtttgaaggagctgaggacaacctgcctgacagagatgccctgcgggccgccctggccatccagcagctggccgagggcctgacagcagatgacctgctgctggtgctgatcagcggcggggagccccaccctgtgcgctgtggcggcggcccctgtggcggggactgccagtggccccaccggggccagttcccccagtgtgcccggctgcctgcctacccccagagcctgcggcccccctgcagccctgccaccttctgtgaggactgtgctgtgtctggccgcctgtag

SEQ ID NO: 154146 - DNA, 1374 bp, Artificial Sequence
  Description of Artificial Sequence: Synthetic coding sequence
atggctgctgccctgcaggtgctgccccggctggcccgggcccccctgcaccccctgctgtggaggggctctgtggcccggctggccagctccatggccctggccgagcaggcccggcagctgtttgagagcgctgtgggcgctgtgctgcccggccccatgctgcaccgggccctgagcctggaccccggcggccggcagctgaaggtgcgggacaggaacttccagctgcggcagaacctgtacctggtgggctttgggaaggctgtgctgggcatggctgctgctgctgaggagctgctgggccagcacctggtgcagggcgtcatctctgtgcccaagggcatccgggccgcccccatcccccctgtgaccctggaggagaagcagaccctgacccggctgctggccgcccggggggccaccatccaggagctgaacaccatcaggaaggccctgagccagctgaagggcggcggcctggcccaggccgcctacccagcccaggtggtgtccctcatcctgagtgatgtggtgggggaccctgtggaggtgattgccagcggccccaccgtggccagcagccacaacgtgcaggactgcctgcacatcctgaacagatatggcctgcgggccgccctgcccaggtctgtgaagacagtgctgagcagagctgacagcgacccccacggcccccacacctgtggccacgtgctgaatgtcatcatcggcagcaatgtgctggccctggccgaggcccagaggcaggccgaggccctgggctaccaggccgtggtgctgtctgctgccatgcagggagatgtgaagtccatggcccagttctacggcctgctggcccacgtggcccggacccggctgacccccagcatggccggggcctctgtggaggaggatgcccagctgcacgagctggccgctgagctgcagatcccagacctgcagctggaggaggccctggagaccatggcctggggccggggccctgtgtgcctgctggccggcggggagcccaccgtgcagctgcagggcagcggccggggcggcaggaaccaggagctggccctgcgggtgggcgctgagctgcggcgctggcccctgggccccattgatgtgctcttcctgagcggcggcacagatggccaggacggccccacagaggccgccggggcctgggtgaccccagagctggccagccaggccgctgctgagggcctggacatcgccaccttcctggcccacaatgacagccacaccttcttctgctgcctgcagggcggggcccacctgctgcacacaggcatgacaggcaccaacgtgatggacacccacctgctcttcctgcggcccaggtag

SEQ ID NO: 154147 - DNA, 1572 bp, Artificial Sequence
  Description of Artificial Sequence: Synthetic coding sequence
atggctgctgccctgcaggtgctgccccggctggcccgggcccccctgcaccccctgctgtggaggggctctgtggcccggctggccagctccatggccctggccgagcaggcccggcagctgtttgagagcgctgtgggcgctgtgctgcccggccccatgctgcaccgggccctgagcctggaccccggcggccggcagctgaaggtgcgggacaggaacttccagctgcggcagaacctgtacctggtgggctttgggaaggctgtgctgggcatggctgctgctgctgaggagctgctgggccagcacctggtgcagggcgtcatctctgtgcccaagggcatccgggccgccatggagagagctgggaagcaggagatgctgctgaagccccacagccgggtgcaggtgtttgaaggagctgaggacaacctgcctgacagagatgccctgcgggccgccctggccatccagcagctggccgagggcctgacagcagatgacctgctgctggtgctgatcagcggcggcggcagcgccctgctgcctgcccccatcccccctgtgaccctggaggagaagcagaccctgacccggctgctggccgcccggggggccaccatccaggagctgaacaccatcaggaaggccctgagccagctgaagggcggcggcctggcccaggccgcctacccagcccaggtggtgtccctcatcctgagtgatgtggtgggggaccctgtggaggtgattgccagcggccccaccgtggccagcagccacaacgtgcaggactgcctgcacatcctgaacagatatggcctgcgggccgccctgcccaggtctgtgaagacagtgctgagcagagctgacagcgacccccacggcccccacacctgtggccacgtgctgaatgtcatcatcggcagcaatgtgctggccctggccgaggcccagaggcaggccgaggccctgggctaccaggccgtggtgctgtctgctgccatgcagggagatgtgaagtccatggcccagttctacggcctgctggcccacgtggcccggacccggctgacccccagcatggccggggcctctgtggaggaggatgcccagctgcacgagctggccgctgagctgcagatcccagacctgcagctggaggaggccctggagaccatggcctggggccggggccctgtgtgcctgctggccggcggggagcccaccgtgcagctgcagggcagcggccggggcggcaggaaccaggagctggccctgcgggtgggcgctgagctgcggcgctggcccctgggccccattgatgtgctcttcctgagcggcggcacagatggccaggacggccccacagaggccgccggggcctgggtgaccccagagctggccagccaggccgctgctgagggcctggacatcgccaccttcctggcccacaatgacagccacaccttcttctgctgcctgcagggcggggcccacctgctgcacacaggcatgacaggcaccaacgtgatggacacccacctgctcttcctgcggcccaggtag

SEQ ID NO: 154148 - DNA, 852 bp, Artificial Sequence
  Description of Artificial Sequence: Synthetic coding sequence
atggagctgctgctgagccagagctgcatctggtggcccatggtgggggagggccgcaccatcatcagctgtggcatcaaggccatggagaggagcggcaactacctgatctggctgcagaagggggagatgctgctgaagccccacagccgggtgcaggtgtttgaaggagctgaggacaacctgcctgacagagatgccctgcgggccgccctggccatccagcagctggccgagggcctgacagcagatgacctgctgctggtgctgatcagcggcggcggcagcgccctgctgcctgcccccatcccccctgtgaccctggaggagaagcagaccctgacccggctgctggccgcccggggggccaccatccaggagctgaacaccatcaggaaggccctgagccagctgaagggcggcggcctggcccaggccgcctacccagcccaggtggtgtccctcatcctgagtgatgtggtgggggaccctgtggaggtgattgccagcggccccaccgtggccagcagccacaacgtgcaggactgcctgcacatcctgaacagatatggcctgcgggccgccctgcccaggtctgtgaagacagtgctgagcagagctgacagcgacccccacggcccccacacctgtggccacgtgctgaatgtcatcatcggcagcaatgtgctggccctggccgaggcccagaggcaggccgaggccctgggctaccaggccgtggtgctgtctgctgccatgcagggctggggcaccccagctgcccacagagatgaccgctaccagtgccacggccacccccccctggtgcctgctgcctctgtgatggcctag

SEQ ID NO: 154149 - DNA, 723 bp, Artificial Sequence
  Description of Artificial Sequence: Synthetic coding sequence
atgctgctgaagccccacagccgggtgcaggtgtttgagggcgctgaggacaacctgcctgacagagatgccctgcgggccgccctggccatccagcagctggccgagggcctgacagcagatgacctgctgctggtgctgatcagcggcggcggcagcgccctgctgcctgcccccatcccccctgtgaccctggaggagaagcagaccctgacccggctgctggccgcccggggggccaccatccaggagctgaacaccatcaggaaggccctgagccagctgaagggcggcggcctggcccaggccgcctacccagcccaggtggtgtccctcatcctgagtgatgtggtgggggaccctgtggaggtgattgccagcggccccaccgtggccagcagccacaacgtgcaggactgcctgcacatcctgaacagatatggcctgcgggccgccctgcccaggtctgtgaagacagtgctgagcagagctgacagcgacccccacggcccccacacctgtggccacgtgctgaatgtcatcatcggcagcaatgtgctggccctggccgaggcccagaggcaggccgaggccctgggctaccaggccgtggtgctgtctgctgccatgcagggctggggcaccccagctgcccacagagatgaccgctaccagtgccacggccacccccccctggtgcctgctgcctctgtgatggcctag

SEQ ID NO: 154150 - DNA, 618 bp, Artificial Sequence
  Description of Artificial Sequence: Synthetic coding sequence
atggctgctgccctgcaggtgctgccccggctggcccgggcccccctgcaccccctgctgtggaggggctctgtggcccggctggccagctccatggccctggccgagcaggcccggcagctgtttgagagcgctgtgggcgctgtgctgcccggccccatgctgcaccgggccctgagcctggaccccggcggccggcagctgaaggtgcgggacaggaacttccagctgcggcagaacctgtacctggtgggctttgggaaggctgtgctgggcatggctgctgctgctgaggagctgctgggccagcacctggtgcagggcgtcatctctgtgcccaagggcatccgggccgccatggagagagctgggaagcaggagatgctgctgaagccccacagccgggtgcaggtgtttgaaggagctgaggacaacctgcctgacagagatgccctgcgggccgccctggccatccagcagctggccgagggcctgacagcagatgacctgctgctggtgctgatcagcggctggggcaccccagctgcccacagagatgaccgctaccagtgccacggccacccccccctggtgcctgctgcctctgtgatggcctag

SEQ ID NO: 154151 - DNA, 705 bp, Artificial Sequence; identical to SEQ ID NO: 154145
  Description of Artificial Sequence: Synthetic coding sequence

SEQ ID NO: 154152 - DNA, 285 bp, Artificial Sequence
  Description of Artificial Sequence: Synthetic coding sequence
aagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggccgccggggctgctgagggcgtgggcgtgtggagcctggagcctgaggacctgtctgctgtgaccatggagagatttgagccccagatcaatgctgagggcaccttcaaggagtag

SEQ ID NO: 154153 - DNA, 1662 bp, Artificial Sequence
  Description of Artificial Sequence: Synthetic coding sequence
atggccgccagcaagaaggctgtgctgggccccctggtgggcgctgtggaccagggcaccagcagcacccgcttcctggtgttcaacagcaagacagctgagctgctgagccaccaccaggtggagatcaagcaggagttcccccgggagggctgggtggagcaggaccccaaggagatcctgcacagcgtgtatgagtgcatcgagaagacctgtgagaagctgggccagctgaacatcgacatcagcaacatcaaggccatcggcgtgagcaaccagcgggagaccaccgtggtgtgggacaagatcaccggggagcccctgtacaatgctgtggtgtggctggacctgcggacccagagcacagtggagagcctgagcaagagaattcctggcaacaacaactttgtgaagagcaagacaggcctgcccctgagcacctacttctctgctgtgaagctgcgctggctgctggacaacgtgaggaaggtgcagaaggctgtggaggagaagagggccctgtttggcaccatcgacagctggctgatctggagcctgactggaggagtgaatggaggagtgcactgcacagatgtgaccaatgccagcaggaccatgctgttcaacatccacagcctggagtgggacaagcagctgtgtgagttcttcggcatccccatggagatcctgcccaacgtgcgcagcagcagcgagatctacggcctgatgaaggccggggccctggagggcgtgcccatcagcggctgcctgggggaccagagcgctgccctggtgggccagatgtgcttccagatcggccaggccaagaacacctatggaacaggctgcttcctgctgtgcaacacaggccacaagtgtgtgttcagtgaccacggcctgctgaccaccgtggcctacaagctgggccgggacaagcctgtgtactatgccctggagggctctgtggccatcgccggggctgtgatccgctggctgcgggacaacctgggcatcatcaagaccagcgaggagattgagaagctggccaaggaggtgggcaccagctatggctgctactttgtgcctgccttcagcggcctgtatgccccctactgggagcccagcgcccggggcatcatctgtggcctgacccagttcaccaacaagtgccacatcgcctttgctgccctggaggccgtgtgcttccagacccgggagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggctgctggagctgctgagggcgtgggcgtgtggagcctggagcctgaggacctgtctgctgtgaccatggagagatttgagccccagatcaatgctgaggagagcgagatccgctacagcacctggaagaaggctgtgatgaagtccatgggctgggtgaccacccagagccctgagagcggggaccccagcatcttctgcagcctgcccctgggcttcttcatcgtgtcctccatggtgatgctgattggagcccgctacatcagcggcatcccctag

SEQ ID NO: 154154 - DNA, 1575 bp, Artificial Sequence
  Description of Artificial Sequence: Synthetic coding sequence
atggccgccagcaagaaggctgtgctgggccccctggtgggcgctgtggaccagggcaccagcagcacccgcttcctggtgttcaacagcaagacagctgagctgctgagccaccaccaggtggagatcaagcaggagttcccccgggagggctgggtggagcaggaccccaaggagatcctgcacagcgtgtatgagtgcatcgagaagacctgtgagaagctgggccagctgaacatcgacatcagcaacatcaaggccatcggcgtgagcaaccagcgggagaccaccgtggtgtgggacaagatcaccggggagcccctgtacaatgctgtggtgtggctggacctgcggacccagagcacagtggagagcctgagcaagagaattcctggcaacaacaactttgtgaagagcaagacaggcctgcccctgagcacctacttctctgctgtgaagctgcgctggctgctggacaacgtgaggaaggtgcagaaggctgtggaggagaagagggccctgtttggcaccatcgacagctggctgatctggagcctgactggaggagtgaatggaggagtgcactgcacagatgtgaccaatgccagcaggaccatgctgttcaacatccacagcctggagtgggacaagcagctgtgtgagttcttcggcatccccatggagatcctgcccaacgtgcgcagcagcagcgagatctacggcctgatgaaggccggggccctggagggcgtgcccatcagcggctgcctgggggaccagagcgctgccctggtgggccagatgtgcttccagatcggccaggccaagaacacctatggaacaggctgcttcctgctgtgcaacacaggccacaagtgtgtgttcagtgaccacggcctgctgaccaccgtggcctacaagctgggccgggacaagcctgtgtactatgccctggagggctctgtggccatcgccggggctgtgatccgctggctgcgggacaacctgggcatcatcaagaccagcgaggagattgagaagctggccaaggaggtgggcaccagctatggctgctactttgtgcctgccttcagcggcctgtatgccccctactgggagcccagcgcccggggcatcatctgtggcctgacccagttcaccaacaagtgccacatcgcctttgctgccctggaggccgtgtgcttccagacccgggagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggctgctggagctgctgagggcgtgggcgtgtggagcctggagcctgaggacctgtctgctgtgaccatggagagatttgagccccagatcaatgctgaggagagcgagatccgctacagcacctggaagaaggctgtgatgaagtccatgggctgggtgaccacccagagccctgagagcggcatcccctag

SEQ ID NO: 154155 - DNA, 1593 bp, Artificial Sequence
  Description of Artificial Sequence: Synthetic coding sequence
atggccgccagcaagaaggctgtgctgggccccctggtgggcgctgtggaccagggcaccagcagcacccgcttcctggtgttcaacagcaagacagctgagctgctgagccaccaccaggtggagatcaagcaggagttcccccgggagggctgggtggagcaggaccccaaggagatcctgcacagcgtgtatgagtgcatcgagaagacctgtgagaagctgggccagctgaacatcgacatcagcaacatcaaggccatcggcgtgagcaaccagcgggagaccaccgtggtgtgggacaagatcaccggggagcccctgtacaatgctgtggtgtggctggacctgcggacccagagcacagtggagagcctgagcaagagaattcctggcaacaacaactttgtgaagagcaagacaggcctgcccctgagcacctacttctctgctgtgaagctgcgctggctgctggacaacgtgaggaaggtgcagaaggctgtggaggagaagagggccctgtttggcaccatcgacagctggctgatctggagcctgactggaggagtgaatggaggagtgcactgcacagatgtgaccaatgccagcaggaccatgctgttcaacatccacagcctggagtgggacaagcagctgtgtgagttcttcggcatccccatggagatcctgcccaacgtgcgcagcagcagcgagatctacggcctgatgaagatcagccacagcgtgaaggccggggccctggagggcgtgcccatcagcggctgcctgggggaccagagcgctgccctggtgggccagatgtgcttccagatcggccaggccaagaacacctatggaacaggctgcttcctgctgtgcaacacaggccacaagtgtgtgttcagtgaccacggcctgctgaccaccgtggcctacaagctgggccgggacaagcctgtgtactatgccctggagggctctgtggccatcgccggggctgtgatccgctggctgcgggacaacctgggcatcatcaagaccagcgaggagattgagaagctggccaaggaggtgggcaccagctatggctgctactttgtgcctgccttcagcggcctgtatgccccctactgggagcccagcgcccggggcatcatctgtggcctgacccagttcaccaacaagtgccacatcgcctttgctgccctggaggccgtgtgcttccagacccgggagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggctgctggagctgctgagggcgtgggcgtgtggagcctggagcctgaggacctgtctgctgtgaccatggagagatttgagccccagatcaatgctgaggagagcgagatccgctacagcacctggaagaaggctgtgatgaagtccatgggctgggtgaccacccagagccctgagagcggcatcccctag

SEQ ID NO: 154156 - DNA, 1065 bp, Artificial Sequence
  Description of Artificial Sequence: Synthetic coding sequence
atgctgttcaacatccacagcctggagtgggacaagcagctgtgtgagttcttcggcatccccatggagatcctgcccaacgtgcgcagcagcagcgagatctacggcctgatgaagatcagccacagcgtgaaggccggggccctggagggcgtgcccatcagcggctgcctgggggaccagagcgctgccctggtgggccagatgtgcttccagatcggccaggccaagaacacctacggcaccggctgcttcctgctgtgcaacacaggccacaagtgtgtgttcagtgaccacggcctgctgaccaccgtggcctacaagctgggccgggacaagcctgtgtactatgccctggagggctctgtggccatcgccggggccgtcatccgctggctgcgggacaacctgggcatcatcaagaccagcgaggagattgagaagctggccaaggaggtgggcaccagctatggctgctactttgtgcctgccttcagcggcctgtatgccccctactgggagcccagcgcccggggcatcatctgtggcctgacccagttcaccaacaagtgccacatcgcctttgctgccctggaggccgtgtgcttccagacccgggagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggccgccggggctgctgagggcgtgggcgtgtggagcctggagcctgaggacctgtctgctgtgaccatggagagatttgagccccagatcaatgctgaggagagcgagatccgctacagcacctggaagaaggctgtgatgaagtccatgggctgggtgaccacccagagccctgagagcggggaccccagcatcttctgcagcctgcccctgggcttcttcatcgtgtcctccatggtgatgctgattggagcccgctacatcagcggcatcccctag

SEQ ID NO: 154157 - DNA, 1104 bp, Artificial Sequence
  Description of Artificial Sequence: Synthetic coding sequence
atggcctacctggacaacttcaagaccaatgcccggcacttcatcctgtttgtgaacatcagcagcctgaccggcggcgtgaatggaggagtgcactgcacagatgtgaccaatgccagcaggaccatgctgttcaacatccacagcctggagtgggacaagcagctgtgtgagttcttcggcatccccatggagatcctgcccaacgtgcgcagcagcagcgagatctacggcctgatgaagatcagccacagcgtgaaggccggggccctggagggcgtgcccatcagcggctgcctgggggaccagagcgctgccctggtgggccagatgtgcttccagatcggccaggccaagaacacctacggcaccggctgcttcctgctgtgcaacacaggccacaagtgtgtgttcagtgaccacggcctgctgaccaccgtggcctacaagctgggccgggacaagcctgtgtactatgccctggagggctctgtggccatcgccggggccgtcatccgctggctgcgggacaacctgggcatcatcaagaccagcgaggagattgagaagctggccaaggaggtgggcaccagctatggctgctactttgtgcctgccttcagcggcctgtatgccccctactgggagcccagcgcccggggcatcatctgtggcctgacccagttcaccaacaagtgccacatcgcctttgctgccctggaggccgtgtgcttccagacccgggagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggccgccggggctgctgagggcgtgggcgtgtggagcctggagcctgaggacctgtctgctgtgaccatggagagatttgagccccagatcaatgctgaggagagcgagatccgctacagcacctggaagaaggctgtgatgaagtccatgggctgggtgaccacccagagccctgagagcggcatcccctag

SEQ ID NO: 154158 - DNA, 1680 bp, Artificial Sequence
  Description of Artificial Sequence: Synthetic coding sequence
atggccgccagcaagaaggctgtgctgggccccctggtgggcgctgtggaccagggcaccagcagcacccgcttcctggtgttcaacagcaagacagctgagctgctgagccaccaccaggtggagatcaagcaggagttcccccgggagggctgggtggagcaggaccccaaggagatcctgcacagcgtgtatgagtgcatcgagaagacctgtgagaagctgggccagctgaacatcgacatcagcaacatcaaggccatcggcgtgagcaaccagcgggagaccaccgtggtgtgggacaagatcaccggggagcccctgtacaatgctgtggtgtggctggacctgcggacccagagcacagtggagagcctgagcaagagaattcctggcaacaacaactttgtgaagagcaagacaggcctgcccctgagcacctacttctctgctgtgaagctgcgctggctgctggacaacgtgaggaaggtgcagaaggctgtggaggagaagagggccctgtttggcaccatcgacagctggctgatctggagcctgactggaggagtgaatggaggagtgcactgcacagatgtgaccaatgccagcaggaccatgctgttcaacatccacagcctggagtgggacaagcagctgtgtgagttcttcggcatccccatggagatcctgcccaacgtgcgcagcagcagcgagatctacggcctgatgaccatccacaacagcaagaaggccggggccctggagggcgtgcccatcagcggctgcctgggggaccagagcgctgccctggtgggccagatgtgcttccagatcggccaggccaagaacacctatggaacaggctgcttcctgctgtgcaacacaggccacaagtgtgtgttcagtgaccacggcctgctgaccaccgtggcctacaagctgggccgggacaagcctgtgtactatgccctggagggctctgtggccatcgccggggctgtgatccgctggctgcgggacaacctgggcatcatcaagaccagcgaggagattgagaagctggccaaggaggtgggcaccagctatggctgctactttgtgcctgccttcagcggcctgtatgccccctactgggagcccagcgcccggggcatcatctgtggcctgacccagttcaccaacaagtgccacatcgcctttgctgccctggaggccgtgtgcttccagacccgggagatcctggatgccatgaacagagactgtggcatccccctgagccacctgcaggtggatggcggcatgaccagcaacaagatcctgatgcagctgcaggccgacatcctgtacatccctgtggtgaagcccagcatgcctgagaccacagccctgggcgccgccatggctgctggagctgctgagggcgtgggcgtgtggagcctggagcctgaggacctgtctgctgtgaccatggagagatttgagccccagatcaatgctgaggagagcgagatccgctacagcacctggaagaaggctgtgatgaagtccatgggctgggtgaccacccagagccctgagagcggggaccccagcatcttctgcagcctgcccctgggcttcttcatcgtgtcctccatggtgatgctgattggagcccgctacatcagcggcatcccctag

SEQ ID NO: 154159 - DNA, 1662 bp, Artificial Sequence
  Description of Artificial Sequence: Synthetic coding sequence
atggccgcccccaagacagctgctgtgggccccctggtgggcgctgtggtgcagggcaccaacagcacccgcttcctggtgttcaacagcaagacagctgagctgctgagccaccacaaggtggagctgacccaggagttccccaaggagggctgggtggagcaggaccccaaggagatcctgcagagcgtgtatgagtgcatcgcccggacctgtgagaagctggatgagctgaacatcgacatcagcaacatcaaggctgtgggcgtgagcaaccagcgggagaccaccgtcatctgggacaagctgaccggggagcccctgtacaatgctgtggtgtggctggacctgcggacccagaccaccgtggaggacctgagcaagaagatccctggcaacagcaactttgtgaagagcaagacaggcctgcccctgagcacctacttctctgctgtgaagctgcgctggatgctggacaacgtgagaaatgtgcagaaggctgtggaggagggccgggccctgtttggcaccatcgacagctggctgatctggagcctgactggaggagtgaatggaggagtgcactgcacagatgtgaccaatgccagcaggaccatgctgttcaacatccacagcctggagtgggacaaggagctgtgtgacttctttgagatccccatggacctgctgcccaacgtgttcagcagcagcgagatctacggcctcatcaagacaggagccctggagggcgtgcccatcagcggctgcctgggggaccagtgtgccgccctggtgggccagatgtgcttccaggagggccaggccaagaacacctatggaacaggctgcttcctgctgtgcaacacaggcaggaaatgtgtgttcagcgagcacggcctgctgaccaccgtggcctacaagctgggccgggagaagccagcctactatgccctggagggctctgtggccatcgccggggctgtgatccgctggctgcgggacaacctgggcatcatcgagaccagcggggacatcgagcggctggccaaggaggtgggcaccagctatggctgctactttgtgcctgccttcagcggcctgtatgccccctactgggagcccagcgcccggggcatcctgtgtggcctgacccagttcaccaacaagtgccacatcgcctttgctgccctggaggccgtgtgcttccagacccgggagatcctggaggccatgaacagagactgtggcatccccctgcggcacctgcaggtggatggcggcatgaccaacaacaaggtgctgatgcagctgcaggccgacatcctgcacatccctgtgatcaagcccttcatgcctgagaccacagccctgggcgccgccatggctgctggagctgctgagggcgtgtctgtgtggagcctggagccccaggccctgtctgtgctgaggatggagagatttgagccccagatccaggccacagagagcgagatccgctatgccacctggaagaaggctgtgatgaagtccatgggctgggtgaccagccagagccctgagggcggggaccccagcatcttcagcagcctgcccctgggcttcttcatcgtgtcctccatggtgatgctgattggagcccgctacatcagcggcgtgccctag

SEQ ID NO: 154160 - DNA, 1050 bp, Artificial Sequence
  Description of Artificial Sequence: Synthetic coding sequence
atggccagcaagaaggtgtgcatcgtgggcagcggcaactggggcagcgccatcgccaagatcgtgggcggcaatgctgcccagctggcccagtttgacccccgggtgaccatgtgggtgtttgaagaagatattggaggcaagaagctgacagagatcatcaacacccagcatgaaaatgtgaagtacctgcccggccacaagctgccccccaacgtggtggccgtgcctgatgtggtgcaggccgcagaagatgctgacatcctgatctttgtggtgccccaccagttcatcggcaagatctgtgaccagctgaagggccacctgaaggccaatgccaccggcatcagcctcatcaagggcgtggatgagggccccaacggcctgaagctgatcagcgaggtgattggagagcggctgggcatccccatgtctgtgctgatgggcgccaacatcgccagcgaggtggctgatgagaagttctgtgagaccaccatcggctgcaaggaccctgcccagggccagctgctgaaggagctgatgcagacccccaacttccgcatcaccgtggtgcaggaggtggacacagtggagatctgtggggccctgaagaatgtggtggccgtgggcgccggcttctgtgatggcctgggctttggagacaacaccaaggccgccgtcatccggctgggcctgatggagatgattgcctttgccaagctgttctgcagcggccctgtgtcctctgccaccttcctggagagctgtggggtggccgacctgatcaccacctgctacggcggcaggaacaggaaggtggccgaggcctttgccaggacaggcaagagcattgagcagctggagaaggagctgctgaatggccagaagctgcagggccctgagacagcccgggagctgtacagcatcctgcagcacaagggcctggtggacaagttccccctcttcatggctgtgtacaaggtgtgctatgagggccagcctgtgggggagttcatccactgcctgcagaaccaccctgagcacatgtag

SEQ ID NO: 154161 - DNA, 981 bp, Artificial Sequence
  Description of Artificial Sequence: Synthetic coding sequence
atgcagacccccaacttccgcatcaccgtggtgcaggaggtggacacagtggagatctgtggggccctgaaggtgcggggggcccagaggcagctgtggggcgaggagaaggcccccaaggaggtgtggctgagcagcgcccggctgcaggtgctgcaggccctgaccatcgagcagtggttccccttccccaccatgagccacgcctacagaagaagctgccgcagcaaggcccgggccatccaggccgactacagcagcagtgaccggggccccccctgcagctgccccatcctggccccctgtggcaccccccaccccctggcccctgggggccagggcgacaaggagatgccccggctgatgggagacaagaccagcctgaccccccggcagaccaacggccagaactacggctcctggacagctgtggatggcctgtacaacggcatggtgcgctgggaggaccagctggagcggcgggtggtgttcaggaagtgcccccggggcggctccatgggccagggcctgaggaaaggagtgcagcagggcggcaagccccggggcggcagccggctgctgaagggccacaccctgtacctgagcagcgctgtgggcgtgacagcagatgagatgtccatgaggggcctgcacatgggccccatcggcggcggcctcttcacctatgacctgcacagcttcaagaatgtggtggccgtgggcgccggcttctgtgatggcctgggctttggagacaacaccaaggctgctgtgatccggctgggcctgatggagatgattgcctttgccaagctgttctgcagcggccctgtgagcagcgccaccttcctggagagctgtggggtggccgacctgatcaccacctgctatggaggcaggaacaggaaggtggccgaggcctttgccaggacaggcaaggtgggccctggccggcgggagaacagaggagctgccctgtag

SEQ ID NO: 154162 - DNA, 1056 bp, Artificial Sequence
  Description of Artificial Sequence: Synthetic coding sequence
atggctgctgcccccctgaaggtgtgcatcgtgggcagcggcaactggggcagcgctgtggccaagatcatcggcaacaacgtgaagaagctgcagaagtttgccagcacagtgaagatgtgggtgtttgaggagaccgtgaatggaaggaagctgacagacatcatcaacaatgaccatgaaaatgtgaagtacctgcccggccacaagctgcctgaaaatgtggtggccatgagcaacctgtctgaggccgtgcaggatgctgacctgctggtgtttgtgatcccccaccagttcatccaccgcatctgtgatgagatcaccggccgggtgcccaagaaggccctgggcatcaccctcatcaagggcattgatgagggccctgagggcctgaagctgatcagtgacatcatccgggagaagatgggcatcgacatctctgtgctgatgggcgccaacatcgccaatgaggtggccgctgagaagttctgtgagaccaccatcggcagcaaggtgatggagaatggcctgctcttcaaggagctgctgcagacccccaacttccgcatcaccgtggtggatgatgctgacacagtggagctgtgtggggccctgaagaacatcgtggccgtgggcgccggcttctgtgatggcctgcgctgtggggacaacaccaaggccgccgtcatccggctgggcctgatggagatgattgcctttgcccgcatcttctgcaagggccaggtgtccacagccaccttcctggagagctgtggggtggccgacctgatcaccacctgctacggcggcaggaacagaagagtggccgaggcctttgccaggacaggcaagaccatcgaggagctggagaaggagatgctgaatggccagaagctgcagggcccccagaccagcgctgaggtgtaccgcatcctgaagcagaagggcctgctggacaagttccccctcttcaccgctgtgtaccagatctgctatgagagcaggcctgtgcaggagatgctgagctgcctgcagagccaccctgagcacacctag

SEQ ID NO: 154163 - DNA, 1860 bp, Artificial Sequence
  Description of Artificial Sequence: Synthetic coding sequence
atggagagcagcagcagcagcaacagctacttctctgtgggccccaccagccccagcgctgtggtgctgctgtacagcctgagcaaggagagcctgcagagcgtggatgtgctgcgggaggaggtgtctgagatcctggatgagatgagccacaagctgcggctgggcgccatccgcttctgtgccttcaccctgagcaaggtgttcaagcagatcttcagcaaggtgtgtgtgaatgaggagggcatccagaagctgcagagggccatccaggagcaccctgtggtgctgctgcccagccacaggagctacatcgacttcctgatgctgtccttcctgctgtacaactatgacctgcctgtgcctgtgattgctgctggcatggacttcctgggcatgaagatggtgggggagctgctgaggatgtctggggccttcttcatgaggaggaccttcggcggcaacaagctgtactgggccgtgttttctgaatatgtgaagaccatgctgagaaatggctacgcccctgtggagttcttcctggagggcaccaggagccgcagcgccaagaccctgacccccaagtttggcctgctgaacatcgtgatggagcccttcttcaagcgggaggtgtttgacacctacctggtgcccatcagcatctcctatgacaagatcctggaggagaccctgtatgtgtatgagctgctgggcgtgcccaagcccaaggagagcaccaccggcctgctgaaggccaggaagatcctgtctgagaactttggcagcatccacgtgtactttggagaccctgtgtccctgcggagcctggccgccggccgcatgagccgcagcagctacaacctggtgccccgctacatcccccagaagcagagcgaggacatgcacgcctttgtgacagaggtggcctacaagatggagctgctgcagatcgagaacatggtgctgagcccctggaccctcatcgtggccgtgctgctgcagaaccggcccagcatggactttgatgccctggtggagaagaccctgtggctgaagggcctgacccaggccttcggcggcttcctgatctggccagacaacaagccagctgaggaggtggtgcctgccagcatcctgctgcacagcaacatcgccagcctggtgaaggaccaggtgatcctgaaggtggacagcggggacagcgaggtggtggatggcctgatgctgcagcacatcaccctgctgatgtgcagcgcctacagaaaccagctgctgaacatctttgtgcggcccagcctggtggccgtggccctgcagatgaccccaggcttcagaaaagaagatgtgtacagctgcttccgcttcctgagagatgtgtttgctgatgagttcatcttcctgcccggcaacaccctgaaggactttgaggagggctgctacctgctgtgcaagtctgaggccatccaggtgaccaccaaggacatcctggtgacagagaagggcaacacagtgctggagttcctggtgggcctcttcaagccctttgtggagagctaccagatcatctgcaagtacctgctgtctgaggaggaggaccacttcagcgaggagcagtacctggccgctgtgaggaagttcaccagccagctgctggaccagggcaccagccagtgctatgatgtgctgagcagtgatgtgcagaagaatgccctggccgcctgtgtgcggctgggcgtggtggagaagaagaagatcaacaacaactgcatcttcaacgtgaatgagcccgccaccaccaagctggaggagatgctgggctgcaagacccccatcggcaagccagccacagccaagctgtag

SEQ ID NO: 154164 - DNA, 2043 bp, Artificial Sequence
  Description of Artificial Sequence: Synthetic coding sequence
atggagagcagcagcagcagcaacagctacttctctgtgggccccaccagccccagcgctgtggtgctgctgtacagcaaggagctgaagaagtgggatgaatttgaggacatcctggaggagcggcggcacgtgtctgacctgaagtttgccatgaagtgctacacccccctggtgtacaagggcatcaccccctgcaagcccatcgacatcaagtgcagcgtgctgaacagcgaggagatccactacgtgatcaagcagctgagcaaggagagcctgcagagcgtggatgtgctgcgggaggaggtgtctgagatcctggatgagatgagccacaagctgcggctgggcgccatccgcttctgtgccttcaccctgagcaaggtgttcaagcagatcttcagcaaggtgtgtgtgaatgaggagggcatccagaagctgcagagggccatccaggagcaccctgtggtgctgctgcccagccacaggagctacatcgacttcctgatgctgtccttcctgctgtacaactatgacctgcctgtgcctgtgattgctgctggcatggacttcctgggcatgaagatggtgggggagctgctgaggatgtctggggccttcttcatgaggaggacctttggaggcaacaagctgtactgggccgtgttttctgaatatgtgaagaccatgctgagaaatggctacgcccctgtggagttcttcctggagggcaccaggagccgcagcgccaagaccctgacccccaagtttggcctgctgaacatcgtgatggagcccttcttcaagcgggaggtgtttgacacctacctggtgcccatcagcatctcctatgacaagatcctggaggagaccctgtatgtgtatgagctgctgggcgtgcccaagcccaaggagagcaccaccggcctgctgaaggccaggaagatcctgtctgaaaattttggcagcatccacgtgtactttggagaccctgtgtccctgcggagcctggccgccggccgcatgagccgcagcagctacaacctggtgccccgctacatcccccagaagcagagcgaggacatgcacgcctttgtgacagaggtggcctacaagatggagctgctgcagatcgagaacatggtgctgagcccctggaccctgattgtggccgtgctgctgcagaaccggcccagcatggactttgatgccctggtggagaagaccctgtggctgaagggcctgacccaggcctttggaggcttcctgatctggccagacaacaagccagctgaggaggtggtgcctgccagcatcctgctgcacagcaacatcgccagcctggtgaaggaccaggtgatcctgaaggtggacagcggggacagcgaggtggtggatggcctgatgctgcagcacatcaccctgctgatgtgcagcgcctacagaaaccagctgctgaacatctttgtgcggcccagcctggtggccgtggccctgcagatgaccccaggcttcaggaaggaggatgtgtacagctgcttccgcttcctgagagatgtgtttgctgatgagttcatcttcctgcccggcaacaccctgaaggactttgaggagggctgctacctgctgtgcaagtctgaggccatccaggtgaccaccaaggacatcctggtgacagagaagggcaacacagtgctggagttcctggtgggcctcttcaagccctttgtggagagctaccagatcatctgcaagtacctgctgtctgaggaggaggaccacttcagcgaggagcagtacctggccgctgtgaggaagttcaccagccagctgctggaccagggcaccagccagtgctatgatgtgctgagcagtgatgtgcagaagaatgccctggccgcctgtgtgcggctgggcgtggtggagaagaagaagatcaacaacaactgcatcttcaacgtgaatgaaccagccaccaccaagctggaggagatgctgggctgcaagacccccatcggcaagccagccacagccaagctgtag

SEQ ID NO: 154165 - DNA, 1764 bp, Artificial Sequence
  Description of Artificial Sequence: Synthetic coding sequence
atggagagcagcagcagcagcaacagctacttctctgtgggccccaccagccccagcgctgtggtgctgctgtacagcaaggagctgaagaagtgggatgaatttgaggacatcctggaggagcggcggcacgtgtctgacctgaagtttgccatgaagtgctacacccccctggtgtacaagggcatcaccccctgcaagcccatcgacatcaagtgcagcgtgctgaacagcgaggagatccactacgtgatcaagcagctgagcaaggagagcctgcagagcgtggatgtgctgcgggaggaggtgtctgagatcctggatgagatgagccacaagctgcggctgggcgccatccgcttctgtgccttcaccctgagcaaggtgttcaagcagatcttcagcaagctgcagagggccatccaggagcaccctgtggtgctgctgcccagccacaggagctacatcgacttcctgatgctgtccttcctgctgtacaactatgacctgcctgtgcctgtgattgctgctggcatggacttcctgggcatgaagatggtgggggagctgctgaggatgtctggggccttcttcatgaggaggacctttggaggcaacaagctgtactgggccgtgttttctgaatatgtgaagaccatgctgagaaatggctacgcccctgtggagttcttcctggagggcaccaggagccgcagcgccaagaccctgacccccaagtttggcctgctgaacatcgtgatggagcccttcttcaagcgggaggtgtttgacacctacctggtgcccatcagcatctcctatgacaagatcctggaggagaccctgtatgtgtatgagctgctgggcgtgcccaagcccaaggagagcaccaccggcctgctgaaggccaggaagatcctgtctgaaaattttggcagcatccacgtgtactttggagaccctgtgtccctgcggagcctggccgccggccgcatgagccgcagcagctacaacctggtgccccgctacatcccccagaagcagagcgaggacatgcacgcctttgtgacagaggtggcctacaagatggagctgctgcagatcgagaacatggtgctgagcccctggaccctgattgtggccgtgctgctgcagaaccggcccagcatggactttgatgccctggtggagaagaccctgtggctgaagggcctgacccaggcctttggaggcttcctgatctggccagacaacaagccagctgaggaggtggtgcctgccagcatcctgctgcacagcaacatcgccagcctggtgaaggaccaggtgatcctgaaggtggacagcggggacagcgaggtggtggatggcctgatgctgcagcacatcaccctgctgatgtgcagcgcctacagaaaccagctgctgaacatctttgtgcggcccagcctggtggccgtggccctgcagatgaccccaggcttcaggaaggaggatgtgtacagctgcttccgcttcctgagagatgtgtttgctgatgagttcatcttcctgcccggcaacaccctgaaggactttgaggagggctgctacctgctgtgcaagtctgaggccatccaggtgaccaccaaggacatcctggtgacagagaagggcaacacagtgctggagttcctggtgggcctcttcaagccctttgtggagagctaccagatcatctgcaagtacctgctgtctgaggaggaggaccacttcagcgagtag

SEQ ID NO: 154166 - DNA, 669 bp, Artificial Sequence
  Description of Artificial Sequence: Synthetic coding sequence
atggagagcagcagcagcagcaacagctacttctctgtgggccccaccagccccagcgctgtggtgctgctgtacagcctgagcaaggagagcctgcagagcgtggatgtgctgcgggaggaggtgtctgagatcctggatgagatgagccacaagctgcggctgggcgccatccgcttctgtgccttcaccctgagcaaggtgttcaagcagatcttcagcaaggtgtgtgtgaatgaggagggcatccagaagctgcagagggccatccaggagcaccctgtggtgctgctgcccagccacaggagctacatcgacttcctgatgctgtccttcctgctgtacaactatgacctgcctgtgcctgtgattgctgctggcatggacttcctgggcatgaagatggtgggggagctgctgaggatgtctggggccttcttcatgaggaggaccttcggcggcaacaagctgtactgggccgtgttttctgaatatgtgaagaccatgctgagaaatggctacgcccctgtggagttcttcctggagggcaccaggagccgcagcgccaagaccctgacccccaagtttggcctgctgaacatcgtgatggagcccttcttcaagcgggaggtgtttgacacctacctggtgcccatcagcatctcctag

SEQ ID NO: 154167 - DNA, 870 bp, Artificial Sequence
  Description of Artificial Sequence: Synthetic coding sequence
atgagcaggaacagcaggaagaccatcggcaaggtgcgggtggactacatcatcatcaagcccctgcccggctacagctgtgacatgaagagcagcttcagcaagtactggaagccccgcatccccctggatgtgggccacagaggagctggcaacagcaccaccacagcccagctggccaaggtgcaggagaacaccatcgccagcctgagaaatgctgccagccacggggccgcctttgtggagtttgatgtgcacctgagcaaggactttgtgcctgtggtgtaccatgacctgacctgctgcctgaccatgaagaagaacctgtggttccggaggaagatccccttccagaagatcagccacttcctgctgctgcgctgggtgcggcagaagcagaacaagtaccccatcctcttcctgacccagggcaagtctgagatctacccagagctgatggacctgcggagcaggaccacccccatcgccatgagctttgcccagtttgagaacctgctgggcatcaacgtgcacacagaggacctgctgaggaaccccagctacatccaggaggccaaggccaagggcctggtgatcttctgctggggagatgacaccaatgaccctgagaacagaaggaagctgaaggagctgggcgtgaatggcctcatctatgaccgcatctatgactggatgcctgagcagcccaacatcttccaggtggagcagctggagcggctgaagcaggagctgcctgagctgaagagctgcctgtgccccaccgtgtccagatttgtgcccagcagcctgtgtggggagagtgacatccacgtggatgccaatggaattgacaacgtggagaatgcctag

SEQ ID NO: 154168 - DNA, 2019 bp, Artificial Sequence
  Description of Artificial Sequence: Synthetic coding sequence
atgacccccagccaggtggcctttgagatccggggcaccctgctgcccggggaggtgtttgccatctgtggcagctgtgatgccctgggcaactggaacccccagaatgctgtggccctgctgcctgaaaatgacaccggggagagcatgctgtggaaggccaccatcgtgctgagcagaggagtgtctgtgcagtaccgctacttcaagggctacttcctggagcccaagaccatcggcggcccctgccaggtgattgtgcacaagtgggagacccacctgcagcccaggagcatcacccccctggagagcgagatcatcattgatgatggccagtttggcatccacaatggagtggagaccctggacagcggctggctgacctgccagacagagatccggctgcggctgcactacagcgagaagccccctgtgtccatcaccaagaagaagctgaagaagagccgcttccgggtgaagctgaccctggagggcctggaggaggatgatgatgacagagtgagccccaccgtgctgcacaagatgagcaacagcctggagatcagcctcatcagtgacaatgagttcaagtgccgccacagccagccagaatgtggctacggcctgcagcctgaccgctggacagagtacagcatccagaccatggagccagacaacctggagctgatctttgacttctttgaggaggacctgtctgaacatgtggtgcagggagatgccctgcccggccacgtgggcacagcctgcctgctgagcagcaccatcgccgagagcggcaagtctgctggcatcctgaccctgcccatcatgagcaggaacagcaggaagaccatcggcaaggtgcgggtggactacatcatcatcaagcccctgcccggctacagctgtgacatgaagagcagcttcagcaagtactggaagccccgcatccccctggatgtgggccacagaggagctggcaacagcaccaccacagcccagctggccaaggtgcaggagaacaccatcgccagcctgagaaatgctgccagccacggggccgcctttgtggagtttgatgtgcacctgagcaaggactttgtgcctgtggtgtaccatgacctgacctgctgcctgaccatgaagaagaagtttgatgctgaccctgtggagctgtttgagatccctgtgaaggagctgacctttgaccagctgcagctgctgaagctgacccacgtgacagccctgaagagcaaggacaggaaggagagcgtggtgcaggaggagaacagcttcagcgagaaccagcccttccccagcctgaagatggtgctggagagcctgcctgaagatgtgggcttcaacatcgagatcaagtggatctgccagcagagagatggcatgtgggatggcaacctgagcacctactttgacatgaacctcttcctggacatcatcctgaagacagtgctggagaacagcggcaagagaagaattgtgttcagcagctttgatgctgacatctgcaccatggtgcggcagaagcagaacaagtaccccatcctcttcctgacccagggcaagtctgagatctacccagagctgatggacctgcggagcaggaccacccccatcgccatgagctttgcccagtttgagaacctgctgggcatcaacgtgcacacagaggacctgctgaggaaccccagctacatccaggaggccaaggccaagggcctggtgatcttctgctggggagatgacaccaatgaccctgaaaatagaaggaagctgaaggagctgggcgtgaatggcctcatctatgaccgcatctatgactggatgcctgagcagcccaacatcttccaggtggagcagctggagcggctgaagcaggagctgcctgagctgaagagctgcctgtgccccaccgtgtccagatttgtgcccagcagcctgtgtggggagagtgacatccacgtggatgccaacggcatcgacaacgtggagaatgcctag

SEQ ID NO: 154169 - DNA, 795 bp, Artificial Sequence
  Description of Artificial Sequence: Synthetic coding sequence
tgatgtgacatgaagagcagcttcagcaagtactggaagccccgcatccccctggatgtgggccacagaggagctggcaacagcaccaccacagcccagctggccaaggtgcaggagaacaccatcgccagcctgagaaatgctgccagccatggagctgcctttgtggagtttgatgtgcacctgagcaaggactttgtgcctgtggtgtaccatgacctgacctgctgcctgaccatgaagaagaacctgtggttccggaggaagatccccttccagaagatcagccacttcctgctgctgcgctgggtgcggcagaagcagaacaagtaccccatcctcttcctgacccagggcaagtctgagatctacccagagctgatggacctgcggagcaggaccacccccatcgccatgagctttgcccagtttgagaacctgctgggcatcaacgtgcacacagaggacctgctgaggaaccccagctacatccaggaggccaaggccaagggcctggtgatcttctgctggggagatgacaccaatgaccctgaaaatagaaggaagctgaaggagctgggcgtgaatggcctcatctatgaccgcatctatgactggatgcctgagcagcccaacatcttccaggtggagcagctggagcggctgaagcaggagctgcctgagctgaagagctgcctgtgccccaccgtgtccagatttgtgcccagcagcctgtgtggggagagtgacatccacgtggatgccaacggcatcgacaacgtggagaatgcctag

SEQ ID NO: 154170 - DNA, 996 bp, Artificial Sequence
  Description of Artificial Sequence: Synthetic coding sequence
atgtggctgtgggaggaccagggcggcctgctgggccccttctccttcctgctgctggtgctgctgctggtgaccaggagccctgtgaatgcctgcctgctgaccggcagcctgtttgtgctgctgcgggtcttctcctttgagcctgtgcccagctgccgggccctgcaggtgctgaagccccgggaccgcatcagcgccatcgcccaccggggcggcagccatgatgcccctgagaacaccctggccgccatccggcaggccgccaagaatggagccaccggggtggagctggacatcgagttcaccagtgatggcatccctgtgctgatgcatgacaacacagtggacaggaccacagatggcaccggccgcctgtgtgacctgacctttgagcagatcaggaagctgaacccagctgccaaccaccggctgagaaatgacttcccagatgagaagatccccaccctgcgggaggccgtggctgaatgtctgaaccacaacctgaccatcttctttgatgtgaagggccacgcccacaaggccacagaggccctgaagaagatgtacatggagttcccccagctgtacaacaacagcgtggtgtgcagcttcctgcctgaggtgatctacaagatgaggcagacagacagagatgtgatcacagccctgacccaccggccctggagcctgagccacactggagatggcaagcccaggtatgacaccttctggaagcacttcatctttgtgatgatggacatcctgctggactggagcatgcacaacatcctgtggtacctgtgtggcatcagcgccttcctgatgcagaaggactttgtgtccccagcctacctgaagaagtggagcgccaagggcatccaggtggtgggctggacagtgaacacctttgatgagaagagctactatgagagccacctgggcagcagctacatcacagacagcatggtggaggactgtgagccccacttctag

SEQ ID NO: 154171 - DNA, 1818 bp, Artificial Sequence
  Description of Artificial Sequence: Synthetic coding sequence
atggtgcgccaccagcccctgcagtactatgagccccagctgtgcctgagctgcctgaccggcatctacggctgccgctggaagcgctaccagaggagccatgatgacaccaccccctgggagcggctgtggttcctgctgctgaccttcaccttcggcctgaccctgacctggctgtacttctggtgggaggtgcacaatgactatgatgagttcaactggtacctgtacaacaggatgggctactggagcgactggcctgtgcccatcctggtgaccacagctgctgcctttgcctacatcgccggcctgctggtgctggccctgtgccacatcgctgtgggccagcagatgaacctgcactggctgcacaagattggcctggtggtgatcctggccagcacagtggtggccatgtctgctgtggcccagctgtgggaggatgagtgggaggtgctgctgatcagcctgcagggcacagcccccttcctgcacgtgggcgctgtggccgctgtgaccatgctgtcctggatcgtggccggccagtttgcccgggcagagaggaccagcagccaggtgaccatcctgtgcaccttcttcaccgtggtgtttgccctgtacctggcccccctgaccatcagcagcccctgcatcatggagaagaaggacctgggccccaagccagccctgattggccacagaggagcccccatgctggcccctgagcacaccctgatgtccttcaggaaggccctggagcagaagctgtatggcctgcaggccgacatcaccatcagcctggatggagtgcccttcctgatgcatgacaccaccctgcggaggaccaccaacgtggaggaggagttccctgagctggcccggcggcctgcctccatgctgaactggaccaccctgcagaggctgaatgccggccagtggttcctgaagacagaccccttctggacagccagcagcctgagccccagcgaccaccgggaggcccagaaccagagcatctgcagcctggccgagctgctggagctggccaagggaaatgccaccctgctgctgaacctgcgggaccccccccgggagcacccctaccgcagcagcttcatcaacgtgaccctggaggccgtgctgcacagcggcttcccccagcaccaggtgatgtggctgcccagccggcagaggcccctggtgaggaaggtggcccctggcttccagcagaccagcggcagcaaggaggccgtggccagcctgcggcggggccacatccagaggctgaacctgcgctacacccaggtgtcccggcaggagctgcgggactatgcctcctggaacctgtctgtgaacctgtacacagtgaatgccccctggctgttcagcctgctgtggtgtgccggcgtgcccagcgtgaccagtgacaacagccacgccctgagccaggtgcccagccccctgtggatcatgcccccagatgagtactgcctgatgtgggtgacagctgacctggtgtccttcaccctgattgtgggcatctttgtgctgcagaagtggaggctgggcggcatccgcagctacaaccctgagcagatcatgctgtctgctgctgtgcggaggaccagcagagatgtgtccatcatgaaggagaagctgatcttcagcgagatcagtgatggagtggaggtgtctgatgtgctgtctgtgtgcagcgacaacagctatgacacctacgccaacagcacagccacccctgtgggcccccggggcggcggcagccacaccaagaccctcatcgagaggtctggaagatag

SEQ ID NO: 154172 - DNA, 1461 bp, Artificial Sequence
  Description of Artificial Sequence: Synthetic coding sequence
atggtgcgccaccagcccctgcagtactatgagccccagctgtgcctgagctgcctgaccggcatctacggctgccgctggaagcgctaccagaggagccatgatgacaccaccccaggcacagcccccttcctgcacgtgggcgctgtggccgctgtgaccatgctgtcctggatcgtggccggccagtttgcccgggcagagaggaccagcagccaggtgaccatcctgtgcaccttcttcaccgtggtgtttgccctgtacctggcccccctgaccatcagcagcccctgcatcatggagaagaaggacctgggccccaagccagccctgattggccacagaggagcccccatgctggcccctgagcacaccctgatgtccttcaggaaggccctggagcagaagctgtatggcctgcaggccgacatcaccatcagcctggatggagtgcccttcctgatgcatgacaccaccctgcggaggaccaccaacgtggaggaggagttccctgagctggcccggcggcctgcctccatgctgaactggaccaccctgcagaggctgaatgccggccagtggttcctgaagacagaccccttctggacagccagcagcctgagccccagcgaccaccgggaggcccagaaccagagcatctgcagcctggccgagctgctggagctggccaagggaaatgccaccctgctgctgaacctgcgggaccccccccgggagcacccctaccgcagcagcttcatcaacgtgaccctggaggccgtgctgcacagcggcttcccccagcaccaggtgatgtggctgcccagccggcagaggcccctggtgaggaaggtggcccctggcttccagcagaccagcggcagcaaggaggccgtggccagcctgcggcggggccacatccagaggctgaacctgcgctacacccaggtgtcccggcaggagctgcgggactatgcctcctggaacctgtctgtgaacctgtacacagtgaatgccccctggctgttcagcctgctgtggtgtgccggcgtgcccagcgtgaccagtgacaacagccacgccctgagccaggtgcccagccccctgtggatcatgcccccagatgagtactgcctgatgtgggtgacagctgacctggtgtccttcaccctcatcgtgggcatctttgtgctgcagaagtggaggctgggcggcatccgcagctacaaccctgagcagatcatgctgtctgctgctgtgcggaggaccagcagagatgtgtccatcatgaaggagaagctgatcttcagcgagatcagtgatggagtggaggtgtctgatgtgctgtctgtgtgcagcgacaacagctatgacacctacgccaacagcacagccacccctgtgggcccccggggcggcggcagccacaccaagaccctgattgaaagaagtggccgctag

SEQ ID NO: 154173 - DNA, 408 bp, Artificial Sequence
  Description of Artificial Sequence: Synthetic coding sequence
atggtgcgccaccagcccctgcagtactatgagccccagctgtgcctgagctgcctgaccggcatctacggctgccgctggaagcgctaccagaggagccatgatgacaccaccccctgggagcggctgtggttcctgctgctgaccttcaccttcggcctgaccctgacctggctgtacttctggtgggaggtgcacaatgactatgatgagttcaactggtacctgtacaacaggatgggctactggagcgactggcctgtgcccatcctggtgaccacagctgctgcctttgcctacatcgccggcctgctggtgctggccctgtgccacatcgctgtgggccagcagatgaacctgcactggctgcacaaggccagcagcggcctgcccctgagccccctgtag

SEQ ID NO: 154174 - DNA, 1404 bp, Artificial Sequence
  Description of Artificial Sequence: Synthetic coding sequence
atgtctgctgtggcccagctgtgggaggatgagtgggaggtgctgctgatcagcctgcagggcacagcccccttcctgcacgtgggcgctgtggccgctgtgaccatgctgtcctggatcgtggccggccagtttgcccgggcagagaggaccagcagccaggtgaccatcctgtgcaccttcttcaccgtggtgtttgccctgtacctggcccccctgaccatcagcagcccctgcatcatggagaagaaggacctgggccccaagccagccctgattggccacagaggagcccccatgctggcccctgagcacaccctgatgtccttcaggaaggccctggagcagaagctgtatggcctgcaggccgacatcaccatcagcctggatggagtgcccttcctgatgcatgacaccaccctgcggaggaccaccaacgtggaggaggagttccctgagctggcccggcggcctgcctccatgctgaactggaccaccctgcagaggctgaatgccggccagtggttcctgaagacagaccccttctggacagccagcagcctgagccccagcgaccaccgggaggcccagaaccagagcatctgcagcctggccgagctgctggagctggccaagggaaatgccaccctgctgctgaacctgcgggaccccccccgggagcacccctaccgcagcagcttcatcaacgtgaccctggaggccgtgctgcacagcggcttcccccagcaccaggtgatgtggctgcccagccggcagaggcccctggtgaggaaggtggcccctggcttccagcagaccagcggcagcaaggaggccgtggccagcctgcggcggggccacatccagaggctgaacctgcgctacacccaggtgtcccggcaggagctgcgggactatgcctcctggaacctgtctgtgaacctgtacacagtgaatgccccctggctgttcagcctgctgtggtgtgccggcgtgcccagcgtgaccagtgacaacagccacgccctgagccaggtgcccagccccctgtggatcatgcccccagatgagtactgcctgatgtgggtgacagctgacctggtgtccttcaccctgattgtgggcatctttgtgctgcagaagtggaggctgggcggcatccgcagctacaaccctgagcagatcatgctgtctgctgctgtgcggaggaccagcagagatgtgtccatcatgaaggagaagctgatcttcagcgagatcagtgatggagtggaggtgtctgatgtgctgtctgtgtgcagcgacaacagctatgacacctacgccaacagcacagccacccctgtgggcccccggggcggcggcagccacaccaagaccctcatcgagaggtctggaagatag

SEQ ID NO: 154175 - DNA, 1818 bp, Artificial Sequence; identical to SEQ ID NO: 154171
  Description of Artificial Sequence: Synthetic coding sequence

SEQ ID NO: 154176 - DNA, 222 bp, Artificial Sequence
  Description of Artificial Sequence: Synthetic coding sequence
atggtgcgccaccagcccctgcagtactatgagccccagctgtgcctgagctgcctgaccggcatctacggctgccgctggaagcgctaccagaggagccatgatgacaccaccccctgggagcggctgtggttcctgctgctgaccttcaccttcggcctgaccctgacctggctgtacttctggtgggaggtgcacaatgactatgatgagttcaactag

SEQ ID NO: 154177 - DNA, 1461 bp, Artificial Sequence; identical to SEQ ID NO: 154172
  Description of Artificial Sequence: Synthetic coding sequence

SEQ ID NO: 154178 - DNA, 1083 bp, Artificial Sequence
  Description of Artificial Sequence: Synthetic coding sequence
atgtccttcaggaaggccctggagcagaagctgtatggcctgcaggccgacatcaccatcagcctggatggagtgcccttcctgatgcatgacaccaccctgcggaggaccaccaacgtggaggaggagttccctgagctggcccggcggcctgcctccatgctgaactggaccaccctgcagaggctgaatgccggccagtggttcctgaagacagaccccttctggacagccagcagcctgagccccagcgaccaccgggaggcccagaaccagagcatctgcagcctggccgagctgctggagctggccaagggaaatgccaccctgctgctgaacctgcgggaccccccccgggagcacccctaccgcagcagcttcatcaacgtgaccctggaggccgtgctgcacagcggcttcccccagcaccaggtgatgtggctgcccagccggcagaggcccctggtgaggaaggtggcccctggcttccagcagaccagcggcagcaaggaggccgtggccagcctgcggcggggccacatccagaggctgaacctgcgctacacccaggtgtcccggcaggagctgcgggactatgcctcctggaacctgtctgtgaacctgtacacagtgaatgccccctggctgttcagcctgctgtggtgtgccggcgtgcccagcgtgaccagtgacaacagccacgccctgagccaggtgcccagccccctgtggatcatgcccccagatgagtactgcctgatgtgggtgacagctgacctggtgtccttcaccctcatcgtgggcatctttgtgctgcagaagtggaggctgggcggcatccgcagctacaaccctgagcagatcatgctgtctgctgctgtgcggaggaccagcagagatgtgtccatcatgaaggagaagctgatcttcagcgagatcagtgatggagtggaggtgtctgatgtgctgtctgtgtgcagcgacaacagctatgacacctacgccaacagcacagccacccctgtgggcccccggggcggcggcagccacaccaagaccctgattgaaagaagtggccgctag

SEQ ID NO: 154179 - DNA, 1272 bp, Artificial Sequence
  Description of Artificial Sequence: Synthetic coding sequence
atgctgcgggtgcgctgcctgcggggcggcagcagaggagctgaggccgtgcactacatcggcagccggctgggccgcaccctgaccggctgggtgcagaggaccttccagagcacccaggccgccacagccagcagcaggaacagctgtgccgcagatgacaaggccacagagcccctgcccaaggactgccctgtgagcagctacaatgagtgggaccccctggaggaggtgattgtgggccgggcagaaaatgcctgtgtgccccccttcaccatcgaggtgaaggccaacacctatgagaagtactggcccttctaccagaagcagggcggccactacttccccaaggaccacctgaagaaggctgtggccgagattgaggagatgtgcaacatcctgaagacagagggcgtgacagtgcggcggccagaccccatcgactggagcctgaagtacaagaccccagactttgagagcacaggcctgtacagcgccatgccccgggacatcctgattgtggtgggcaatgagatcatcgaggcccccatggcctggaggagccgcttctttgagtaccgggcctaccgcagcatcatcaaggactacttccacagaggagccaagtggaccacagcccccaagcccaccatggctgatgagctgtacaaccaggactaccccatccacagcgtggaggacagacacaagctggccgcccagggcaagtttgtgaccacagaatttgagccctgctttgatgctgctgacttcatccgggccggccgggacatctttgcccagaggagccaggtgaccaactacctgggcatcgagtggatgaggaggcacctggccccagactacagagtgcacatcatctccttcaaggaccccaaccccatgcacattgatgccaccttcaacatcatcggccctggcatcgtgctgagcaacccagaccggccctgccaccagattgacctcttcaagaaggccggctggaccatcatcaccccacccacccccatcatcccagatgaccaccccctgtggatgagcagcaagtggctgtccatgaatgtgctgatgctggatgagaagagggtgatggtggatgccaatgaggtgcccatccagaagatgtttgagaagctgggcatcaccaccatcaaggtgaacatcagaaatgccaacagcctgggcggcggcttccactgctggacctgtgatgtgagaagaagaggcaccctgcagagctacctggactag

SEQ ID NO: 154180 - DNA, 1176 bp, Artificial Sequence
  Description of Artificial Sequence: Synthetic coding sequence
atgctgcgggtgcgctgcctgcggggcggcagcagaggagctgaggccgtgcactacatcggcagccggctgggccgcaccctgaccggctgggtgcagaggaccttccagagcacccaggccgccacagccagcagcaggaacagctgtgccgcagatgacaaggccacagagcccctgcccaaggactgccctgtgagcagctacaatgagtgggaccccctggaggaggtgattgtgggccgggcagaaaatgcctgtgtgccccccttcaccatcgaggtgaaggccaacacctatgagaagtactggcccttctaccagaagcagggcggccactacttccccaaggaccacctgaagaaggctgtggccgagattgaggagatgtgcaacatcctgaagacagagggcgtgacagtgcggcggccagaccccatcgactggagcctgaagtacaagaccccagactttgagagcacaggcctgtacagcgccatgccccgggacatcctgattgtggtgggcaatgagatcatcgaggcccccatggcctggaggagccgcttctttgagtaccgggcctaccgcagcatcatcaaggactacttccacagaggagccaagtggaccacagcccccaagcccaccatggctgatgagctgtacaaccaggactaccccatccacagcgtggaggacagacacaagctggccgcccagggcaagtttgtgaccacagaatttgagccctgctttgatgctgctgacttcatccgggccggccgggacatctttgcccagaggagccaggtgaccaactacctgggcatcgagtggatgaggaggcacctggccccagactacagagtgcacatcatctccttcaaggaccccaaccccatgcacattgatgccaccttcaacatcatcggccctggcatcgtgctgagcaacccagaccggccctgccaccagattgacctcttcaagaaggccggctggaccatcatcaccccacccacccccatcatcccagatgaccaccccctgtggatgagcagcaagtggctgtccatgaatgtgctgatgctggatgagaagagggtgatggtggatgccaatgaggtgcccatccagaagatgtttgagaagctgggcatgtacaacaagtag

SEQ ID NO: 154181 - DNA, 1260 bp, Artificial Sequence
  Description of Artificial Sequence: Synthetic coding sequence
atgtggccaggaaatgcctggagggctgccctcttctgggtgccccggggccggcgggcccagagcgccctggcccagctgcggggcatcctggagggggagctggagggcatcagaggagctggcacctggaagtctgagagggtcatcaccagccggcagggcccccacatccgggtggatggagtgtctgggggcatcctgaacttctgtgccaacaactacctgggcctgagcagccaccctgaggtgatccaggccggcctgcaggccctggaggagtttggagctggcctgagctctgtgcgcttcatctgtggcacccagagcatccacaagaacctggaggccaagatcgcccgcttccaccagcgggaggatgccatcctgtaccccagctgctatgatgccaatgccggcctgtttgaggccctgctgaccccagaagatgctgtgctgagtgatgagctgaaccacgccagcatcattgatggcatccggctgtgcaaggcccacaagtaccgctaccgccacctggacatggctgacctggaggccaagctgcaggaggcccagaagcaccggctgcggctggtggccacagatggagccttctccatggatggagacatcgcccccctgcaggagatctgctgcctggccagccgctacggggccctggtgttcatggatgagtgccacgccaccggcttcctgggccccaccggccggggcacagatgagctgctgggcgtgatggaccaggtgaccatcatcaacagcaccctgggcaaggccctgggcggggccagcggcggctacaccaccggccctggccccctggtgtccctgctgcggcagagggcccggccctacctgttcagcaacagcctgcccccagctgtggtgggctgtgccagcaaggccctggacctgctgatgggcagcaacaccatcgtgcagagcatggccgccaagacccagcgcttccgcagcaagatggaggccgccggcttcaccatcagcggggccagccaccccatctgccctgtgatgctgggagatgcccggctggccagcaggatggctgatgacatgctgaagaggggcatcttcgtcatcggcttctcctaccctgtggtgcccaagggcaaggcccgcatccgggtgcagatctctgctgtgcacagtgaagaagatattgacagatgtgtggaggcctttgtggaggtgggccgcctgcatggagccctgccctag

SEQ ID NO: 154182 - DNA, 1338 bp, Artificial Sequence
  Description of Artificial Sequence: Synthetic coding sequence
atgtggccaggaaatgcctggagggctgccctcttctgggtgccccggggccggcgggcccagagcgccctggcccagctgcggggcatcctggagggggagctggagggcatcagaggagctggcacctggaagtctgagagggtcatcaccagccggcagggcccccacatccgggtggatggagtgtctgggggccctggcaccgtcatcttccctggcctgcccctgccccacctgagctgctgcatccacctgctgtccttcaccagcggcatcctgaacttctgtgccaacaactacctgggcctgagcagccaccctgaggtgatccaggccggcctgcaggccctggaggagtttggagctggcctgagctctgtgcgcttcatctgtggcacccagagcatccacaagaacctggaggccaagatcgcccgcttccaccagcgggaggatgccatcctgtaccccagctgctatgatgccaatgccggcctgtttgaggccctgctgaccccagaagatgctgtgctgagtgatgagctgaaccacgccagcatcattgatggcatccggctgtgcaaggcccacaagtaccgctaccgccacctggacatggctgacctggaggccaagctgcaggaggcccagaagcaccggctgcggctggtggccacagatggagccttctccatggatggagacatcgcccccctgcaggagatctgctgcctggccagccgctacggggccctggtgttcatggatgagtgccacgccaccggcttcctgggccccaccggccggggcacagatgagctgctgggcgtgatggaccaggtgaccatcatcaacagcaccctgggcaaggccctgggcggggccagcggcggctacaccaccggccctggccccctggtgtccctgctgcggcagagggcccggccctacctgttcagcaacagcctgcccccagctgtggtgggctgtgccagcaaggccctggacctgctgatgggcagcaacaccatcgtgcagagcatggccgccaagacccagcgcttccgcagcaagatggaggccgccggcttcaccatcagcggggccagccaccccatctgccctgtgatgctgggagatgcccggctggccagcaggatggctgatgacatgctgaagaggggcatcttcgtcatcggcttctcctaccctgtggtgcccaagggcaaggcccgcatccgggtgcagatctctgctgtgcacagtgaagaagatattgacagatgtgtggaggcctttgtggaggtgggccgcctgcatggagccctgccctag

SEQ ID NO: 154183 - DNA, 744 bp, Artificial Sequence
  Description of Artificial Sequence: Synthetic coding sequence
atgtggccaggaaatgcctggagggctgccctcttctgggtgccccggggccggcgggcccagagcgccctggcccagctgcggggcatcctggagggggagctggagggcatcagaggagctggcacctggaagtctgagagggtcatcaccagccggcagggcccccacatccgggtggatggagtgtctgggggccctggcaccgtcatcttccctggcctgcccctgccccacctgagctgctgcatccacctgctgtccttcaccagcggcatcctgaacttctgtgccaacaactacctgggcctgagcagccaccctgaggtgatccaggccggcctgcaggccctggaggagtttggagctggcctgagctctgtgcgcttcatctgtggcacccagagcatccacaagaacctggaggccaagatcgcccgcttccaccagcgggaggatgccatcctgtaccccagctgctatgatgccaatgccggcctgtttgaggccctgctgaccccagaagatgctgtgctgagtgatgagctgaaccacgccagcatcattgatggcatccggctgtgcaaggcccacaagtaccgctaccgccacctggacatggctgacctggaggccaagctgcaggaggcccagaagcaccggctgcggctggtggccacagatggagccttccacggctggaggcacaggaccccagctggggacctgctgccccggctgtag

SEQ ID NO: 154184 - DNA, 522 bp, Artificial Sequence
  Description of Artificial Sequence: Synthetic coding sequence
atggccctgcgggtggtgcgctctgtgcgggccctgctgtgcaccctgcgggctgtgcccagccctgctgccccctgccccccccggccctggcagctgggcgtgggcgctgtgaggaccctgaggactggacctgccctgctgtctgtgaggaagttcacagagaagcatgagtgggtgaccacagaaaatggcatcggcaccgtgggcatcagcaactttgcccaggaggccctgggagatgtggtgtactgcagcctgcctgaggtgggcaccaagctgaacaagcaggatgaatttggagccctggagagcgtgaaggccgccagcgagctgtacagccccctgtctggagaggtgacagagatcaatgaggccctggctgaaaatcctggcctggtgaacaagagctgctatgaagatggctggctgatcaagatgaccctgagcaaccccagcgagctggatgagctgatgtctgaggaggcctatgagaagtacatcaagagcattgaggagtag

SEQ ID NO: 154185 - DNA, 3063 bp, Artificial Sequence
  Description of Artificial Sequence: Synthetic coding sequence
atgcagagctgtgcccgggcctggggcctgcggctgggccggggcgtgggcggcggccggcggctggccggcggcagcggcccctgctgggcccccaggagccgggacagcagcagcggcggcggggacagcgctgctgctggggccagccggctgctggagcggctgctgcccaggcatgatgactttgcccggcggcacatcggccctggggacaaggaccagcgggagatgctgcagaccctgggcctggccagcattgatgagctgattgagaagacagtgcctgccaacatccggctgaagaggcccctgaagatggaggaccctgtgtgtgaaaatgagatcctggccaccctgcacgccatcagcagcaagaaccagatctggaggagctacatcggcatgggctactacaactgcagcgtgccccagaccatcctgaggaacctgctggagaacagcggctggatcacccagtacaccccctaccagcctgaggtgtcccagggccgcctggagagcctgctgaactaccagaccatggtgtgtgacatcaccggcctggacatggccaatgccagcctgctggatgagggcacagctgctgctgaggccctgcagctgtgctaccgccacaacaagaggaggaagttcctggtggacccccgctgccacccccagaccatcgctgtggtgcagacccgggccaagtacacaggagtgctgacagagctgaagctgccctgtgagatggacttcagcggcaaggatgtgtctggagtgctcttccagtacccagacacagagggcaaggtggaggacttcacagagctggtggagcgggcccaccagagcggcagcctggcctgctgtgccacagacctgctggccctgtgcatcctgcggcccccaggagaatttggagtggacatcgccctgggcagcagccagcgcttcggcgtgcccctgggctacggcggcccccatgctgccttctttgctgtgcgggagagcctggtgaggatgatgcctggccgcatggtgggcgtgaccagagatgccaccgggaaggaggtgtaccgcctggccctgcagacccgggagcagcacatcagaagagacaaggccaccagcaacatctgcacagcccaggccctgctggccaacatggccgccatgtttgccatctaccacggcagccacggcctggagcacatcgccaggagagtgcacaatgccaccctcatcctgtctgagggcctgaagagagctggccaccagctgcagcacgacctcttctttgacaccctgaagatccagtgtggctgcagcgtgaaggaggtgctgggccgggccgcccagaggcagatcaacttccggctgtttgaagatggcaccctgggcatcagcctggatgaaacagtgaatgagaaggacctggatgacctgctgtggatcttcggctgtgagagcagcgctgagctggtggccgagagcatgggagaggagtgccggggcatccctggctctgtgttcaagaggaccagccccttcctgacccaccaggtgttcaacagctaccacagcgagaccaacatcgtgcgctacatgaagaagctggagaacaaggacatcagcctggtgcacagcatgatccccctgggcagctgcaccatgaagctgaacagcagcagcgagctggcccccatcacctggaaggagtttgccaacatccacccctttgtgcccctggaccaggcccagggctaccagcagctgttccgggagctggagaaggacctgtgtgagctgaccggctatgaccaggtgtgcttccagcccaacagcggggcccagggcgagtatgccggcctggccaccatccgggcctacctgaaccagaagggggagggccacaggacagtgtgcctgatccccaagagcgcccacggcaccaacccagccagcgcccacatggccggcatgaagatccagcctgtggaggtggacaagtatggcaacattgatgctgtgcacctgaaggccatggtggacaagcacaaggagaacctggccgccatcatgatcacctaccccagcaccaatggagtgtttgaggagaacatcagtgatgtgtgtgacctgatccaccagcacggcggccaggtgtacctggatggagccaacatgaatgcccaggtgggcatctgcaggcctggggactttggaagtgatgtgagccacctgaacctgcacaagaccttctgcatcccccacggcggcggcggccctggcatgggccccatcggcgtgaagaagcacctggcccccttcctgcccaaccaccctgtgatcagcctgaagagaaatgaagatgcctgccctgtgggcaccgtgtctgctgccccctggggcagcagcagcatcctgcccatctcctgggcctacatcaagatgatgggcggcaagggcctgaagcaggccacagaaacagccatcctgaatgccaactacatggccaagaggctggagacccactaccgcatcctcttccggggggcccggggctacgtgggccacgagttcatcctggacacccggcccttcaagaagagcgccaacatcgaggccgtggatgtggccaagaggctgcaggactatggcttccacgcccccaccatgtcctggcctgtggccggcaccctgatggtggagcccacagaaagtgaggacaaggccgagctggaccgcttctgtgatgccatgatcagcatccggcaggagattgctgacatcgaggagggcagaattgacccccgggtgaaccccctgaagatgagcccccacagcctgacctgtgtgaccagcagccactgggaccggccctacagccgggaggtggccgccttccccctgccctttgtgaagccagagaacaagttctggcccaccatcgccagaattgatgacatctatggagaccagcacctggtgtgcacctgcccccccatggaggtgtatgagagccccttcagcgagcagaagagggccagcagctag

SEQ ID NO: 154186 - DNA, 888 bp, Artificial Sequence
  Description of Artificial Sequence: Synthetic coding sequence
atggtggacagcgtgtaccgcaccaggagcctgggcgtggccgctgagggcctgcctgaccagtatgcagatggagaggccgcccgggtgtggcagctgtacatcggggacaccaggagcaggacagctgagtacaaggcctggctgctgggcctgctgcggcagcacggctgccagagggtgctggatgtggcctgtggcaccggggtggacagcatcatgctggtggaggagggcttctctgtgacctctgtggatgccagtgacaagatgctgaagtatgccctgaaggagcgctggaacagaagacatgagcccgcctttgacaagtgggtgattgaggaggccaactggatgaccctggacaaggatgtgccccagagcgctgagggcggctttgatgctgtgatctgcctgggcaacagctttgcccacctgcctgactgcaagggggaccagagcgagcaccggctggccctgaagaacatcgcctccatggtgcgggccggcggcctgctggtgattgaccacaggaactatgaccacatcctgagcacaggctgtgcccctcctgggaagaacatctactacaagagtgacctgaccaaggatgtgaccacctctgtgctgattgtgaacaacaaggcccacatggtgaccctggactacacagtgcaggtgcctggggccggccaggacggcagccctggcctgagcaagttccggctgagctactacccccactgcctggccagcttcacagagctgctgcaggccgcctttggaggcaagtgccagcacagcgtgctgggggacttcaagccctacaagccaggccagacctacatcccctgctacttcatccacgtgctgaagaggacagactag

SEQ ID NO: 154187 - DNA, 1350 bp, Artificial Sequence
  Description of Artificial Sequence: Synthetic coding sequence
atgtacagcttcaacaccctgcggctgtacctgtgggagaccatcgtgttcttcagcctggccgccagcaaggaggccgaggccgcccggagcgcccccaagcccatgagccccagcgacttcctggacaagctgatgggccgcaccagcggctatgatgcccgcatccggcccaacttcaagggcccccctgtgaatgtgtcctgcaacatcttcatcaacagctttggcagcattgctgagaccaccatggactacagagtgaacatcttcctgcggcagcagtggaatgacccccggctggcctacaatgagtacccagatgacagcctggacctggaccccagcatgctggacagcatctggaagccagacctcttctttgccaatgagaagggggcccacttccacgagatcaccacagacaacaagctgctgcgcatcagcagaaatggaaatgtgctgtacagcatccgcatcaccctgaccctggcctgccccatggacctgaagaacttccccatggatgtgcagacctgcatcatgcagctggagagctttggctacaccatgaatgacctgatctttgagtggcaggagcagggcgctgtgcaggtggctgatggcctgaccctgccccagttcatcctgaaggaggagaaggacctgcgctactgcaccaagcactacaacacaggcaagttcacctgcatcgaggcccgcttccacctggagcggcagatgggctactacctgatccagatgtacatccccagcctgctgattgtcatcctgtcctggatctccttctggatcaacatggatgctgccccagcccgggtgggcctgggcatcaccaccgtgctgaccatgaccacccagagcagcggcagccgggccagcctgcccaaggtgtcctatgtgaaggccatcgacatctggatggctgtgtgcctgctgtttgtgttcagcgccctgctggagtatgctgctgtgaactttgtgtcccggcagcacaaggagctgctgcgcttccggaggaagagaagacaccacaaggaggatgaagctggggagggccgcttcaacttcagcgcctacggcatgggccctgcctgcctgcaggccaaggatggcatctctgtgaagggggccaacaacagcaacaccaccaaccccccaccagcccccagcaagagccctgaggagatgaggaagctgttcatccagagggccaagaagattgacaagatcagcagaattggcttccccatggccttcctgatcttcaacatgttctactggatcatctacaagatcgtgcggcgggaggatgtgcacaaccagtag

SEQ ID NO: 154188 - DNA, 1374 bp, Artificial Sequence
  Description of Artificial Sequence: Synthetic coding sequence
atgtacagcttcaacaccctgcggctgtacctgtgggagaccatcgtgttcttcagcctggccgccagcaaggaggccgaggccgcccggagcgcccccaagcccatgagccccagcgacttcctggacaagctgatgggccgcaccagcggctatgatgcccgcatccggcccaacttcaagggcccccctgtgaatgtgtcctgcaacatcttcatcaacagctttggcagcattgctgagaccaccatggactacagagtgaacatcttcctgcggcagcagtggaatgacccccggctggcctacaatgagtacccagatgacagcctggacctggaccccagcatgctggacagcatctggaagccagacctcttctttgccaatgagaagggggcccacttccacgagatcaccacagacaacaagctgctgcgcatcagcagaaatggaaatgtgctgtacagcatccgcatcaccctgaccctggcctgccccatggacctgaagaacttccccatggatgtgcagacctgcatcatgcagctggagagctttggctacaccatgaatgacctgatctttgagtggcaggagcagggcgctgtgcaggtggctgatggcctgaccctgccccagttcatcctgaaggaggagaaggacctgcgctactgcaccaagcactacaacacaggcaagttcacctgcatcgaggcccgcttccacctggagcggcagatgggctactacctgatccagatgtacatccccagcctgctgattgtcatcctgtcctggatctccttctggatcaacatggatgctgccccagcccgggtgggcctgggcatcaccaccgtgctgaccatgaccacccagagcagcggcagccgggccagcctgcccaaggtgtcctatgtgaaggccatcgacatctggatggctgtgtgcctgctgtttgtgttcagcgccctgctggagtatgctgctgtgaactttgtgtcccggcagcacaaggagctgctgcgcttccggaggaagagaagacaccacaagagccccatgctgaacctcttccaggaggatgaagctggggagggccgcttcaacttcagcgcctacggcatgggccctgcctgcctgcaggccaaggatggcatctctgtgaagggggccaacaacagcaacaccaccaaccccccaccagcccccagcaagagccctgaggagatgaggaagctgttcatccagagggccaagaagattgacaagatcagcagaattggcttccccatggccttcctgatcttcaacatgttctactggatcatctacaagatcgtgcggcgggaggatgtgcacaaccagtag

SEQ ID NO: 154189 - DNA, 1101 bp, Artificial Sequence
  Description of Artificial Sequence: Synthetic coding sequence
atggactacagagtgaacatcttcctgcggcagcagtggaatgacccccggctggcctacaatgagtacccagatgacagcctggacctggaccccagcatgctggacagcatctggaagccagacctcttctttgccaatgaaaaaggagcccacttccacgagatcaccacagacaacaagctgctgcgcatcagcagaaatggaaatgtgctgtacagcatccgcatcaccctgaccctggcctgccccatggacctgaagaacttccccatggatgtgcagacctgcatcatgcagctggagagctttggctacaccatgaatgacctgatctttgagtggcaggagcagggcgctgtgcaggtggctgatggcctgaccctgccccagttcatcctgaaggaggagaaggacctgcgctactgcaccaagcactacaacacaggcaagttcacctgcatcgaggcccgcttccacctggagcggcagatgggctactacctgatccagatgtacatccccagcctgctgattgtcatcctgtcctggatctccttctggatcaacatggatgctgccccagcccgggtgggcctgggcatcaccaccgtgctgaccatgaccacccagagcagcggcagccgggccagcctgcccaaggtgtcctatgtgaaggccatcgacatctggatggctgtgtgcctgctgtttgtgttttctgccctgctggagtatgctgctgtgaactttgtgtcccggcagcacaaggagctgctgcgcttccggaggaagaggaggcaccacaaggaggatgaggccggggagggccgcttcaacttcagcgcctacggcatgggccctgcctgcctgcaggccaaggatggcatctctgtgaagggggccaacaacagcaacaccaccaaccccccaccagcccccagcaagagccctgaggagatgaggaagctgttcatccagagggccaagaagattgacaagatcagccgcatcggcttccccatggccttcctgatcttcaacatgttctactggatcatctacaagatcgtgagaagagaagatgtgcacaaccagtag

SEQ ID NO: 154190 - DNA, 309 bp, Artificial Sequence
  Description of Artificial Sequence: Synthetic coding sequence
atgtctgcccgggtgcgcagccgcagccggggcagaggagatggccaggaggccccagatgtggtggcctttgtggcccctggagagagccagcaggaggagcccccaacagacaaccaggacatcgagcccggccaggagcgggagggcaccccacccatcgaggagaggaaggtggagggggactgccaggagatggacctggagaagaccaggagtgaaagaggagatggcagtgatgtgaaggagaagaccccacccaaccccaagcacgccaagaccaaggaggccggagatggccagccctag

SEQ ID NO: 154191 - DNA, 1359 bp, Artificial Sequence
  Description of Artificial Sequence: Synthetic coding sequence
atgaaccggcagctggtgaacatcctgacagccctgtttgccttcttcctggagaccaaccacttcagaacagccttctgcaaggaccatgacagccgcagcggcaagcagcccagccagaccctgagccccagcgacttcctggacaagctgatgggccgcaccagcggctatgatgcccgcatccggcccaacttcaagggcccccctgtgaatgtgacctgcaacatcttcatcaacagctttggcagcattgctgagaccaccatggactacagagtgaacatcttcctgcggcagcagtggaatgacagccggctggcctacagcgagtacccagatgacagcctggacctggaccccagcatgctggacagcatctggaagccagacctcttctttgccaatgagaagggggccaacttccatgatgtgaccacagacaacaagctgctgcgcatcagcaagaatggcaaggtgctgtacagcatccggctgaccctgaccctgagctgccccatggacctgaagaacttccccatggatgtgcagacctgcaccatgcagctggagagctttggctacaccatgaatgacctgatctttgagtggctgagtgatggccctgtgcaggtggccgagggcctgaccctgccccagttcatcctgaaggaggagaaggagctgggctactgcaccaagcactacaacacaggcaagttcacctgcatcgaggtgaagttccacctggagcggcagatgggctactacctgatccagatgtacatccccagcctgctgattgtcatcctgtcctgggtgtccttctggatcaacatggatgctgccccagcccgggtggccctgggcatcaccaccgtgctgaccatgaccacccagagcagcggcagccgggccagcctgcccaaggtgtcctatgtgaaggccatcgacatctggatggctgtgtgcctgctgtttgtgtttgctgccctgctggagtatgctgctgtgaactttgtgtcccggcagcacaaggagttcctgcggctgcggcggcggcagaagaggcagaacaaggaggaggatgtgacccgggagagccgcttcaacttcagcggctacggcatgggccactgcctgcaggtgaaggatggaacagctgtgaaggccaccccagccaaccccctgccccagccccccaaggatggagatgccatcaagaagaagtttgtggaccgggccaagagaattgacaccatcagccgggccgccttccccctggccttcctgatcttcaacatcttctactggatcacctacaagatcatcagacatgaagatgtgcacaagaagtag

SEQ ID NO: 154192 - DNA, 648 bp, Artificial Sequence
  Description of Artificial Sequence: Synthetic coding sequence
atgaacctgcacatgaggatgacagccttctgcaaggaccatgacagccgcagcggcaagcagcccagccagaccctgagccccagcgacttcctggacaagctgatgggccgcaccagcggctatgatgcccgcatccggcccaacttcaagggcccccctgtgaatgtgacctgcaacatcttcatcaacagctttggatctgtgacagagaccaccatggactacagagtgaacatcttcctgcggcagcagtggaatgacagccggctggcctacagcgagtacccagatgacagcctggacctggaccccagcatgctggacagcatctggaagccagacctcttctttgccaatgagaagggggccaacttccatgatgtgaccacagacaacaagctgctgcgcatcagcaagaatggcaaggtgctgtacagcatccggctgaccctgaccctgagctgccccatggacctgaagaacttccccatggatgtgcagacctgcaccatgcagctggagagctttggctacaccatgaatgacctgatctttgagtggctgagtgatggccctgtgcaggtggccgagggcctgaccctgccccagttcatcctgaaggaggagaaggagctgggctactag

SEQ ID NO: 154193 - DNA, 1092 bp, Artificial Sequence
  Description of Artificial Sequence: Synthetic coding sequence
atggactacagagtgaacatcttcctgcggcagcagtggaatgacagccggctggcctacagcgagtacccagatgacagcctggacctggaccccagcatgctggacagcatctggaagccagacctcttctttgccaatgaaaaaggagccaacttccatgatgtgaccacagacaacaagctgctgcgcatcagcaagaatggcaaggtgctgtacagcatccggctgaccctgaccctgagctgccccatggacctgaagaacttccccatggatgtgcagacctgcaccatgcagctggagagctttggctacaccatgaatgacctgatctttgagtggctgagtgatggccctgtgcaggtggccgagggcctgaccctgccccagttcatcctgaaggaggagaaggagctgggctactgcaccaagcactacaacacaggcaagttcacctgcatcgaggtgaagttccacctggagcggcagatgggctactacctgatccagatgtacatccccagcctgctgattgtcatcctgtcctgggtgtccttctggatcaacatggatgctgccccagcccgggtggccctgggcatcaccaccgtgctgaccatgaccacccagagcagcggcagccgggccagcctgcccaaggtgtcctatgtgaaggccatcgacatctggatggctgtgtgcctgctgtttgtgtttgctgccctgctggagtatgctgctgtgaactttgtgtcccggcagcacaaggagttcctgcggctgcggcggcggcagaagaggcagaacaaggaggaggatgtgacccgggagagccgcttcaacttcagcggctacggcatgggccactgcctgcaggtgaaggatggaacagctgtgaaggccaccccagccaaccccctgccccagccccccaaggatggagatgccatcaagaagaagtttgtggaccgggccaagagaattgacaccatcagcagagctgccttccccctggccttcctgatcttcaacatcttctactggatcacctacaagatcatcagacatgaagatgtgcacaagaagtag

SEQ ID NO: 154194 - DNA, 1395 bp, Artificial Sequence
  Description of Artificial Sequence: Synthetic coding sequence
atggcccacgtgcgccacttccgcaccctggtgtctggcttctacttctgggaggccgccctgctgctgagcctggtggccaccaaggagacagattctgcccggagccgcagcgcccccatgagccccagcgacttcctggacaagctgatgggccgcaccagcggctatgatgcccgcatccggcccaacttcaagggcccccctgtgaatgtgacctgcaacatcttcatcaacagctttggcagcattgctgagaccaccatggactacagagtgaacatcttcctgcggcagaagtggaatgacccccggctggcctacagcgagtacccagatgacagcctggacctggaccccagcatgctggacagcatctggaagccagacctcttctttgccaatgaaaaaggagccaacttccacgaggtgaccacagacaacaagctgctgcgcatcttcaagaatggaaatgtgctgtacagcatccggctgaccctgaccctgagctgccccatggacctgaagaacttccccatggatgtgcagacctgcatcatgcagctggagagctttggctacaccatgaatgacctgatctttgagtggcaggatgaggcccctgtgcaggtggccgagggcctgaccctgccccagttcctgctgaaggaggagaaggacctgcgctactgcaccaagcactacaacacaggcaagttcacctgcatcgaggtgcgcttccacctggagcggcagatgggctactacctgatccagatgtacatccccagcctgctgattgtcatcctgtcctgggtgtccttctggatcaacatggatgctgccccagcccgggtggccctgggcatcaccaccgtgctgaccatgaccacccagagcagcggcagccgggccagcctgcccaaggtgtcctatgtgaaggccatcgacatctggatggctgtgtgcctgctgtttgtgttttctgccctgctggagtatgctgctgtgaactttgtgtcccggcagcacaaggagctgctgcgcttccggaggaagaggaagaacaagacagaggcctttgccctggagaagttctaccgcttcagtgacatggatgatgaggtgcgggagagccgcttctccttcaccgcctacggcatgggcccctgcctgcaggccaaggatggcatgacccccaagggccccaaccaccctgtgcaggtgatgcccaagagcccagatgagatgaggaaggtgttcatcgaccgggccaagaagattgacaccatcagccgggcctgcttccccctggccttcctgatcttcaacatcttctactgggtgatctacaagatcctgcggcatgaggacatccaccagcagcaggactag

SEQ ID NO: 154195 - DNA, 1350 bp, Artificial Sequence
  Description of Artificial Sequence: Synthetic coding sequence
atggcccacgtgcgccacttccgcaccctggtgtctggcttctacttctgggaggccgccctgctgctgagcctggtggccaccaaggagacagattctgcccggagccgcagcgcccccatgagccccagcgacttcctggacaagctgatgggccgcaccagcggctatgatgcccgcatccggcccaacttcaagggcccccctgtgaatgtgacctgcaacatcttcatcaacagctttggcagcattgctgagaccaccatggactacagagtgaacatcttcctgcggcagaagtggaatgacccccggctggcctacagcgagtacccagatgacagcctggacctggaccccagcatgctggacagcatctggaagccagacctcttctttgccaatgaaaaaggagccaacttccacgaggtgaccacagacaacaagctgctgcgcatcttcaagaatggaaatgtgctgtacagcatccggctgaccctgaccctgagctgccccatggacctgaagaacttccccatggatgtgcagacctgcatcatgcagctggagagctttggctacaccatgaatgacctgatctttgagtggcaggatgaggcccctgtgcaggtggccgagggcctgaccctgccccagttcctgctgaaggaggagaaggacctgcgctactgcaccaagcactacaacacaggcaagttcacctgcatcgaggtgcgcttccacctggagcggcagatgggctactacctgatccagatgtacatccccagcctgctgattgtcatcctgtcctgggtgtccttctggatcaacatggatgctgccccagcccgggtggccctgggcatcaccaccgtgctgaccatgaccacccagagcagcggcagccgggccagcctgcccaaggtgtcctatgtgaaggccatcgacatctggatggctgtgtgcctgctgtttgtgttttctgccctgctggagtatgctgctgtgaactttgtgtcccggcagcacaaggagctgctgcgcttccggaggaagaggaagaacaaggatgatgaggtgcgggagagccgcttctccttcaccgcctacggcatgggcccctgcctgcaggccaaggatggcatgacccccaagggccccaaccaccctgtgcaggtgatgcccaagagcccagatgagatgaggaaggtgttcatcgaccgggccaagaagattgacaccatcagccgggcctgcttccccctggccttcctgatcttcaacatcttctactgggtgatctacaagatcctgcggcatgaggacatccaccagcagcaggactag

SEQ ID NO: 154196 - DNA, 1494 bp, Artificial Sequence
  Description of Artificial Sequence: Synthetic coding sequence
atgaagttcctgctgaccacagccttcctgatcctgatcagcctgtgggtggaggaggcctacagcaaggagaagagcagcaagaagggcaagggcaagaagaagcagtacctgtgccccagccagcagagcgctgaggacctggcccgggtgcctgccaacagcaccagcaacatcctgaaccggctgctggtgtcctatgacccccgcatccggcccaacttcaagggcatccctgtggatgtggtggtgaacatcttcatcaacagctttggcagcatccaggagaccaccatggactacagagtgaacatcttcctgcggcagaagtggaatgacccccggctgaagctgcccagcgacttccggggcagtgatgccctgactgtggaccccaccatgtacaagtgcctgtggaagccagacctcttctttgccaatgagaagagcgccaacttccatgatgtgacccaggagaacatcctgctcttcatcttcagagatggagatgtgctggtgtccatgaggctgagcatcaccctgagctgccccctggacctgaccctcttccccatggacacccagcgctgcaagatgcagctggagagctttggctacaccacagatgacctgcgcttcatctggcagagcggggaccctgtgcagctggagaagatcgccctgccccagtttgacatcaagaaggaggacatcgagtatggcaactgcaccaagtactacaagggcaccggctactacacctgtgtggaggtgatcttcaccctgcggcggcaggtgggcttctacatgatgggcgtgtatgcccccaccctgctgattgtggtgctgtcctggctgtccttctggatcaacccagatgccagcgctgcccgggtgcccctgggcatcttctctgtgctgagcctggccagcgagtgcaccaccctggccgctgagctgcccaaggtgtcctatgtgaaggccctggatgtgtggctgattgcctgcctgctgtttggatttgccagcctggtggagtatgctgtggtgcaggtgatgctgaacaaccccaagagggtggaggccgagaaggccagaattgccaaggccgagcaggctgatggcaagggcggcaatgtggccaagaagaacacagtgaatggaacaggcacccctgtgcacatcagcaccctgcaggtgggggagacccgctgcaagaaggtgtgcaccagcaagagtgacctgcggagcaatgacttcagcatcgtgggcagcctgccccgggactttgagctgagcaactatgactgctacggcaagcccatcgaggtgaacaacggcctgggcaagagccaggccaagaacaacaagaagcccccaccagccaagcctgtgatccccacagctgccaagagaattgacctgtatgcccgggccctcttccccttctgcttcctgttcttcaacgtcatctactggagcatctacctgtag

SEQ ID NO: 154197 - DNA, 1494 bp, Artificial Sequence; identical to SEQ ID NO: 154196
  Description of Artificial Sequence: Synthetic coding sequence

SEQ ID NO: 154198 - DNA, 912 bp, Artificial Sequence
  Description of Artificial Sequence: Synthetic coding sequence
atgaagttcctgctgaccacagccttcctgatcctgatcagcctgtgggtggaggaggcctacagcaaggagaagagcagcaagaagggcaagggcaagaagaagcagtacctgtgccccagccagcagagcgctgaggacctggcccgggtgcctgccaacagcaccagcaacatcctgaaccggctgctggtgtcctatgacccccgcatccggcccaacttcaagggcatccctgtggatgtggtggtgaacatcttcatcaacagctttggcagcatccaggagaccaccatggactacagagtgaacatcttcctgcggcagaagtggaatgacccccggctgaagctgcccagcgacttccggggcagtgatgccctgactgtggaccccaccatgtacaagtgcctgtggaagccagacctcttctttgccaatgagaagagcgccaacttccatgatgtgacccaggagaacatcctgctcttcatcttcagagatggagatgtgctggtgtccatgaggctgagcatcaccctgagctgccccctggacctgaccctcttccccatggacacccagcgctgcaagatgcagctggagagctttggctacaccacagatgacctgcgcttcatctggcagagcggggaccctgtgcagctggagaagatcgccctgccccagtttgacatcaagaaggaggacatcgagtatggcaactgcaccaagtactacaagggcaccggctactacacctgtgtggaggtgatcttcaccctgcggcggcaggtgggcttctacatgatgggcgtgtatgcccccaccctgctgattgtggtgctgtcctggctgtccttctggatcaacccagatgccagcgctgcccgggtgcccctgggctggtag

SEQ ID NO: 154199 - DNA, 492 bp, Artificial Sequence
  Description of Artificial Sequence: Synthetic coding sequence
atgatgctgcccctgcagggcgcccagatgctgcagatgctggagaagagcctgaggaagagcctgcctgccagcctgaaggtgtatggaacagtgttccacatcaaccacggcaaccccttcaacctgaaggctgtggtggacaagtggccagacttcaacacagtggtggtgtgcccccaggagcaggacatgacagatgacctggaccactacaccaacacctaccagatctacagcaaggacccccagaactgccaggagttcctgggcagccctgagctgatcaactggaagcagcacctgcagatccagagcagccagcccagcctgaatgaggccatccagaacctggccgccatcaagagcttcaaggtgaagcagacccagaggatcctgtacatggctgctgagacagccaaggagctgacccccttcctgctgaagagcaagatcctgagccccaacggcggcaagcccaaggccatgtag

SEQ ID NO: 154200 - DNA, 891 bp, Artificial Sequence
  Description of Artificial Sequence: Synthetic coding sequence
atgatgctgcccctgcagggcgcccagatgctgcagatgctggagaagagcctgaggaagagcctgcctgccagcctgaaggtgtatggaacagtgttccacatcaaccacggcaaccccttcaacctgaaggctgtggtggacaagtggccagacttcaacacagtggtggtgtgcccccaggagcaggacatgacagatgacctggaccactacaccaacacctaccagatctacagcaaggacccccagaactgccaggagttcctgggcagccctgagctgatcaactggaagcagcacctgcagatccagagcagccagcccagcctgaatgaggccatccagaacctggccgccatcaagagcttcaaggtgaagcagacccagaggatcctgtacatggctgctgagacagccaaggagctgacccccttcctgctgaagagcaagatcctgagccccaacggcggcaagcccaaggccatcaaccaggagatgttcaagctgagctccatggatgtgacccacgcccacctggtgaacaagttctggcactttggaggaaatgaaagaagccagcgcttcatcgagcgctgcatccagaccttccccacctgctgcctgctgggccctgagggcacccctgtgtgctgggacctgatggaccagacaggagagatgaggatggccggcaccctgcctgagtaccgcctgcacggcctggtgacctacgtgatctacagccacgcccagaagctgggcaagctgggcttccctgtgtacagccacgtggactacagcaatgaggccatgcagaagatgagctacaccctgcagcacgtgcccatccccaggtcctggaaccagtggaactgtgtgcccctgtag

SEQ ID NO: 154201 - DNA, 891 bp, Artificial Sequence; identical to SEQ ID NO: 154200
  Description of Artificial Sequence: Synthetic coding sequence

SEQ ID NO: 154202 - DNA, 2022 bp, Artificial Sequence
  Description of Artificial Sequence: Synthetic coding sequence
atgcccctgaacagaaccctgtccatgagcagcctgcccggcctggaggactgggaggatgaatttgacctggagaatgctgtgctgtttgaggtggcctgggaggtggccaacaaggtgggcggcatctacacagtgctgcagaccaaggccaaggtgactggagatgagtggggagacaactacttcctggtgggcccctacacagagcagggcgtgaggacccaggtggagctgctggaggcccccaccccagccctgaagaggaccctggacagcatgaacagcaagggctgcaagttcctggcccagagcgaggagaagccccacgtggtggcccacttccacgagtggctggccggcgtgggcctgtgcctgtgccgggcccggcggctgcctgtggccaccatcttcaccacccacgccaccctgctgggccgctacctgtgtgccggggctgtggacttctacaacaacctggagaacttcaacgtggacaaggaggccggggagcggcagatctaccaccgctactgcatggagagagctgctgcccactgtgcccacgtgttcaccaccgtgtcccagatcacagccatcgaggcccagcacctgctgaagaggaagccagacatcgtgacccccaacggcctgaatgtgaagaagttcagcgccatgcatgagttccagaacctgcacgcccagagcaaggcccgcatccaggagtttgtgcggggccacttctacggccacctggacttcaacctggacaagaccctgtacttcttcatcgccggccgctatgagttcagcaacaagggagcagatgtgttcctggaggccctggcccggctgaactacctgctgcgggtgaatggcagcgagcagacagtggtggccttcttcatcatgcctgcccggaccaacaacttcaacgtggagaccctgaagggccaggccgtgaggaagcagctgtgggacacagccaacacagtgaaggagaagtttggaaggaagctgtatgagagcctgctggtgggcagcctgcctgacatgaacaagatgctggacaaggaggacttcaccatgatgaagagggccatctttgccacccagaggcagagcttcccccctgtgtgcacccacaacatgctggatgacagcagtgaccccatcctgaccaccatcagaagaattggcctcttcaacagcagcgctgacagagtgaaggtgatcttccaccctgagttcctgagcagcaccagccccctgctgcctgtggactatgaggagtttgtgcggggctgccacctgggcgtcttccccagctactatgagccctggggctacaccccagctgagtgcaccgtgatgggcatccccagcatcagcaccaacctgagcggcttcggctgcttcatggaggagcacatcgctgaccccagcgcctacggcatctacatcctggaccggcgcttccgcagcctggatgacagctgcagccagctgaccagcttcctgtacagcttctgccagcagagccggcggcagaggatcatccagaggaacagaacagagcggctgagtgacctgctggactggaagtacctgggccgctactacatgtctgcccggcacatggccctgagcaaggccttccctgagcacttcacctatgagcccaatgaagcagatgctgcccagggctaccgctaccccaggcctgcctctgtgccccccagccccagcctgagccgccacagcagcccccaccagagtgaagatgaggaggaccccagaaatggccccctggaggaggatggagagagatatgatgaagatgaggaggccgccaaggacagaagaaacatccgggcccctgagtggccccggcgggccagctgcaccagcagcaccagcggcagcaagaggaacagcgtggacacagccaccagcagcagcctgagcaccccatctgagcccctgagccccaccagcagcctgggggaggagaggaactag

SEQ ID NO: 154203 - DNA, 2214 bp, Artificial Sequence
  Description of Artificial Sequence: Synthetic coding sequence
atgcccctgaacagaaccctgtccatgagcagcctgcccggcctggaggactgggaggatgaatttgacctggagaatgctgtgctgtttgaggtggcctgggaggtggccaacaaggtgggcggcatctacacagtgctgcagaccaaggccaaggtgactggagatgagtggggagacaactacttcctggtgggcccctacacagagcagggcgtgaggacccaggtggagctgctggaggcccccaccccagccctgaagaggaccctggacagcatgaacagcaagggctgcaaggtgtacttcggccgctggctgattgagggcggccccctggtggtgctgctggatgtgggcgccagcgcctgggccctggagcgctggaagggggagctgtgggacacctgcaacattggagtgccctggtatgaccgggaggccaatgatgctgtgctgtttggcttcctgaccacctggttcctgggggagttcctggcccagagcgaggagaagccccacgtggtggcccacttccacgagtggctggccggcgtgggcctgtgcctgtgccgggcccggcggctgcctgtggccaccatcttcaccacccacgccaccctgctgggccgctacctgtgtgccggggctgtggacttctacaacaacctggagaacttcaacgtggacaaggaggccggggagcggcagatctaccaccgctactgcatggagagagctgctgcccactgtgcccacgtgttcaccaccgtgtcccagatcacagccatcgaggcccagcacctgctgaagaggaagccagacatcgtgacccccaacggcctgaatgtgaagaagttcagcgccatgcatgagttccagaacctgcacgcccagagcaaggcccgcatccaggagtttgtgcggggccacttctacggccacctggacttcaacctggacaagaccctgtacttcttcatcgccggccgctatgagttcagcaacaagggagcagatgtgttcctggaggccctggcccggctgaactacctgctgcgggtgaatggcagcgagcagacagtggtggccttcttcatcatgcctgcccggaccaacaacttcaacgtggagaccctgaagggccaggccgtgaggaagcagctgtgggacacagccaacacagtgaaggagaagtttggaaggaagctgtatgagagcctgctggtgggcagcctgcctgacatgaacaagatgctggacaaggaggacttcaccatgatgaagagggccatctttgccacccagaggcagagcttcccccctgtgtgcacccacaacatgctggatgacagcagtgaccccatcctgaccaccatcagaagaattggcctcttcaacagcagcgctgacagagtgaaggtgatcttccaccctgagttcctgagcagcaccagccccctgctgcctgtggactatgaggagtttgtgcggggctgccacctgggcgtcttccccagctactatgagccctggggctacaccccagctgagtgcaccgtgatgggcatccccagcatcagcaccaacctgagcggcttcggctgcttcatggaggagcacatcgctgaccccagcgcctacggcatctacatcctggaccggcgcttccgcagcctggatgacagctgcagccagctgaccagcttcctgtacagcttctgccagcagagccggcggcagaggatcatccagaggaacagaacagagcggctgagtgacctgctggactggaagtacctgggccgctactacatgtctgcccggcacatggccctgagcaaggccttccctgagcacttcacctatgagcccaatgaagcagatgctgcccagggctaccgctaccccaggcctgcctctgtgccccccagccccagcctgagccgccacagcagcccccaccagagtgaagatgaggaggaccccagaaatggccccctggaggaggatggagagagatatgatgaagatgaggaggccgccaaggacagaagaaacatccgggcccctgagtggccccggcgggccagctgcaccagcagcaccagcggcagcaagaggaacagcgtggacacagccaccagcagcagcctgagcaccccatctgagcccctgagccccaccagcagcctgggggaggagaggaactag

SEQ ID NO: 154204 - DNA, 708 bp, Artificial Sequence
  Description of Artificial Sequence: Synthetic coding sequence
atgaacagcacctggaggacccagtgcagcagcaagtggccaggccgctggctgaccagggtgtacttcggccgctggctgattgagggcggccccctggtggtgctgctggatgtgggcgccagcgcctgggccctggagcgctggaagggggagctgtgggacacctgcaacattggagtgccctggtatgaccgggaggccaatgatgctgtgctgtttggcttcctgaccacctggttcctgggggagttcctggcccagagcgaggagaagccccacgtggtggcccacttccacgagtggctggccggcgtgggcctgtgcctgtgccgggcccggcggctgcctgtggccaccatcttcaccacccacgccaccctgctgggccgctacctgtgtgccggggctgtggacttctacaacaacctggagaacttcaacgtggacaaggaggccggggagcggcagatctaccaccgctactgcatggagagagctgctgcccactgtgcccacgtgttcaccaccgtgtcccagatcacagccatcgaggcccagcacctgctgaagaggaagccaggcatctggaccagcacctggacccggccctacaccagcctgagccctgctgccatgagcagccccaccagggtgctgaccagctcctggaggcactggctgggcagcaccatctgcagcgagtag

SEQ ID NO: 154205 - DNA, 1974 bp, Artificial Sequence
  Description of Artificial Sequence: Synthetic coding sequence
atgaacagcacctggaggacccagtgcagcagcaagtggccaggccgctggctgaccagggtgtacttcggccgctggctgattgagggcggccccctggtggtgctgctggatgtgggcgccagcgcctgggccctggagcgctggaagggggagctgtgggacacctgcaacattggagtgccctggtatgaccgggaggccaatgatgctgtgctgtttggcttcctgaccacctggttcctgggggagttcctggcccagagcgaggagaagccccacgtggtggcccacttccacgagtggctggccggcgtgggcctgtgcctgtgccgggcccggcggctgcctgtggccaccatcttcaccacccacgccaccctgctgggccgctacctgtgtgccggggctgtggacttctacaacaacctggagaacttcaacgtggacaaggaggccggggagcggcagatctaccaccgctactgcatggagagagctgctgcccactgtgcccacgtgttcaccaccgtgtcccagatcacagccatcgaggcccagcacctgctgaagaggaagccagacatcgtgacccccaacggcctgaatgtgaagaagttcagcgccatgcatgagttccagaacctgcacgcccagagcaaggcccgcatccaggagtttgtgcggggccacttctacggccacctggacttcaacctggacaagaccctgtacttcttcatcgccggccgctatgagttcagcaacaagggagcagatgtgttcctggaggccctggcccggctgaactacctgctgcgggtgaatggcagcgagcagacagtggtggccttcttcatcatgcctgcccggaccaacaacttcaacgtggagaccctgaagggccaggccgtgaggaagcagctgtgggacacagccaacacagtgaaggagaagtttggaaggaagctgtatgagagcctgctggtgggcagcctgcctgacatgaacaagatgctggacaaggaggacttcaccatgatgaagagggccatctttgccacccagaggcagagcttcccccctgtgtgcacccacaacatgctggatgacagcagtgaccccatcctgaccaccatcagaagaattggcctcttcaacagcagcgctgacagagtgaaggtgatcttccaccctgagttcctgagcagcaccagccccctgctgcctgtggactatgaggagtttgtgcggggctgccacctgggcgtcttccccagctactatgagccctggggctacaccccagctgagtgcaccgtgatgggcatccccagcatcagcaccaacctgagcggcttcggctgcttcatggaggagcacatcgctgaccccagcgcctacggcatctacatcctggaccggcgcttccgcagcctggatgacagctgcagccagctgaccagcttcctgtacagcttctgccagcagagccggcggcagaggatcatccagaggaacagaacagagcggctgagtgacctgctggactggaagtacctgggccgctactacatgtctgcccggcacatggccctgagcaaggccttccctgagcacttcacctatgagcccaatgaagcagatgctgcccagggctaccgctaccccaggcctgcctctgtgccccccagccccagcctgagccgccacagcagcccccaccagagtgaagatgaggaggaccccagaaatggccccctggaggaggatggagagagatatgatgaagatgaggaggccgccaaggacagaagaaacatccgggcccctgagtggccccggcgggccagctgcaccagcagcaccagcggcagcaagaggaacagcgtggacacagccaccagcagcagcctgagcaccccatctgagcccctgagccccaccagcagcctgggggaggagaggaactag

SEQ ID NO: 154206 - DNA, 1113 bp, Artificial Sequence
  Description of Artificial Sequence: Synthetic coding sequence
atgcctgcccggaccaacaacttcaacgtggagaccctgaagggccaggccgtgaggaagcagctgtgggacacagccaacacagtgaaggagaagtttggaaggaagctgtatgagagcctgctggtgggcagcctgcctgacatgaacaagatgctggacaaggaggacttcaccatgatgaagagggccatctttgccacccagaggcagagcttcccccctgtgtgcacccacaacatgctggatgacagcagtgaccccatcctgaccaccatccgccgcatcggcctcttcaacagcagcgctgacagagtgaaggtgatcttccaccctgagttcctgagcagcaccagccccctgctgcctgtggactatgaggagtttgtgcggggctgccacctgggcgtcttccccagctactatgagccctggggctacaccccagcagaatgtactgtgatgggcatccccagcatcagcaccaacctgagcggcttcggctgcttcatggaggagcacatcgctgaccccagcgcctacggcatctacatcctggaccggcgcttccgcagcctggatgacagctgcagccagctgaccagcttcctgtacagcttctgccagcagagccggcggcagaggatcatccagaggaacagaacagagcggctgagtgacctgctggactggaagtacctgggccgctactacatgtctgcccggcacatggccctgagcaaggccttccctgagcacttcacctatgagcccaatgaagcagatgctgcccagggctaccgctaccccaggcctgcctctgtgccccccagccccagcctgagccgccacagcagcccccaccagagtgaagatgaggaggaccccagaaatggccccctggaggaggatggagagagatatgatgaagatgaggaggccgccaaggacagaagaaacatccgggcccctgagtggccccggcgggccagctgcaccagcagcaccagcggcagcaagagaaattctgtggacacagccaccagcagcagcctgagcacccccagcgagcccctgagccccaccagcagcctgggggaggagagaaattag

SEQ ID NO: 154207 - DNA, 1002 bp, Artificial Sequence
  Description of Artificial Sequence: Synthetic coding sequence
atgacagaccaggcctttgtgaccctgaccaccaatgatgcctatgccaagggggccctggtgctgggcagcagcctgaagcagcacaggaccacccggcggctggtggtgctggccaccccccaggtgtctgacagcatgaggaaggtgctggagaccgtgtttgatgaggtgatcatggtggatgtgctggacagcggggacagcgcccacctgaccctgatgaagaggcctgagctgggcgtgaccctgaccaagctgcactgctggagcctgacccagtacagcaaatgtgtgttcatggatgctgacaccctggtgctggccaacattgatgacctgtttgaccgggaggagctgtctgctgccccagaccccggctggccagactgcttcaacagcggcgtgtttgtgtaccagcccagcgtggagacctacaaccagctgctgcacctggccagcgagcagggcagctttgatggaggagaccagggcatcctgaacaccttcttcagctcctgggccaccacagacatcaggaagcacctgcccttcatctacaacctgagcagcatcagcatctacagctacctgcctgccttcaaggtgtttggagccagcgccaaggtggtgcacttcctgggccgggtgaagccctggaactacacctatgaccccaagaccaagtctgtgaagtctgaggcccatgaccccaacatgacccaccctgagttcctgatcctgtggtggaacatcttcaccaccaacgtgctgcccctgctgcagcagtttggcctggtgaaggacacctgcagctatgtgaatgtggaggatgtgtctggggccatcagccacctgagcctgggggagatcccagccatggcccagccctttgtgtcctctgaggagaggaaggagcgctgggagcagggccaggccgactacatgggcgctgacagctttgacaacatcaagaggaagctggacacctacctgcagtag

SEQ ID NO: 154208 - DNA, 1053 bp, Artificial Sequence
  Description of Artificial Sequence: Synthetic coding sequence
atgacagaccaggcctttgtgaccctgaccaccaatgatgcctatgccaagggggccctggtgctgggcagcagcctgaagcagcacaggaccacccggcggctggtggtgctggccaccccccaggtgtctgacagcatgaggaaggtgctggagaccgtgtttgatgaggtgatcatggtggatgtgctggacagcggggacagcgcccacctgaccctgatgaagaggcctgagctgggcgtgaccctgaccaagctgcactgctggagcctgacccagtacagcaaatgtgtgttcatggatgctgacaccctggtgctggccaacattgatgacctgtttgaccgggaggagctgtctgctgccccagaccccggctggccagactgcttcaacagcggcgtgtttgtgtaccagcccagcgtggagacctacaaccagctgctgcacctggccagcgagcagggcagctttgatggaggagaccagggcatcctgaacaccttcttcagctcctgggccaccacagacatcaggaagcacctgcccttcatctacaacctgagcagcatcagcatctacagctacctgcctgccttcaaggtgtttggagccagcgccaaggtggtgcacttcctgggccgggtgaagccctggaactacacctatgaccccaagaccaagtctgtgaagtctgaggcccatgaccccaacatgacccaccctgagttcctgatcctgtggtggaacatcttcaccaccaacgtgctgcccctgctgcagcagtttggcctggtgaaggacacctgcagctatgtgaatgtgctgagtgacctggtgtacaccctggccttcagctgtggcttctgcaggaaggaggatgtgtctggggccatcagccacctgagcctgggggagatcccagccatggcccagccctttgtgagcagcgaggagaggaaggagcgctgggagcagggccaggccgactacatgggcgctgacagctttgacaacatcaagaggaagctggacacctacctgcagtag

SEQ ID NO: 154209 - DNA, 840 bp, Artificial Sequence
  Description of Artificial Sequence: Synthetic coding sequence
atgacagaccaggcctttgtgaccctgaccaccaatgatgcctatgccaagggggccctggtgctgggcagcagcctgaagcagcacaggaccacccggcggctggtggtgctggccaccccccaggtgtctgacagcatgaggaaggtgctggagaccgtgtttgatgaggtgatcatggtggatgtgctggacagcggggacagcgcccacctgaccctgatgaagaggcctgagctgggcgtgaccctgaccaagctgcactgctggagcctgacccagtacagcaaatgtgtgttcatggatgctgacaccctggtgctggccaacattgatgacctgtttgaccgggaggagctgtctgctgccccagaccccggctggccagactgcttcaacagcggcgtgtttgtgtaccagcccagcgtggagacctacaaccagctgctgcacctggccagcgagcagggcagctttgatggaggagaccagggcatcctgaacaccttcttcagctcctgggccaccacagacatcaggaagcacctgcccttcatctacaacctgagcagcatcagcatctacagctacctgcctgccttcaaggtgaagatgagccaggagccctaccacatctgccccctgggccgcagccagctgtggcacagccggctgtaccccaggaagaatggaagaaatgatggcaacagagcccggctcatcatctgggagcagatccccctgaccaccagccggggcaacctgaccctgaccagcagcaggaacacagccttcttctgtgagcacatccacttcaccagcctggtgtctgacacctag

SEQ ID NO: 154210 - DNA, 1398 bp, Artificial Sequence
  Description of Artificial Sequence: Synthetic coding sequence
atgtctgaaacagagttccaccacggggcccaggccggcctggagctgctgcggagcagcaacagccccaccagcgccagccagagcgctggcatgacagtgacagaccaggcctttgtgaccctggccaccaatgacatctactgccagggcgccctggtgctgggccagagcctgcggcggcaccggctgaccaggaagctggtggtgctgatcaccccccaggtgagcagcctgctgcgggtcatcctgagcaaggtgtttgatgaagtcatcgaggtgaacctgattgattctgctgactacatccacctggccttcctgaagaggcctgagctgggcctgaccctgaccaagctgcactgctggaccctgacccactacagcaaatgtgtgttcctggatgctgacaccctggtgctgagcaatgtggatgagctgtttgacagaggagagttctctgctgccccagaccccggctggccagactgcttcaacagcggcgtgtttgtgttccagcccagcctgcacacccacaagctgctgctgcagcacgccatggagcacggcagctttgatggagctgaccagggcctgctgaacagcttcttcaggaactggagcaccacagacatccacaagcacctgcccttcatctacaacctgagcagcaacaccatgtacacctacagccctgccttcaagcagtttggcagcagcgccaaggtggtgcacttcctgggctccatgaagccctggaactacaagtacaacccccagagcggctctgtgctggagcagggcagcgccagcagcagccagcaccaggccgccttcctgcacctgtggtggacagtgtaccagaacaacgtgctgcccctgtacaagtctgtgcaggccggggaggcccgggccagccctggccacaccctgtgccacagtgatgtgggcggcccctgtgccgacagcgccagcggcgtgggggagccctgtgagaacagcaccccatctgctggggtgccctgtgccaacagccccctgggcagcaaccagcctgcccagggcctgcctgagcccacccagatcgtggatgagaccctgagcctgcctgagggcagaagaagtgaggacatgattgcctgcccagagacagagaccccagctgtgatcacctgtgaccccctgagccagcccagcccccagcctgctgacttcacagaaacagagaccatcctggtggacctggccgtgtctgtgtcccagatcagcattgaggagaaggtgaaggagctgagccctgaggaggagaggaggaagtgggaggagggcagaattgactacatgggcaaggatgcctttgcccgcatccaggagaagctggaccgcttcctgcagtag

SEQ ID NO: 154211 - DNA, 1506 bp, Artificial Sequence
  Description of Artificial Sequence: Synthetic coding sequence
atgtctgaaacagagttccaccacggggcccaggccggcctggagctgctgcggagcagcaacagccccaccagcgccagccagagcgctggcatgacagtgacagaccaggcctttgtgaccctggccaccaatgacatctactgccagggcgccctggtgctgggccagagcctgcggcggcaccggctgaccaggaagctggtggtgctgatcaccccccaggtgagcagcctgctgcgggtcatcctgagcaaggtgtttgatgaagtcatcgaggtgaacctgattgattctgctgactacatccacctggccttcctgaagaggcctgagctgggcctgaccctgaccaagctgcactgctggaccctgacccactacagcaaatgtgtgttcctggatgctgacaccctggtgctgagcaatgtggatgagctgtttgacagaggagagttctctgctgccccagaccccggctggccagactgcttcaacagcggcgtgtttgtgttccagcccagcctgcacacccacaagctgctgctgcagcacgccatggagcacggcagctttgatggagctgaccagggcctgctgaacagcttcttcaggaactggagcaccacagacatccacaagcacctgcccttcatctacaacctgagcagcaacaccatgtacacctacagccctgccttcaagcagtttggcagcagcgccaaggtggtgcacttcctgggctccatgaagccctggaactacaagtacaacccccagagcggctctgtgctggagcagggcagcgccagcagcagccagcaccaggccgccttcctgcacctgtggtggacagtgtaccagaacaacgtgctgcccctgtacaagtctgtgcaggccggggaggcccgggccagccctggccacaccctgtgccacagtgatgtgggcggcccctgtgccgacagcgccagcggcgtgggggagccctgtgagaacagcaccccatctgctggggtgccctgtgccaacagccccctgggcagcaaccagcctgcccagggcctgcctgagcccacccagatcgtggatgagaccctgagcctgcctgagggcagaagaagtgaggacatgattgcctgcccagagacagagaccccagctgtgatcacctgtgaccccctgagccagcccagcccccagcctgctgacttcacagaaacagagaccatcctgcagcctgccaacaaggtggagagcgtgtcctctgaggagacctttgagcccagccaggagctgcctgctgaggccctgcgggaccccagcctgcaggatgccctggaggtggacctggccgtgtctgtgtcccagatcagcattgaggagaaggtgaaggagctgagccctgaggaggagaggaggaagtgggaggagggcagaattgactacatgggcaaggatgcctttgcccgcatccaggagaagctggaccgcttcctgcagtag

SEQ ID NO: 154212 - DNA, 1413 bp, Artificial Sequence
  Description of Artificial Sequence: Synthetic coding sequence
atgtctgtgacagaccaggcctttgtgaccctggccaccaatgacatctactgccagggcgccctggtgctgggccagagcctgcggcggcaccggctgaccaggaagctggtggtgctgatcaccccccaggtgagcagcctgctgcgggtcatcctgagcaaggtgtttgatgaggtgattgaggtgaacctgattgacagcgctgactacatccacctggccttcctgaagaggcctgagctgggcctgaccctgaccaagctgcactgctggaccctgacccactacagcaaatgtgtgttcctggatgctgacaccctggtgctgagcaatgtggatgagctgtttgacagaggagagttctctgctgccccagaccccggctggccagactgcttcaacagcggcgtgtttgtgttccagcccagcctgcacacccacaagctgctgctgcagcacgccatggagcacggcagctttgatggagctgaccagggcctgctgaacagcttcttcaggaactggagcaccacagacatccacaagcacctgcccttcatctacaacctgagcagcaacaccatgtacacctacagccctgccttcaagcagtttggcagcagcgccaaggtggtgcacttcctgggctccatgaagccctggaactacaagtacaacccccagagcggctctgtgctggagcagggcagcgccagcagcagccagcaccaggccgccttcctgcacctgtggtggacagtgtaccagaacaacgtgctgcccctgtacaagtctgtgcaggccggggaggcccgggccagccctggccacaccctgtgccacagtgatgtgggcggcccctgtgccgacagcgccagcggcgtgggggagccctgtgagaacagcacccccagcgctggggtgccctgtgccaacagccccctgggcagcaaccagcctgcccagggcctgcctgagcccacccagatcgtggatgagaccctgagcctgcctgagggccgccgctctgaggacatgattgcctgcccagagacagagaccccagctgtgatcacctgtgaccccctgagccagcccagcccccagcctgctgacttcacagaaacagagaccatcctgcagcctgccaacaaggtggagagcgtgagcagcgaggagacctttgagcccagccaggagctgcctgctgaggccctgcgggaccccagcctgcaggatgccctggaggtggacctggccgtgtctgtgtcccagatcagcattgaggagaaggtgaaggagctgagccctgaggaggagaggaggaagtgggaggagggcagaattgactacatgggcaaggatgcctttgcccgcatccaggagaagctggaccgcttcctgcagtag

SEQ ID NO: 154213 - DNA, 417 bp, Artificial Sequence
  Description of Artificial Sequence: Synthetic coding sequence
atgtctgtgacagaccaggcctttgtgaccctggccaccaatgacatctactgccagggcgccctggtgctgggccagagcctgcggcggcaccggctgaccaggaagctggtggtgctgatcaccccccaggtgagcagcctgctgcgggtcatcctgagcaaggtgtttgatgaggtgattgaggtgaacctgattgacagcgctgactacatccacctggccttcctgaagaggcctgagctgggcctgaccctgaccaagctgcactgctggaccctgacccactacagcaaatgtgtgttcctggatgctgacaccctggtgctgagcaatgtggatgagctgtttgacagaggagagttctctgctgccccagaccccggctggccagactgcttcaacagcggcgtgtag

SEQ ID NO: 154214 - DNA, 1293 bp, Artificial Sequence
  Description of Artificial Sequence: Synthetic coding sequence
atgtctgaaacagagttccaccacggggcccaggccggcctggagctgctgcggagcagcaacagccccaccagcgccagccagagcgctggcatgacagtgacagaccaggcctttgtgaccctggccaccaatgacatctactgccagggcgccctggtgctgggccagagcctgcggcggcaccggctgaccaggaagctggtggtgctgatcaccccccaggtgagcagcctgctgcgggtcatcctgagcaaggtgtttgatgaagtcatcgaggtgaacctgattgattctgctgactacatccacctggccttcctgaagaggcctgagctgggcctgaccctgaccaagctgcactgctggaccctgacccactacagcaaatgtgtgttcctggatgctgacaccctggtgctgagcaatgtggatgagctgtttgacagaggagagttctctgctgccccagaccccggctggccagactgcttcaacagcggcgtgtttgtgttccagcccagcctgcacacccacaagctgctgctgcagcacgccatggagcacggcagctttgatggagctgaccagggcctgctgaacagcttcttcaggaactggagcaccacagacatccacaagcacctgcccttcatctacaacctgagcagcaacaccatgtacacctacagccctgccttcaagcagtttggcagcagcgccaaggtggtgcacttcctgggctccatgaagccctggaactacaagtacaacccccagagcggctctgtgctggagcagggcagcgccagcagcagccagcaccaggccgccttcctgcacctgtggtggacagtgtaccagaacaacgtgctgcccctgtacaagtctgtgcaggccggggaggcccgggccagccctggccacaccctgtgccacagtgatgtgggcggcccctgtgccgacagcgccagcggcgtgggggagccctgtgagaacagcaccccatctgctggggtgccctgtgccaacagccccctgggcagcaaccagcctgcccagggcctgcctgagcccacccagatcgtggatgagaccctgagcctgcctgagggcagaagaagtgaagatgtggacctggccgtgtctgtgtcccagatcagcattgaggagaaggtgaaggagctgagccctgaggaggagaggaggaagtgggaggagggcagaattgactacatgggcaaggatgcctttgcccgcatccaggagaagctggaccgcttcctgcagtag

SEQ ID NO: 154215 - DNA, 354 bp, Artificial Sequence
  Description of Artificial Sequence: Synthetic coding sequence
atgtatggcaagatcatctttgtgctgctgctgagtgacacccacaagagggacacctatgctgccaccccccgggcccacgaggtgtctgagatctctgtgaggacagtgtacccacctgaggaggagaccggggagcgggtgcagctggcccaccacttcagcgagcctgagatcaccctcatcatcttcggcgtgatggccggcgtgattggcaccatcctgctgatctcctatggcatccggcggctcatcaagaagagccccagtgatgtgaagcccctgcccagcccagacacagatgtgcccctgagctctgtggagattgagaaccctgagaccagtgaccagtag

SEQ ID NO: 154216 - DNA, 453 bp, Artificial Sequence
  Description of Artificial Sequence: Synthetic coding sequence
atgtatggcaagatcatctttgtgctgctgctgtctgagatcgtgtccatcagcgccctgagcaccacagaggtggccatgcacaccagcaccagcagctctgtgaccaagagctacatcagcagccagaccaatgacacccacaagagggacacctacgccgccaccccccgggcccacgaggtgtctgagatctctgtgaggacagtgtacccacctgaggaggagactggagagcgggtgcagctggcccaccacttcagcgagcctgagatcaccctcatcatctttggagtgatggccggggtcatcggcaccatcctgctgatctcctatggcatcagaagactcatcaagaagagccccagtgatgtgaagcccctgcccagcccagacacagatgtgcccctgagctctgtggagattgaaaatcctgagaccagtgaccagtag

SEQ ID NO: 154217 - DNA, 189 bp, Artificial Sequence
  Description of Artificial Sequence: Synthetic coding sequence
atgtatggcaagatcatctttgtgctgctgctgtctgagatcgtgtccatcagcgccctgagcaccacagaggtggccatgcacaccagcaccagcagctctgtgaccaagagctacatcagcagccagaccaatggagagcgggtgcagctggcccaccacttcagcgagccagacttccacaactag

SEQ ID NO: 154218 - DNA, 357 bp, Artificial Sequence
  Description of Artificial Sequence: Synthetic coding sequence
atgtatggcaagatcatctttgtgctgctgctgtctgagatcgtgtccatcagcgccctgagcaccacagaggtggccatgcacaccagcaccagcagctctgtgaccaagagctacatcagcagccagaccaatggagagcgggtgcagctggcccaccacttcagcgagcctgagatcaccctcatcatctttggagtgatggccggggtcatcggcaccatcctgctgatctcctatggcatcagaagactcatcaagaagagccccagtgatgtgaagcccctgcccagcccagacacagatgtgcccctgagctctgtggagattgaaaatcctgagaccagtgaccagtag

SEQ ID NO: 154219 - DNA, 414 bp, Artificial Sequence
  Description of Artificial Sequence: Synthetic coding sequence
atgtatggcaagatcatctttgtgctgctgctgtctgagatcgtgtccatcagcgccctgagcaccacagaggtggccatgcacaccagcaccagcagctctgtgaccaagagctacatcagcagccagaccaatgacacccacaagagggacacctacgccgccaccccccgggcccacgaggtgtctgagatctctgtgaggacagtgtacccacctgaggaggagacagagatcaccctcatcatcttcggcgtgatggccggcgtgattggcaccatcctgctgatctcctatggcatccggcggctcatcaagaagagccccagtgatgtgaagcccctgcccagcccagacacagatgtgcccctgagctctgtggagattgagaaccctgagaccagtgaccagtag

SEQ ID NO: 154220 - DNA, 258 bp, Artificial Sequence
  Description of Artificial Sequence: Synthetic coding sequence
atgtatggcaagatcatctttgtgctgctgctgagcggggagcgggtgcagctggcccaccacttcagcgagcctgagatcaccctcatcatcttcggcgtgatggccggcgtgattggcaccatcctgctgatctcctatggcatccggcggctcatcaagaagagccccagtgatgtgaagcccctgcccagcccagacacagatgtgcccctgagctctgtggagattgagaaccctgagaccagtgaccagtag

SEQ ID NO: 154221 - DNA, 375 bp, Artificial Sequence
  Description of Artificial Sequence: Synthetic coding sequence
atgcacaccagcaccagcagctctgtgaccaagagctacatcagcagccagaccaatgacacccacaagagggacacctacgccgccaccccccgggcccacgaggtgtctgagatctctgtgaggacagtgtacccacctgaggaggagactggagagcgggtgcagctggcccaccacttcagcgagcctgagatcaccctcatcatctttggagtgatggccggggtcatcggcaccatcctgctgatctcctatggcatcagaagactcatcaagaagagccccagtgatgtgaagcccctgcccagcccagacacagatgtgcccctgagctctgtggagattgaaaatcctgagaccagtgaccagtag

SEQ ID NO: 154222 - DNA, 276 bp, Artificial Sequence
  Description of Artificial Sequence: Synthetic coding sequence
atgtatggcaagatcatctttgtgctgctgctgtctgagatcgtgtccatcagcgccctgagcaccacagaggtggccatgcacaccagcaccagcagctctgtgaccaagagctacatcagcagccagaccaatggagagaccggccagctggtgcaccgcttcaccgtgcctgcccctgtggtgatcatcctgatcatcctgtgtgtgatggccggcatcatcggcaccatcctgctgatctcctacagcatccggcggctcatcaaggcctag

SEQ ID NO: 154223 - DNA, 276 bp, Artificial Sequence; identical to SEQ ID NO: 154222
  Description of Artificial Sequence: Synthetic coding sequence

SEQ ID NO: 154224 - DNA, 177 bp, Artificial Sequence
  Description of Artificial Sequence: Synthetic coding sequence
atgtatggcaagatcatctttgtgctgctgctgagcggggagaccggccagctggtgcaccgcttcaccgtgcctgcccctgtggtgatcatcctgatcatcctgtgtgtgatggccggcatcatcggcaccatcctgctgatctcctacagcatcagaagactcatcaaggcctag

SEQ ID NO: 154225 - DNA, 387 bp, Artificial Sequence
  Description of Artificial Sequence: Synthetic coding sequence
atgtggagcaccaggagccccaacagcacagcctggcccctgagcctggagccagaccccggcatggccagcgccagcaccaccatgcacaccaccaccatcgccgagccagaccccggcatgagcggctggccagatggccgcatggagaccagcacccccaccatcatggacatcgtggtgattgctggggtgattgctgctgtggccatcgtgctggtgtccctgctgtttgtgatgctgcgctacatgtaccgccacaagggcacctaccacaccaatgaggccaagggcacagaatttgctgagagcgcagatgctgccctgcagggcgaccctgccctgcaggatgctggggacagcagcaggaaggagtacttcatctag

SEQ ID NO: 154226 - DNA, 324 bp, Artificial Sequence
  Description of Artificial Sequence: Synthetic coding sequence
atggccagcgccagcaccaccatgcacaccaccaccatcgccgagccagaccccggcatgagcggctggccagatggccgcatggagaccagcacccccaccatcatggacatcgtggtgattgctggggtgattgctgctgtggccatcgtgctggtgtccctgctgtttgtgatgctgcgctacatgtaccgccacaagggcacctaccacaccaatgaggccaagggcacagaatttgctgagagcgcagatgctgccctgcagggcgaccctgccctgcaggatgctggggacagcagcaggaaggagtacttcatctag

SEQ ID NO: 154227 - DNA, 330 bp, Artificial Sequence
  Description of Artificial Sequence: Synthetic coding sequence
atgtggagcaccaggagccccaacagcacagcctggcccctgagcctggagccagaccccggcatgagcggctggccagatggccgcatggagaccagcacccccaccatcatggacatcgtggtgattgctggggtgattgctgctgtggccatcgtgctggtgtccctgctgtttgtgatgctgcgctacatgtaccgccacaagggcacctaccacaccaatgaggccaagggcacagaatttgctgagagcgcagatgctgccctgcagggcgaccctgccctgcaggatgctggggacagcagcaggaaggagtacttcatctag

SEQ ID NO: 154228 - DNA, 237 bp, Artificial Sequence
  Description of Artificial Sequence: Synthetic coding sequence
atgtatggcaagatcatctttgtgctgctgctgagcggcatcgtgtccatcagcgccagcagcaccactggagtggccatgcacaccagcaccagcagctctgtgaccaagagctacatcagcagccagaccaacggcatcaccctcatcaactggtgggccatggcccgggtcatctttgaggtgatgctggtggtggtgggcatgatcatcctgatctcctactgcatcagatag

SEQ ID NO: 154229 - DNA, 168 bp, Artificial Sequence
  Description of Artificial Sequence: Synthetic coding sequence
atgtatggcaagatcatctttgtgctgctgctgagcggcatcgtgtccatcagcgccagcagcaccactggagtggccatgcacaccagcaccagcagctctgtgaccaagagctacatcagcagccagaccaatggagagcggggccagctggtgcaccgcttctag

SEQ ID NO: 154230 - DNA, 237 bp, Artificial Sequence; identical to SEQ ID NO: 154228
  Description of Artificial Sequence: Synthetic coding sequence

SEQ ID NO: 154231 - DNA, 180 bp, Artificial Sequence
  Description of Artificial Sequence: Synthetic coding sequence
atgtatggcaagatcatctttgtgctgctgctgagcggcatcgtgtccatcagcgccagcagcaccactggagtggccatgcacaccagcaccagcagctctgtgaccaagagctacatcagcagccagaccaacggctgtgtgattggcaacatcatctgcagcgacaagagcaagtag

SEQ ID NO: 154232 - DNA, 1605 bp, Artificial Sequence
  Description of Artificial Sequence: Synthetic coding sequence
atgccccacctgatggagaggatggtgggcagcggcctgctgtggctggccctggtgtcctgcatcctgacccaggccagcgctgtgcagaggggctacggcaaccccatcgaggccagcagctatggcctggacctggactgtggggcccctggcaccccagaggcccacgtgtgctttgacccctgccagaactacaccctgctggatgagcccttccgcagcacagaaaattctgctggcagccagggctgtgacaagaacatgagcggctggtacagatttgtgggggagggcggcgtgaggatgtctgagacctgtgtgcaggtgcaccgctgccagacagatgcccccatgtggctgaatggcacccacccagccctgggagatggcatcaccaaccacacagcctgtgcccactggagcggcaactgctgcttctggaagacagaggtgctggtgaaggcctgccctgggggctaccacgtgtaccgcctggagggcaccccctggtgcaacctgcgctactgcacagaccccagcacagtggaggacaagtgtgagaaggcctgcaggcctgaggaggagtgcctggccctgaacagcacctggggctgcttctgccggcaggacctgaacagcagtgatgtgcacagcctgcagccccagctggactgtggcccccgggagatcaaggtgaaggtggacaagtgcctgctgggcggcctgggcctgggggaggaggtgattgcctacctgcgggaccccaactgcagcagcatcctgcagacagaggagaggaactgggtgtctgtgaccagccctgtgcaggccagcgcctgcaggaacatcctggagaggaaccagacccacgccatctacaagaacaccctgagcctggtgaatgacttcatcatccgggacaccatcctgaacatcaacttccagtgtgcctaccccctggacatgaaggtgtccctgcaggccgccctgcagcccatcgtgagcagcctgaatgtgtctgtggatggaaatggagagttcatcgtgaggatggccctcttccaggaccagaactacaccaacccctatgaaggagatgctgtggagctgtctgtggagagcgtgctgtatgtgggcgccatcctggagcagggcgacaccagccgcttcaacctggtgctgaggaactgctacgccacccccacagaggacaaggctgacctggtgaagtacttcatcatccggaacagctgcagcaaccagagggacagcaccatccacgtggaggagaatggccagagcagcgagagccgcttctctgtgcagatgttcatgtttgctggccactatgacctggtgttcctgcactgtgagatccacctgtgtgacagcctgaatgagcagtgccagcccagctgcagccgcagccaggtgcgctctgaggtgcctgccatcgacctggcccgggtgctggacctgggccccatcaccaggagaggagcccagagccctggggtgatgaatggcacccccagcacagctggcttcctggtggcctggcccatggtgctgctgactgtgctgctggcctggctgttctag

SEQ ID NO: 154233 - DNA, 1164 bp, Artificial Sequence
  Description of Artificial Sequence: Synthetic coding sequence
atgccccacctgatggagaggatggtgggcagcggcctgctgtggctggccctggtgtcctgcatcctgacccaggccagcgctgtgcagagggaccccagcacagtggaggacaagtgtgagaaggcctgcaggcctgaggaggagtgcctggccctgaacagcacctggggctgcttctgccggcaggacctgaacagcagtgatgtgcacagcctgcagccccagctggactgtggcccccgggagatcaaggtgaaggtggacaagtgcctgctgggcggcctgggcctgggggaggaggtgattgcctacctgcgggaccccaactgcagcagcatcctgcagacagaggagaggaactgggtgtctgtgaccagccctgtgcaggccagcgcctgcaggaacatcctggagaggaaccagacccacgccatctacaagaacaccctgagcctggtgaatgacttcatcatccgggacaccatcctgaacatcaacttccagtgtgcctaccccctggacatgaaggtgtccctgcaggccgccctgcagcccatcgtgagcagcctgaatgtgtctgtggatggaaatggagagttcatcgtgaggatggccctcttccaggaccagaactacaccaacccctatgaaggagatgctgtggagctgtctgtggagagcgtgctgtatgtgggcgccatcctggagcagggcgacaccagccgcttcaacctggtgctgaggaactgctacgccacccccacagaggacaaggctgacctggtgaagtacttcatcatccggaacagctgcagcaaccagagggacagcaccatccacgtggaggagaatggccagagcagcgagagccgcttctctgtgcagatgttcatgtttgctggccactatgacctggtgttcctgcactgtgagatccacctgtgtgacagcctgaatgagcagtgccagcccagctgcagccgcagccaggtgcgctctgaggtgcctgccatcgacctggcccgggtgctggacctgggccccatcacccggcggggggcccagagccctggggtgatgaatggcacccccagcacagctggcttcctggtggcctggcccatggtgctgctgactgtgctgctggcctggctgttctag

SEQ ID NO: 154234 - DNA, 1173 bp, Artificial Sequence
  Description of Artificial Sequence: Synthetic coding sequence
atgccccacctgatggagaggatggtgggcagcggcctgctgtggctggccctggtgtcctgcatcctgacccaggccagcgctgtgcagagggtgccccgggaccccagcacagtggaggacaagtgtgagaaggcctgcaggcctgaggaggagtgcctggccctgaacagcacctggggctgcttctgccggcaggacctgaacagcagtgatgtgcacagcctgcagccccagctggactgtggcccccgggagatcaaggtgaaggtggacaagtgcctgctgggcggcctgggcctgggggaggaggtgattgcctacctgcgggaccccaactgcagcagcatcctgcagacagaggagaggaactgggtgtctgtgaccagccctgtgcaggccagcgcctgcaggaacatcctggagaggaaccagacccacgccatctacaagaacaccctgagcctggtgaatgacttcatcatccgggacaccatcctgaacatcaacttccagtgtgcctaccccctggacatgaaggtgtccctgcaggccgccctgcagcccatcgtgagcagcctgaatgtgtctgtggatggaaatggagagttcatcgtgaggatggccctcttccaggaccagaactacaccaacccctatgaaggagatgctgtggagctgtctgtggagagcgtgctgtatgtgggcgccatcctggagcagggcgacaccagccgcttcaacctggtgctgaggaactgctacgccacccccacagaggacaaggctgacctggtgaagtacttcatcatccggaacagctgcagcaaccagagggacagcaccatccacgtggaggagaatggccagagcagcgagagccgcttctctgtgcagatgttcatgtttgctggccactatgacctggtgttcctgcactgtgagatccacctgtgtgacagcctgaatgagcagtgccagcccagctgcagccgcagccaggtgcgctctgaggtgcctgccatcgacctggcccgggtgctggacctgggccccatcaccaggagaggagcccagagccctggggtgatgaatggcacccccagcacagctggcttcctggtggcctggcccatggtgctgctgactgtgctgctggcctggctgttctag

SEQ ID NO: 154235 - DNA, 1614 bp, Artificial Sequence
  Description of Artificial Sequence: Synthetic coding sequence
atgccccacctgatggagaggatggtgggcagcggcctgctgtggctggccctggtgtcctgcatcctgacccaggccagcgctgtgcagaggggctacggcaaccccatcgaggccagcagctatggcctggacctggactgtggggcccctggcaccccagaggcccacgtgtgctttgacccctgccagaactacaccctgctggatgagcccttccgcagcacagaaaattctgctggcagccagggctgtgacaagaacatgagcggctggtacagatttgtgggggagggcggcgtgaggatgtctgagacctgtgtgcaggtgcaccgctgccagacagatgcccccatgtggctgaatggcacccacccagccctgggagatggcatcaccaaccacacagcctgtgcccactggagcggcaactgctgcttctggaagacagaggtgctggtgaaggcctgccctgggggctaccacgtgtaccgcctggagggcaccccctggtgcaacctgcgctactgcaccgtgccccgggaccccagcacagtggaggacaagtgtgagaaggcctgcaggcctgaggaggagtgcctggccctgaacagcacctggggctgcttctgccggcaggacctgaacagcagtgatgtgcacagcctgcagccccagctggactgtggcccccgggagatcaaggtgaaggtggacaagtgcctgctgggcggcctgggcctgggggaggaggtgattgcctacctgcgggaccccaactgcagcagcatcctgcagacagaggagaggaactgggtgtctgtgaccagccctgtgcaggccagcgcctgcaggaacatcctggagaggaaccagacccacgccatctacaagaacaccctgagcctggtgaatgacttcatcatccgggacaccatcctgaacatcaacttccagtgtgcctaccccctggacatgaaggtgtccctgcaggccgccctgcagcccatcgtgagcagcctgaatgtgtctgtggatggaaatggagagttcatcgtgaggatggccctcttccaggaccagaactacaccaacccctatgaaggagatgctgtggagctgtctgtggagagcgtgctgtatgtgggcgccatcctggagcagggcgacaccagccgcttcaacctggtgctgaggaactgctacgccacccccacagaggacaaggctgacctggtgaagtacttcatcatccggaacagctgcagcaaccagagggacagcaccatccacgtggaggagaatggccagagcagcgagagccgcttctctgtgcagatgttcatgtttgctggccactatgacctggtgttcctgcactgtgagatccacctgtgtgacagcctgaatgagcagtgccagcccagctgcagccgcagccaggtgcgctctgaggtgcctgccatcgacctggcccgggtgctggacctgggccccatcacccggcggggggcccagagccctggggtgatgaatggcacccccagcacagctggcttcctggtggcctggcccatggtgctgctgactgtgctgctggcctggctgttctag

SEQ ID NO: 154236 - DNA, 1548 bp, Artificial Sequence
  Description of Artificial Sequence: Synthetic coding sequence
atgaagatcaagtgtgagaagagcaggacccagagcagcgcccagcacgtgcagcacagcgcccacagcaccatcgtgtgcaggaagcacagccacaatgctgagacagctggccgggtggacatcgtgcggggcggccccttcttccaccaccccctgaggaagtggctgatcagcccccccctgaacaagcccagcgtgtggcccaggacccccatcatccctgtgcaccagctgcggcgggacacctgggtgggcaactgcaacaagaagacagcccacagccggctgcacagccacggctggccagaggaggagagatttgtgttcagcagcgagctgcacggcaagagcgcctacagcaaggtgacctgcatgccccacctgatggagaggatggtgggcagcggcctgctgtggctggccctggtgtcctgcatcctgacccaggccagcgctgtgcagagggaccacctggaccccagcacagtggaggacaagtgtgagaaggcctgcaggcctgaggaggagtgcctggccctgaacagcacctggggctgcttctgccggcaggacctgaacagcagtgatgtgcacagcctgcagccccagctggactgtggcccccgggagatcaaggtgaaggtggacaagtgcctgctgggcggcctgggcctgggggaggaggtgattgcctacctgcgggaccccaactgcagcagcatcctgcagacagaggagaggaactgggtgtctgtgaccagccctgtgcaggccagcgcctgcaggaacatcctggagaggaaccagacccacgccatctacaagaacaccctgagcctggtgaatgacttcatcatccgggacaccatcctgaacatcaacttccagtgtgcctaccccctggacatgaaggtgtccctgcaggccgccctgcagcccatcgtgagcagcctgaatgtgtctgtggatggaaatggagagttcatcgtgaggatggccctcttccaggaccagaactacaccaacccctatgaaggagatgctgtggagctgtctgtggagagcgtgctgtatgtgggcgccatcctggagcagggcgacaccagccgcttcaacctggtgctgaggaactgctacgccacccccacagaggacaaggctgacctggtgaagtacttcatcatccggaacagctgcagcaaccagagggacagcaccatccacgtggaggagaatggccagagcagcgagagccgcttctctgtgcagatgttcatgtttgctggccactatgacctggtgttcctgcactgtgagatccacctgtgtgacagcctgaatgagcagtgccagcccagctgcagccgcagccaggtgcgctctgaggtgcctgccatcgacctggcccgggtgctggacctgggccccatcacccggcggggggcccagagccctggggtgatgaatggcacccccagcacagctggcttcctggtggcctggcccatggtgctgctgactgtgctgctggcctggctgttctag

SEQ ID NO: 154237 - DNA, 1959 bp, Artificial Sequence
  Description of Artificial Sequence: Synthetic coding sequence
atgcccctgctgctgctgctgctgctgctgcccagccccctgcacccccaccccatctgtgaggtgtccaaggtggccagccacctggaggtgaactgtgacaagaggaacctgacagccctgcccccagacctgcccaaggacaccaccatcctgcacctgtctgagaacctgctgtacaccttcagcctggccaccctgatgccctacacccggctgacccagctgaacctggacagatgtgagctgaccaagctgcaggtggatggcaccctgcctgtgctgggcaccctggacctgagccacaaccagctgcagagcctgcccctgctgggccagaccctgcctgccctgactgtgctggatgtgtccttcaaccggctgaccagcctgcccctgggcgccctgcggggcctgggggagctgcaggagctgtacctgaagggaaatgagctgaagaccctgcccccaggcctgctgacccccacccccaagctggagaagctgagcctggccaacaacaacctgacagagctgcctgctggcctgctgaatggcctggagaacctggacaccctgctgctgcaggagaacagcctgtacaccatccccaagggcttcttcggcagccacctgctgccctttgccttcctgcacggcaacccctggctgtgcaactgtgagatcctgtacttccgccgctggctgcaggacaatgcagaaaatgtgtatgtgtggaagcagggcgtggatgtgaaggccatgaccagcaatgtggcctctgtgcagtgtgacaacagcgacaagtttcctgtgtacaagtacccaggcaagggctgccccaccctgggagatgaaggagacacagacctgtatgactactacccagaggaggacacagaaggagacaaggtgcgggccaccaggacagtggtgaagttccccaccaaggcccacaccaccccctggggcctcttctacagctggagcacagccagcctggacagccagatgcccagcagcctgcaccccacccaggagagcaccaaggagcagaccaccttccccccacgctggacccccaacttcaccctgcacatggagagcatcaccttcagcaagacccccaagagcaccacagagcccacccccagccccaccaccagcgagcctgtgcctgagcccgcccccaacatgaccaccctggagcccacccccagccccaccaccccagagcccaccagcgagcccgcccccagccccaccaccccagagcccaccagcgagcccgcccccagccccaccaccccagagcccaccagcgagcccgcccccagccccaccaccccagagcccacccccatccccaccatcgccaccagccccaccatcctggtgtctgccaccagcctcatcacccccaagagcaccttcctgaccaccaccaagcctgtgtccctgctggagagcaccaagaagaccatccctgagctggaccagccccccaagctgcggggcgtgctgcagggccacctggagagcagcagaaatgaccccttcctgcacccagacttctgctgcctgctgcccctgggcttctacgtgctgggcctcttctggctgctgtttgcctctgtggtgctgatcctgctgctgtcctgggtgggccacgtgaagccccaggccctggacagcggccagggcgccgccctgaccacagccacccagaccacccacctggagctgcagaggggccggcaggtgacagtgccccgggcctggctgctcttcctgcggggcagcctgcccaccttccgcagcagcctcttcctgtgggtgcggcccaacggccgggtgggccccctggtggccggccggcggcccagcgccctgagccagggccggggccaggacctgctgagcacagtgtccatccgctacagcggccacagcctgtag

SEQ ID NO: 154238 - DNA, 1881 bp, Artificial Sequence
  Description of Artificial Sequence: Synthetic coding sequence
atgcccctgctgctgctgctgctgctgctgcccagccccctgcacccccaccccatctgtgaggtgtccaaggtggccagccacctggaggtgaactgtgacaagaggaacctgacagccctgcccccagacctgcccaaggacaccaccatcctgcacctgtctgagaacctgctgtacaccttcagcctggccaccctgatgccctacacccggctgacccagctgaacctggacagatgtgagctgaccaagctgcaggtggatggcaccctgcctgtgctgggcaccctggacctgagccacaaccagctgcagagcctgcccctgctgggccagaccctgcctgccctgactgtgctggatgtgtccttcaaccggctgaccagcctgcccctgggcgccctgcggggcctgggggagctgcaggagctgtacctgaagggaaatgagctgaagaccctgcccccaggcctgctgacccccacccccaagctggagaagctgagcctggccaacaacaacctgacagagctgcctgctggcctgctgaatggcctggagaacctggacaccctgctgctgcaggagaacagcctgtacaccatccccaagggcttcttcggcagccacctgctgccctttgccttcctgcacggcaacccctggctgtgcaactgtgagatcctgtacttccgccgctggctgcaggacaatgcagaaaatgtgtatgtgtggaagcagggcgtggatgtgaaggccatgaccagcaatgtggcctctgtgcagtgtgacaacagcgacaagtttcctgtgtacaagtacccaggcaagggctgccccaccctgggagatgaaggagacacagacctgtatgactactacccagaggaggacacagaaggagacaaggtgcgggccaccaggacagtggtgaagttccccaccaaggcccacaccaccccctggggcctcttctacagctggagcacagccagcctggacagccagatgcccagcagcctgcaccccacccaggagagcaccaaggagcagaccaccttccccccacgctggacccccaacttcaccctgcacatggagagcatcaccttcagcaagacccccaagagcaccacagagcccacccccagccccaccaccagcgagcctgtgcctgagcccgcccccaacatgaccaccctggagcccacccccagccccaccaccccagagcccaccagcgagcccgcccccagccccaccaccccagagcccacccccatccccaccatcgccaccagccccaccatcctggtgtctgccaccagcctcatcacccccaagagcaccttcctgaccaccaccaagcctgtgtccctgctggagagcaccaagaagaccatccctgagctggaccagccccccaagctgcggggcgtgctgcagggccacctggagagcagcagaaatgaccccttcctgcacccagacttctgctgcctgctgcccctgggcttctacgtgctgggcctcttctggctgctgtttgcctctgtggtgctgatcctgctgctgtcctgggtgggccacgtgaagccccaggccctggacagcggccagggcgccgccctgaccacagccacccagaccacccacctggagctgcagaggggccggcaggtgacagtgccccgggcctggctgctcttcctgcggggcagcctgcccaccttccgcagcagcctcttcctgtgggtgcggcccaacggccgggtgggccccctggtggccggccggcggcccagcgccctgagccagggccggggccaggacctgctgagcacagtgtccatccgctacagcggccacagcctgtag

SEQ ID NO: 154239 - DNA, 621 bp, Artificial Sequence
  Description of Artificial Sequence: Synthetic coding sequence
atgggcagcggccccaggggggccctgagcctgctgctgctgctgctggccccacccagcaggcctgctgctggctgcccagccccctgcagctgtgccggcaccctggtggactgtggcagaagaggcctgacctgggccagcctgcccacagccttccctgtggacaccacagagctggtgctgactggaaacaacctgacagccctgcccccaggcctgctggatgccctgcctgccctgaggacagcccacctgggcgccaacccctggaggtgtgactgccgcctggtgcccctgcgggcctggctggccggccggcctgagcgggccccctacagagacctgcgctgtgtggcccccccagccctgcggggccgcctgctgccctacctggccgaggatgagctgcgggccgcctgtgcccctggccccctgtgctggggcgccctggccgcccagctggccctgctgggcctgggcctgctgcacgccctgctgctggtgctgctgctgtgccgcctgcggcggctgcgggcccgggcccgggcccgggctgctgcccggctgagcctgacagaccccctggtggccgagagagctggaacagatgagagctag

SEQ ID NO: 154240 - DNA, 1230 bp, Artificial Sequence
  Description of Artificial Sequence: Synthetic coding sequence
atgatccccagccgccacaccatgctgcgcttcctgcctgtgaatgctgccagctgccctggggacaggaggaccatgctggtgaatgtggccgccggcgtgcgggtgctgcgggtgcccctgcgggccggcggcagcggcagcctgagcggcctgcggcccccagccatcgtgtgctacctgcccctgcagagggccagcgccagcggcctcttcctggcccggccccagcactgcggccgctgtggccggggccggggcggggccgccctgagcctgggcagccctgcctatgccagccgctgccgggtgtccagagctgctgtgttcagcccctgggcccctgtgtccctggagagcggccgggcccctggctgcagcctgggccggcccggcctgcggggggccctggtggtgtggctgcagctgggggagacctgggtgcggctgcggggggacttccagcctgcctgtggggtggtgcgggtggagcggctggccggctacagagatgctggccaccagggcctggatggagctggccctgctgtgtgggtgctgagagatgtggcccaggtgcctgctgacagaagtgcctactgtggggccagcctggccggccccaggggggccctgagcctgctgctgctgctgctggccccacccagcaggcctgctgctggctgcccagccccctgcagctgtgccggcaccctggtggactgtggccggcggggcctgacctgggccagcctgcccacagccttccctgtggacaccacagagctggtgctgaccggcaacaacctgacagccctgcccccaggcctgctggatgccctgcctgccctgaggacagcccacctgggcgccaacccctggaggtgtgactgccgcctggtgcccctgcgggcctggctggccggccggcctgagcgggccccctacagagacctgcgctgtgtggcccccccagccctgcggggccgcctgctgccctacctggctgaagatgagctgcgggccgcctgtgcccctggccccctgtgctggggcgccctggccgcccagctggccctgctgggcctgggcctgctgcacgccctgctgctggtgctgctgctgtgccgcctgcggcggctgcgggcccgggcccgggcccgggccgccgcccggctgagcctgacagaccccctggtggccgagcgggccggcacagatgagagctag

SEQ ID NO: 154241 - DNA, 534 bp, Artificial Sequence
  Description of Artificial Sequence: Synthetic coding sequence
atgcctgcctggggcgccctcttcctgctgtgggccacagctgaggccaccaaggactgccccagcccctgcacctgccgggccctggagaccatgggcctgtgggtggactgccggggccacggcctgacagccctgcctgccctgcctgcccggaccaggcacctgctgctggccaacaacagcctgcagagcgtgcccccaggggcctttgaccacctgccccagctgcagaccctggatgtgacccagaacccctggcactgtgactgcagcctgacctacctgcggctgtggctggaggacaggaccccagaggccctgctgcaggtgcgctgtgccagccccagcctggccgcccacggccccctgggccgcctgaccggctaccagctgggcagctgtggctggcagctgcaggcctcctgggtgcggcctggggtgctgtgggatgtggccctggtggccgtggccgccctgggcctggccctgctggccggcctgctgtgtgccaccacagaggccctggactag

SEQ ID NO: 154242 - DNA, 987 bp, Artificial Sequence
  Description of Artificial Sequence: Synthetic coding sequence
atgaagccagccatggagacagctgctgaagaaaatacagagcagagccaggagaggaaggtgaacagcagagctgagatggagatcggccgctaccactggatgtacccaggcagcaagaaccaccagtaccaccctgtgcccaccctgggggaccgggccagccccctgagcagccctggctgctttgagtgctgcatcaagtgcctgggcggcgtgccctatgccagcctggtggccaccatcctgtgcttcagcggcgtggccctcttctgtggctgcggccacgtggccctggccggcaccgtggccatcctggagcagcacttcagcaccaatgccagtgaccacgccctgctgtctgaggtgatccagctgatgcagtatgtgatctacggcatcgccagcttcttcttcctgtatggcatcatcctgctggccgagggcttctacaccaccagcgctgtgaaggagctgcacggggagttcaagaccacagcctgtggccgctgcatcagcggcatgtttgtgttcctgacctacgtgctgggcgtggcctggctgggcgtgtttggcttctctgctgtgcctgtgttcatgttctacaacatctggagcacctgtgaggtgatcaagagcccccagaccaacggcaccaccggggtggagcagatctgtgtggacatccggcagtatggcatcatcccctggaatgccttccctgggaagatctgtggcagcgccctggagaacatctgcaacaccaatgagttctacatgagctaccacctgttcatcgtggcctgtgccggggccggggccaccgtgattgccctgatccacttcctgatgatcctgagcagcaactgggcctacctgaaggatgccagcaagatgcaggcctaccaggacatcaaggccaaggaggagcaggagctgcaggacatccagagccgcagcaaggagcagctgaacagctacacctag

SEQ ID NO: 154243 - DNA, 918 bp, Artificial Sequence
  Description of Artificial Sequence: Synthetic coding sequence
atgaagccagccatggagacagctgctgaagaaaatacagagcagagccaggagaggaaggtgaacagcagagctgagatggagatcggccgctaccactggatgtacccaggcagcaagaaccaccagtaccaccctgtgcccaccctgggggaccgggccagccccctgagcagccctggctgctttgagtgctgcatcaagtgcctgggcggcgtgccctatgccagcctggtggccaccatcctgtgcttcagcggcgtggccctcttctgtggctgcggccacgtggccctggccggcaccgtggccatcctggagcagcacttcagcaccaatgccagtgaccacgccctgctgtctgaggtgatccagctgatgcagtatgtgatctacggcatcgccagcttcttcttcctgtatggcatcatcctgctggccgagggcttctacaccaccagcgctgtgaaggagctgcacggggagttcaagaccacagcctgtggccgctgcatcagcggcatgtttgtgttcctgacctacgtgctgggcgtggcctggctgggcgtgtttggcttctctgctgtgcctgtgttcatgttctacaacatctggagcacctgtgaggtgatcaagagcccccagaccaacggcaccaccggggtggagcagatctgtgtggacatccggcagtatggcatcatcccctggaatgccttccctgggaagatctgtggcagcgccctggagaacatctgcaacaccaatgagttctacatgagctaccacctgttcatcgtggcctgtgccggggccggggccaccgtgattgccctgctgatctacatgatggccaccacctacaactatgctgtgctgaagttcaagagccgggaggactgctgcaccaagttctag

SEQ ID NO: 154244 - DNA, 798 bp, Artificial Sequence
  Description of Artificial Sequence: Synthetic coding sequence
atgaagccagccatggagacagctgctgaagaaaatacagagcagagccaggagaggaagggctgctttgagtgctgcatcaagtgcctgggcggcgtgccctatgccagcctggtggccaccatcctgtgcttcagcggcgtggccctcttctgtggctgcggccacgtggccctggccggcaccgtggccatcctggagcagcacttcagcaccaatgccagtgaccacgccctgctgtctgaggtgatccagctgatgcagtatgtgatctacggcatcgccagcttcttcttcctgtatggcatcatcctgctggccgagggcttctacaccaccagcgctgtgaaggagctgcacggggagttcaagaccacagcctgtggccgctgcatcagcggcatgtttgtgttcctgacctacgtgctgggcgtggcctggctgggcgtgtttggcttctctgctgtgcctgtgttcatgttctacaacatctggagcacctgtgaggtgatcaagagcccccagaccaacggcaccaccggggtggagcagatctgtgtggacatccggcagtatggcatcatcccctggaatgccttccctgggaagatctgtggcagcgccctggagaacatctgcaacaccaatgagttctacatgagctaccacctgttcatcgtggcctgtgccggggccggggccaccgtgattgccctgctgatctacatgatggccaccacctacaactatgctgtgctgaagttcaagagccgggaggactgctgcaccaagttctag

SEQ ID NO: 154245 - DNA, 540 bp, Artificial Sequence
  Description of Artificial Sequence: Synthetic coding sequence
atgcagtatgtgatctacggcatcgccagcttcttcttcctgtatggcatcatcctgctggccgagggcttctacaccaccagcgctgtgaaggagctgcacggggagttcaagaccacagcctgtggccgctgcatcagcggcatgtttgtgttcctgacctacgtgctgggcgtggcctggctgggcgtgtttggcttctctgctgtgcctgtgttcatgttctacaacatctggagcacctgtgaggtgatcaagagcccccagaccaacggcaccaccggggtggagcagatctgtgtggacatccggcagtatggcatcatcccctggaatgccttccctgggaagatctgtggcagcgccctggagaacatctgcaacaccaatgagttctacatgagctaccacctgttcatcgtggcctgtgccggggccggggccaccgtgattgccctgctgatctacatgatggccaccacctacaactatgctgtgctgaagttcaagagccgggaggactgctgcaccaagttctag

SEQ ID NO: 154246 - DNA, 741 bp, Artificial Sequence
  Description of Artificial Sequence: Synthetic coding sequence
atgggctgctttgagtgctgcatcaagtgcctgggcggcgtgccctatgccagcctggtggccaccatcctgtgcttctctggagtggccctcttctgtggctgcggccacgtggccctggccggcaccgtggccatcctggagcagcacttcagcaccaatgccagtgaccacgccctgctgtctgaggtgatccagctgatgcagtatgtgatctatggaattgccagcttcttcttcctgtatggcatcatcctgctggccgagggcttctacaccaccagcgctgtgaaggagctgcatggagagttcaagaccacagcctgtggccgctgcatcagcggcatgtttgtgttcctgacctacgtgctgggcgtggcctggctgggcgtgtttggcttctctgctgtgcctgtgttcatgttctacaacatctggagcacctgtgaggtgatcaagagcccccagaccaacggcaccactggagtggagcagatctgtgtggacatccggcagtatggcatcatcccctggaatgccttccctgggaagatctgtggcagcgccctggagaacatctgcaacaccaatgagttctacatgagctaccacctgttcatcgtggcctgtgccggggccggggccaccgtcatcgccctgctgatctacatgatggccaccacctacaactatgctgtgctgaagttcaagagccgggaggactgctgcaccaagttctag

SEQ ID NO: 154247 - DNA, 324 bp, Artificial Sequence
  Description of Artificial Sequence: Synthetic coding sequence
atgaagccagccatggagacagctgctgaagaaaatacagagcagagccaggagaggaagggctgctttgagtgctgcatcaagtgcctgggcggcgtgccctatgccagcctggtggccaccatcctgtgcttcagcggcgtggccctcttctgtggctgcggccacgtggccctggccggcaccgtggccatcctggagcagcacttcagcaccaatgccagtgaccacgccctgctgtctgaggtgatccagctgatgcagtatgtgatctacggcatcgccagcttcttcttcctgtatggcatcatcctgctggcctag

SEQ ID NO: 154248 - DNA, 909 bp, Artificial Sequence
  Description of Artificial Sequence: Synthetic coding sequence
atggagatcggccgctaccactggatgtacccaggcagcaagaaccaccagtaccaccctgtgcccaccctgggggaccgggccagccccctgagcagccctggctgctttgagtgctgcatcaagtgcctgggcggcgtgccctatgccagcctggtggccaccatcctgtgcttcagcggcgtggccctcttctgtggctgcggccacgtggccctggccggcaccgtggccatcctggagcagcacttcagcaccaatgccagtgaccacgccctgctgtctgaggtgatccagctgatgcagtatgtgatctacggcatcgccagcttcttcttcctgtatggcatcatcctgctggccgagggcttctacaccaccagcgctgtgaaggagctgcacggggagttcaagaccacagcctgtggccgctgcatcagcggcatgtttgtgttcctgacctacgtgctgggcgtggcctggctgggcgtgtttggcttctctgctgtgcctgtgttcatgttctacaacatctggagcacctgtgaggtgatcaagagcccccagaccaacggcaccaccggggtggagcagatctgtgtggacatccggcagtatggcatcatcccctggaatgccttccctgggaagatctgtggcagcgccctggagaacatctgcaacaccaatgagttctacatgagctaccacctgttcatcgtggcctgtgccggggccggggccaccgtgattgccctgatccacttcctgatgatcctgagcagcaactgggcctacctgaaggatgccagcaagatgcaggcctaccaggacatcaaggccaaggaggagcaggagctgcaggacatccagagccgcagcaaggagcagctgaacagctacacctag

SEQ ID NO: 154249 - DNA, 1863 bp, Artificial Sequence
  Description of Artificial Sequence: Synthetic coding sequence
atgagccccagccccacagccctcttctgcctgggcctgtgcctgggccgggtgcctgcccagagcggccccctgcccaagcccagcctgcaggccctgcccagcagcctggtgcccctggagaagcctgtgaccctgcgctgccagggccccccaggagtggacctgtaccgcctggagaagctgagcagcagccgctaccaggaccaggccgtgctcttcatcccagccatgaagaggagcctggccggccgctaccgctgcagctaccagaatggcagcctgtggagcctgcccagcgaccagctggagctggtggccaccggggtgtttgccaagcccagcctgagcgcccagcccggccctgctgtgtcctctggaggagatgtgaccctgcagtgccagaccaggtatggctttgaccagtttgccctgtacaaggagggggaccctgccccctacaagaaccctgagcgctggtaccgggccagcttccccatcatcaccgtgacagctgcccacagcggcacctaccgctgctacagcttcagcagccgggacccctacctgtggagcgcccccagcgaccccctggagctggtggtgacaggcacctctgtgacccccagccggctgcccacagagccccccagccctgtggccgagttcagcgaggccacagctgagctgactgtgtccttcaccaatgaggtgttcaccacagagaccagccgcagcatcacagccagccccaaggagagtgacagccctgctggggagagctgcccccctgtgctgcaccagggccagcccggccctgacatgccccggggctgtgaccccaacaaccctgggggcgtgtctggccggggcctggcccagcctgaggaggccccagctgcccagggccagggctgtgccgaggccgccagcgcccccccagcccccccagctgaccctgagatcaagaggggcagcggctggaggcccaccggctgcagccagccccgggtgatgttcatgacagctgagccccaggcccggagctacccccgggagggctcctggcatggaagaaggctgaaggactggagggtgtggagcgtggaggccggcggccagaggctgcagctgtggaagaggggccacgccgccagctcctggtgcagcatccgggagcccttcggccagtgcctgtctgtgtgcctgcccctgtgcctgcgggcccccagcatctgggatggcaggaacctgtggaggccccaccccccaccctgcaccctgtggatgacctggtacccaggctggaccacctactggcccctgagcagcaccagcctcatctgggccccagatggcagcctgcgcttccctgccctgcgggtggacagcgtgcccagctctgtgcagaacccccctgtgctgcccttcggccccctgtgcagctgcctggtgttccccaggaacagccacccccacagcatcagccactgcggcctgaccaacctgctgagcagcctgaggacaggcctggccggcagcctgggcatgtccttcatcttcctgtctgtgaagctggcccgctgccccctgcccttcaccctggagaacaagatcagcctgtgcaacatggtgaagccccacctgtaccagcagaacaagaagacccagaagctggcccgctgtggcggggccagcctgtacagccagcagctgcggggcctgcgctgggagaatggcctgagcctgggcggccggggctgcagcgagctgcggagccaccactgcaccctggcccgggtgaccaagccagactttgtgtccaagaacacaggcatgaacatgagcatcaccctcatctag

SEQ ID NO: 154250 - DNA, 966 bp, Artificial Sequence
  Description of Artificial Sequence: Synthetic coding sequence
atgagccccagccccacagccctcttctgcctgggcctgtgcctgggccgggtgcctgcccagagcggccccctgcccaagcccagcctgcaggccctgcccagcagcctggtgcccctggagaagcctgtgaccctgcgctgccagggccccccaggagtggacctgtaccgcctggagaagctgagcagcagccgctaccaggaccaggccgtgctcttcatcccagccatgaagaggagcctggccggccgctaccgctgcagctaccagaatggcagcctgtggagcctgcccagcgaccagctggagctggtggccaccggggtgtttgccaagcccagcctgagcgcccagcccggccctgctgtgtcctctggaggagatgtgaccctgcagtgccagaccaggtatggctttgaccagtttgccctgtacaaggagggggaccctgccccctacaagaaccctgagcgctggtaccgggccagcttccccatcatcaccgtgacagctgcccacagcggcacctaccgctgctacagcttcagcagccgggacccctacctgtggagcgcccccagcgaccccctggagctggtggtgacagagttcagcgaggccacagctgagctgactgtgtccttcaccaatgaggtgttcaccacagagaccagccgcagcatcacagccagccccaaggagagtgacagccctgctggccctgcccggcagtactacaccaagggcaacctggtgcgcatctgcctgggcgctgtgatcctgatcatcctggccggcttcctggccgaggactggcacagcaggaggaagaggctgcggcaccggggccgggctgtgcagaggcccctgccccccctgccccccctgcccctgaccaggaagagcaatggaggccaggacggcggccggcaggatgtgcacagccggggcctgtgcagctag

SEQ ID NO: 154251 - DNA, 1020 bp, Artificial Sequence
  Description of Artificial Sequence: Synthetic coding sequence
atgagccccagccccacagccctcttctgcctgggcctgtgcctgggccgggtgcctgcccagagcggccccctgcccaagcccagcctgcaggccctgcccagcagcctggtgcccctggagaagcctgtgaccctgcgctgccagggccccccaggagtggacctgtaccgcctggagaagctgagcagcagccgctaccaggaccaggccgtgctcttcatcccagccatgaagaggagcctggccggccgctaccgctgcagctaccagaatggcagcctgtggagcctgcccagcgaccagctggagctggtggccaccggggtgtttgccaagcccagcctgagcgcccagcccggccctgctgtgtcctctggaggagatgtgaccctgcagtgccagaccaggtatggctttgaccagtttgccctgtacaaggagggggaccctgccccctacaagaaccctgagcgctggtaccgggccagcttccccatcatcaccgtgacagctgcccacagcggcacctaccgctgctacagcttcagcagccgggacccctacctgtggagcgcccccagcgaccccctggagctggtggtgacaggcacctctgtgacccccagccggctgcccacagagccccccagccctgtggccgagttcagcgaggccacagctgagctgactgtgtccttcaccaatgaggtgttcaccacagagaccagccgcagcatcacagccagccccaaggagagtgacagccctgctggccctgcccggcagtactacaccaagggcaacctggtgcgcatctgcctgggcgctgtgatcctgatcatcctggccggcttcctggccgaggactggcacagcaggaggaagaggctgcggcaccggggccgggctgtgcagaggcccctgccccccctgccccccctgcccctgaccaggaagagcaatggaggccaggacggcggccggcaggatgtgcacagccggggcctgtgcagctag

SEQ ID NO: 154252 - DNA, 1866 bp, Artificial Sequence
  Description of Artificial Sequence: Synthetic coding sequence
atgggcctgctgagtgaccctgtgagaagaagagccctggcccggctggtgctgcggctgaatgcccccctgtgtgtgctgtcctatgtggccggcatcgcctggttcctggccctggtgttcccccccctgacccagaggacctacatgtctgaaaatgccatgggcagcaccatggtggaggagcagtttgctggaggagaccgggcccgggcctttgcccgggactttgctgcccacaggaagaagagcggggccctgcctgtggcctggctggagaggaccatgaggtctgtgggcctggaggtgtacacccagagcttcagcaggaagctgcccttcccagatgagacccatgagcgctacatggtgtctggcaccaacgtgtatggcatcctgcgggccccccgggccgccagcacagagagcctggtgctgactgtgccctgtggcagtgacagcaccaacagccaggccgtgggcctgctgctggccctggccgcccacttccggggccagatctactgggccaaggacatcgtgttcctggtgacagaacatgacctgctgggcacagaggcctggctggaggcctaccatgatgtgaatgtgacaggcatgcagagcagccccctgcagggccgggccggggccatccaggccgctgtggccctggagctgagcagtgatgtggtgaccagcctggatgtggccgtggagggcctgaatggccagctgcccaacctggacctgctgaacctcttccagaccttctgccagaagggcggcctgctgtgcaccctgcagggcaagctgcagcctgaggactggaccagcctggatggccccctgcagggcctgcagaccctgctgctgatggtgctgcggcaggccagcggccggccccacggcagccacggcctcttcctgcgctacagagtggaggccctgaccctgcggggcatcaacagcttccggcagtacaagtatgacctggtggccgtgggcaaggccctggagggcatgttcaggaagctgaaccacctgctggagcggctgcaccagagcttcttcctgtacctgctgcccggcctgagcagatttgtgtccatcggcctgtacatgcctgctgtgggcttcctgctgctggtgctgggcctgaaggccctggagctgtggatgcagctgcatgaagctggcatgggcctggaggagcccggcggggcccctggccccagcgtgcccctgccccccagccagggcgtgggcctggccagcctggtggcccccctgctgatcagccaggccatgggcctggccctgtatgtgctgcctgtgctgggccagcacgtggccacccagcacttccctgtggccgaggccgaggccgtggtgctgaccctgctggccatctatgctgctggcctggccctgccccacaacacccaccgggtggtgtccacccaggccccagaccggggctggatggccctgaagctggtggccctgatctacctggccctgcagctgggctgcatcgccctgaccaacttcagcctgggcttcctgctggccaccaccatggtgcccacagctgccctggccaagccccacggccccaggaccctgtatgctgccctgctggtgctgaccagccctgctgccaccctgctgggcagcctcttcctgtggagggagctgcaggaggcccccctgagcctggccgagggctggcagctgttcctggccgccctggcccagggcgtgctggagcaccacacctatggagccctgctcttccccctgctgagcctgggcctgtacccctgctggctgctcttctggaatgtgctcttctggaagtag

SEQ ID NO: 154253 - DNA, 1686 bp, Artificial Sequence
  Description of Artificial Sequence: Synthetic coding sequence
atgggcctgctgagtgaccctgtgagaagaagagccctggcccggctggtgctgcggctgaatgcccccctgtgggccctgcctgtggcctggctggagaggaccatgaggtctgtgggcctggaggtgtacacccagagcttcagcaggaagctgcccttcccagatgagacccatgagcgctacatggtgtctggcaccaacgtgtatggcatcctgcgggccccccgggccgccagcacagagagcctggtgctgactgtgccctgtggcagtgacagcaccaacagccaggccgtgggcctgctgctggccctggccgcccacttccggggccagatctactgggccaaggacatcgtgttcctggtgacagaacatgacctgctgggcacagaggcctggctggaggcctaccatgatgtgaatgtgacaggcatgcagagcagccccctgcagggccgggccggggccatccaggccgctgtggccctggagctgagcagtgatgtggtgaccagcctggatgtggccgtggagggcctgaatggccagctgcccaacctggacctgctgaacctcttccagaccttctgccagaagggcggcctgctgtgcaccctgcagggcaagctgcagcctgaggactggaccagcctggatggccccctgcagggcctgcagaccctgctgctgatggtgctgcggcaggccagcggccggccccacggcagccacggcctcttcctgcgctacagagtggaggccctgaccctgcggggcatcaacagcttccggcagtacaagtatgacctggtggccgtgggcaaggccctggagggcatgttcaggaagctgaaccacctgctggagcggctgcaccagagcttcttcctgtacctgctgcccggcctgagcagatttgtgtccatcggcctgtacatgcctgctgtgggcttcctgctgctggtgctgggcctgaaggccctggagctgtggatgcagctgcatgaagctggcatgggcctggaggagcccggcggggcccctggccccagcgtgcccctgccccccagccagggcgtgggcctggccagcctggtggcccccctgctgatcagccaggccatgggcctggccctgtatgtgctgcctgtgctgggccagcacgtggccacccagcacttccctgtggccgaggccgaggccgtggtgctgaccctgctggccatctatgctgctggcctggccctgccccacaacacccaccgggtggtgtccacccaggccccagaccggggctggatggccctgaagctggtggccctgatctacctggccctgcagctgggctgcatcgccctgaccaacttcagcctgggcttcctgctggccaccaccatggtgcccacagctgccctggccaagccccacggccccaggaccctgtatgctgccctgctggtgctgaccagccctgctgccaccctgctgggcagcctcttcctgtggagggagctgcaggaggcccccctgagcctggccgagggctggcagctgttcctggccgccctggcccagggcgtgctggagcaccacacctatggagccctgctcttccccctgctgagcctgggcctgtacccctgctggctgctcttctggaatgtgctcttctggaagtag

SEQ ID NO: 154254 - DNA, 555 bp, Artificial Sequence
  Description of Artificial Sequence: Synthetic coding sequence
atgaaggccctgggcgctgtgctgctggccctgctgctgtgtggccggcccggccggggccagacccagcaggaggaggaggaggaggatgaagatcatggcccagatgattatgatgaagaagatgaagatgaggtggaggaggaggagaccaaccggctgcccggcggccgcagccgggtgctgctgcgctgctacacctgcaagagcctgcccagagatgagcgctgcaacctgacccagaactgcagccacggccagacctgcaccaccctgattgcccacggcaacacagagagcggcctgctgaccacccacagcacctggtgcacagacagctgccagcccatcaccaagacagtggagggcacccaggtgaccatgacctgctgccagagcagcctgtgcaatgtgcccccctggcagagcagccgggtgcaggaccccaccgggaagggggccggcggcccccggggcagcagcgagaccgtgggcgccgccctgctgctgaacctgctggccggcctgggcgccatgggcgcccggcggccctag

SEQ ID NO: 154255 - DNA, 582 bp, Artificial Sequence
  Description of Artificial Sequence: Synthetic coding sequence
atgggcaagcagaacagcaagctgcggcctgaggtgatgcaggacctgctggagagcacagacttcacagaacatgagatccaggagtggtacaagggcttcctgcgggactgccccagcggccacctgtccatggaggagttcaagaagatctacggcaacttcttcccctatggagatgccagcaagtttgctgagcacgtgttccgcacctttgatgccaatggagatggcaccatcgacttccgggagttcatcatcgccctgtctgtgaccagccggggcaagctggagcagaagctgaagtgggccttctccatgtatgacctggatggaaatggctacatcagcaaggccgagatgctggagatcgtgcaggccatctacaagatggtgtcctctgtgatgaagatgccagaagatgagagcaccccagagaagaggacagagaagatcttccggcagatggacaccaacagagatggcaagctgagcctggaggagttcatccggggggccaagagtgaccccagcatcgtgcggctgctgcagtgtgaccccagcagcgctggccagttctag

SEQ ID NO: 154256 - DNA, 756 bp, Artificial Sequence
  Description of Artificial Sequence: Synthetic coding sequence
atgtctgcctacggcatgcccatgtacaagagcggggacctggtgtttgccaagctgaagggctacgcccactggccagccagaattgagcacatgacccagcccaaccgctaccaggtgttcttcttcggcacccatgaaacagccttcctgagccccaagaggctcttcccctacaaggagtgcaaggagaagtttgggaagcccaacaagaggcggggcttctctgctggcctgtgggagattgagaacaaccccaccgtgcaggccagtgactgccccctggccagcgagaagggcagcggagatggcccctggccagagcctgaggccgcagaaggagatgaggacaagcccacccacgccggcggcggcggagatgagctgggcaagccagatgatgacaagcccacagaggaggagaagggccccctgaagaggtctgctggggaccccccagaagatgcccccaagaggcccaaggaggccgccccagaccaggaggaggaggccgaggccgagagagctgctgaggccgagagagctgctgctgctgctgctgccacagctgtggatgaggagagccccttcctggtggccgtggagaatggaagtgcccccagcgagcccggcctggtgtgtgagcccccccagcctgaggaggaggagctgcgggaggaggaggtggctgatgaggaggccagccaggagtggcacgccgaggcccctgggggcggggaccgggacagcctgtag

SEQ ID NO: 154257 - DNA, 531 bp, Artificial Sequence
  Description of Artificial Sequence: Synthetic coding sequence
atgtctgccttccggctgtggccaggcctgctgatcatgctgggcagcctgtgccaccggggcagcccctgtggcctgagcacccacgtggagatcggccaccgggccctggagttcctgcagctgcacaacggccgggtgaactaccgggagctgctgctggagcaccaggatgcctaccaggccggcatcgtgtttcctgactgcttctaccccagcatctgcaagggcggcaagttccatgatgtgtctgagagcacccactggacccccttcctgaatgcctctgtgcactacatccgggagaactaccccctgccctgggagaaggacacagagaagctggtggccttcctgtttggcatcaccagccacatggccgcagatgtgtcctggcacagcctgggcctggagcagggcttcctgcggaccatgggcgccatcgacttccacggcagctacagcgaggcccacagcgctggggactttggaacagtgtacctgcacctgctgaacttcctggtggtgtag

SEQ ID NO: 154258 - DNA, 831 bp, Artificial Sequence
  Description of Artificial Sequence: Synthetic coding sequence
atgaacagcaagaggatgctgctgctggtgctgtttgccttcagcctgatgctggtggagcgctacttcaggaaccaccaggtggaggagctgcggctgagtgactggttccaccccaggaagaggccagatgtgatcaccaagacagactggctggcccctgtgctgtgggagggcacctttgacagaagagtgctggagaagcactacagaagaagaaacatcaccgtgggcctggccgtgtttgccaccggccgctttgctgaggagtacctgcggcccttcctgcacagcgccaacaagcacttcatgacaggctacagagtcatcttctacatcatggtggatgccttcttcaagctgcctgacatcgagcccagccccctgcggaccttcaaggccttcaaggtgggcacagagcgctggtggctggatggccccctggtgcacgtgaagagcctgggggagcacatcgccagccacatccaggatgaggtggacttcctgttctccatggccgccaaccaggtgttccagaatgaatttggagtggagaccctgggccccctggtggcccagctgcacgcctggtggtacttcaggaacaccaagaacttcccctatgaaagaagacccaccagcgctgcctgcatccccttcggccagggcgacttctactacggcaacctgatggtgggcggcaccccccacaacatcctggacttcatcaaggagtacctgaatggagtcatccatgacatcaagaatggcctgaacagcacctatgagaagcacctgaacaagtacttctacctgaacaagcccacctag

SEQ ID NO: 154259 - DNA, 2166 bp, Artificial Sequence
  Description of Artificial Sequence: Synthetic coding sequence
atgctgccccggggccggccccgggccctgggcgctgctgccctgctgctgctgctgctgctgctgggcttcctgctgtttggaggagacctgggctgtgaaagaagagagcccggcggccgggccggggcccctggctgcttccctggccccctgatgccccgggtgcccccagatggccgcctgcggcgggccgccgccctggatggagaccccggggccggccctggggaccacaacagaagtgactgtggcccccagcccccacctccacccaagtgtgagctgctgcacgtggccatcgtgtgtgccggccacaacagcagcagagatgtgatcaccctggtgaagtccatgctgttctacaggaagaaccccctgcacctgcacctggtgacagatgctgtggccaggaacatcctggagaccctcttccacacctggatggtgcctgctgtgcgggtgtccttctaccacgccgaccagctgaagccccaggtgtcctggatccccaacaagcactacagcggcctgtatggcctgatgaagctggtgctgcccagcgccctgcctgctgagctggcccgggtcatcgtgctggacacagatgtgacctttgccagtgacatcagcgagctgtgggccctgtttgcccacttcagtgacacccaggccatcggcctggtggagaaccagagcgactggtacctgggcaacctgtggaagaaccaccggccctggccagccctgggccggggcttcaacacaggagtcatcctgctgcggctggaccggctgcggcaggccggctgggagcagatgtggaggctgacagcccggcgggagctgctgagcctgcctgccaccagcctggccgaccaggacatcttcaatgctgtgatcaaggagcaccctggcctggtgcagaggctgccctgtgtgtggaatgtgcagctgagtgaccacaccctggccgagcgctgctacagcgaggccagtgacctgaaggtgatccactggaacagccccaagaagctgcgggtgaagaacaagcacgtggagttcttcaggaacttctacctgaccttcctggagtatgatggcaacctgctgcggcgggagctgtttgtgtgccccagccagcccccacctggagctgagcagctgcagcaggccctggcccagctggatgaggaggacccctgctttgagttccggcagcagcagctgactgtgcaccgggtgcacgtgaccttcctgccccatgagcccccaccaccccggccccatgatgtgaccctggtggcccagctgtccatggaccggctgcagatgctggaggccctgtgccgccactggccaggccccatgagcctggccctgtacctgacagatgctgaggcccagcagttcctgcactttgtggaggccagccctgtgctggccgcccggcaggatgtggcctaccacgtggtgtaccgggagggccccctgtaccctgtgaaccagctgagaaatgtggccctggcccaggccctgaccccctacgtgttcctgagtgacatcgacttcctgcctgcctacagcctgtatgactacctgcgggccagcattgagcagctgggcctgggcagcaggaggaaggccgccctggtggtgcctgcctttgagaccctgcgctaccgcttctccttcccccacagcaaggtggagctgctggccctgctggatgctggcaccctgtacaccttccgctaccacgagtggccccggggccacgcccccacagattatgcccgctggagggaggcccaggccccctacagagtgcagtgggccgccaactatgagccctacgtggtggtgccccgggactgccccaggtatgaccccaggtttgtgggcttcggctggaacaaggtggcccacatcgtggagctggatgcccaggagtatgagctgctggtgctgcctgaggccttcaccatccacctgccccacgcccccagcctggacatcagccgcttccgcagcagccccacctacagagactgcctgcaggccctgaaggatgagttccaccaggacctgagccgccaccacggggccgccgccctgaagtacctgcctgccctgcagcagccccagagccctgcccggggctag

SEQ ID NO: 154260 - DNA, 870 bp, Artificial Sequence
  Description of Artificial Sequence: Synthetic coding sequence
atgtggaggctgacagcccggcgggagctgctgagcctgcctgccaccagcctggccgaccaggacatcttcaatgctgtgatcaaggagcaccctggcctggtgcagaggctgccctgtgtgtggaatgtgcagctgagtgaccacaccctggccgagcgctgctacagcgaggccagtgacctgaaggtgatccactggaacagccccaagaagctgcgggtgaagaacaagcacgtggagttcttcaggaacttctacctgaccttcctggagtatgatggcaacctgctgcggcgggagctgtttgtgtgccccagccagcccccacctggagctgagcagctgcagcaggccctggcccagctggatgaggaggacccctgctttgagttccggcagcagcagctgactgtgcaccgggtgcacgtgaccttcctgccccatgagcccccaccaccccggccccatgatgtgaccctggtggcccagctgtccatggaccggctgcagatgctggaggccctgtgccgccactggccaggccccatgagcctggccctgtacctgacagatgctgaggcccagcagttcctgcactttgtggaggccagccctgtgctggccgcccggcaggatgtggcctaccacgtggtgtaccgggagggccccctgtaccctgtgaaccagctgagaaatgtggccctggcccaggccctgaccccctacgtgttcctgagtgacatcgacttcctgcctgcctacagcctgtatgactacctgcgggaggcccgggccggcttcaacagcagcagcacctgtggctgtgcccaccccagccaccaggcccgctggcccatggtggtgtag

SEQ ID NO: 154261 - DNA, 2166 bp, Artificial Sequence; identical to SEQ ID NO: 154259
  Description of Artificial Sequence: Synthetic coding sequence

SEQ ID NO: 154262 - DNA, 2166 bp, Artificial Sequence; identical to SEQ ID NO: 154259
  Description of Artificial Sequence: Synthetic coding sequence

SEQ ID NO: 154263 - DNA, 2073 bp, Artificial Sequence
  Description of Artificial Sequence: Synthetic coding sequence
atgctgccccggggccggccccgggccctgggcgctgctgccctgctgctgctgctgctgctgctgggcttcctgctgtttgatggccgcctgcggcgggctgctgccctggatggagaccctggagctggccctggggaccacaacagaagtgactgtggcccccagcccccacctccacccaagtgtgagctgctgcacgtggccatcgtgtgtgccggccacaacagcagcagagatgtgatcaccctggtgaagtccatgctgttctacaggaagaaccccctgcacctgcacctggtgacagatgctgtggccaggaacatcctggagaccctcttccacacctggatggtgcctgctgtgcgggtgtccttctaccacgccgaccagctgaagccccaggtgtcctggatccccaacaagcactacagcggcctgtatggcctgatgaagctggtgctgcccagcgccctgcctgctgagctggcccgggtgattgtgctggacacagatgtgacctttgccagtgacatcagcgagctgtgggccctgtttgcccacttcagtgacacccaggccatcggcctggtggagaaccagagcgactggtacctgggcaacctgtggaagaaccaccggccctggccagccctgggccggggcttcaacacaggagtcatcctgctgcggctggaccggctgcggcaggccggctgggagcagatgtggaggctgacagcccggcgggagctgctgagcctgcctgccaccagcctggccgaccaggacatcttcaatgctgtgatcaaggagcaccctggcctggtgcagaggctgccctgtgtgtggaatgtgcagctgagtgaccacaccctggccgagcgctgctacagcgaggccagtgacctgaaggtgatccactggaacagccccaagaagctgcgggtgaagaacaagcacgtggagttcttcaggaacttctacctgaccttcctggagtatgatggcaacctgctgcggcgggagctgtttgtgtgccccagccagcccccacctggagctgagcagctgcagcaggccctggcccagctggatgaggaggacccctgctttgagttccggcagcagcagctgactgtgcaccgggtgcacgtgaccttcctgccccatgagcccccaccaccccggccccatgatgtgaccctggtggcccagctgtccatggaccggctgcagatgctggaggccctgtgccgccactggccaggccccatgagcctggccctgtacctgacagatgctgaggcccagcagttcctgcactttgtggaggccagccctgtgctggccgcccggcaggatgtggcctaccacgtggtgtaccgggagggccccctgtaccctgtgaaccagctgagaaatgtggccctggcccaggccctgaccccctacgtgttcctgagtgacatcgacttcctgcctgcctacagcctgtatgactacctgcgggccagcattgagcagctgggcctgggcagcaggaggaaggccgccctggtggtgcctgcctttgagaccctgcgctaccgcttctccttcccccacagcaaggtggagctgctggccctgctggatgctggcaccctgtacaccttccgctaccacgagtggccccggggccacgcccccacagattatgcccgctggagggaggcccaggccccctacagagtgcagtgggccgccaactatgagccctacgtggtggtgccccgggactgccccaggtatgaccccaggtttgtgggcttcggctggaacaaggtggcccacatcgtggagctggatgcccaggagtatgagctgctggtgctgcctgaggccttcaccatccacctgccccacgcccccagcctggacatcagccgcttccgcagcagccccacctacagagactgcctgcaggccctgaaggatgagttccaccaggacctgagccgccaccacggggctgctgccctgaagtacctgcctgccctgcagcagccccagagccctgcccggggctag

SEQ ID NO: 154264 - DNA, 1122 bp, Artificial Sequence
  Description of Artificial Sequence: Synthetic coding sequence
atgagcatcctgatcatcgaggccttctacggcggcagccacaagcagctggtggacctgctgcaggaggagctgggggactgtgtggtgtacaccctgcctgccaagaagtggcactggagggcccggaccagcgccctgtacttcagccagaccatccccatcagcgagcactaccgcaccctgtttgccagctctgtgctgaacctgacagagctggccgccctgcggccagacctgggcaagctgaagaagatcctgtacttccacgagaaccagctgatctaccctgtgaagaagtgccaggagcgggacttccagtatggctacaaccagatcctgagctgcctggtggctgatgtggtggtgttcaacagcgtcttcaacatggagagcttcctgacctccatgggcaagttcatgaagctgatcccagaccaccggcccaaggacctggagagcatcatccggcccaagtgccaggtgatctacttccccatccgcttcccagatgtgagccgcttcatgcccaagcacaagaccacccacctgaagaagatgctgggcctgaagggaaatggaggagctgtgctgtccatggccctgcccttccagcctgagcagagggacagcgaggacctgctgaagaacttcaacagtgaatgtgacacccactgcggcctggacacagcccggcaggagtacctgggcaacagcctgcggcaggagagtgacctgaagaagagcaccagcagtgacaacagcagcagccaccacggggagaacaagcagaacctgactgtggacccctgtgacatcctgggcggcgtggacaaccagcagaggctgctgcacatcgtgtggccccaccgctggctggaggccgtgtactgcggctgctaccccctgtgccccaaggacctggtgtacccagagatcttccctgctgagtacctgtacagcaccccagagcagctgagcaagaggctgcagaacttctgcaagaggccagacatcatcaggaagcacctgtacaagggggagatcgcccccttctcctgggccgccctgcacggcaagttccgcagcctgctgaccacagagccccgggaggacctgtag

SEQ ID NO: 154265 - DNA, 1377 bp, Artificial Sequence
  Description of Artificial Sequence: Synthetic coding sequence
atgagcatcctgatcatcgaggccttctacggcggcagccacaagcagctggtggacctgctgcaggaggagctgggggactgtgtggtgtacaccctgcctgccaagaagtggcactggagggcccggaccagcgccctgtacttcagccagaccatccccatcagcgagcactaccgcaccctgtttgccagctctgtgctgaacctgacagagctggccgccctgcggccagacctgggcaagctgaagaagatcctgtacttccacgagaaccagctgatctaccctgtgaagaagtgccaggagcgggacttccagtatggctacaaccagatcctgagctgcctggtggctgatgtggtggtgttcaacagcgtcttcaacatggagagcttcctgacctccatgggcaagttcatgaagctgatcccagaccaccggcccaaggacctggagagcatcatccggcccaagtgccaggtgatctacttccccatccgcttcccagatgtgagccgcttcatgcccaagcacaagaccacccacctgaagaagatgctgggcctgaagggaaatggaggagctgtgctgtccatggccctgcccttccagcctgagcagagggacagcgaggacctgctgaagaacttcaacagtgaatgtgacacccactgcggcctggacacagcccggcaggagtacctgggcaacagcctgcggcaggagagtgacctgaagaagagcaccagcagtgacaacagcagcagccaccacggggagaacaagcagaacctgactgtggacccctgtgacatcctgggcggcgtggacaaccagcagaggctgctgcacatcgtgtggccccaccgctgggagcatgacaaggaccctgagagcttcttcaaggtgctgatgcacctgaaggacctgggcctgaacttccacgtgtctgtgctgggggagaccttcacagatgtgcctgacatcttcagcgaggccaagaaggccctgggcagctctgtgctgcactggggctacctgcccagcaaggatgactacttccaggtgctgtgcatggctgatgtggtgatcagcacagccaagcatgagttctttggagtggccatgctggaggccgtgtactgcggctgctaccccctgtgccccaaggacctggtgtacccagagatcttccctgctgagtacctgtacagcaccccagagcagctgagcaagaggctgcagaacttctgcaagaggccagacatcatcaggaagcacctgtacaagggggagatcgcccccttctcctgggccgccctgcacggcaagttccgcagcctgctgaccacagagccccgggaggacctgtag

SEQ ID NO: 154266 - DNA, 1122 bp, Artificial Sequence; identical to SEQ ID NO: 154264
  Description of Artificial Sequence: Synthetic coding sequence

SEQ ID NO: 154267 - DNA, 1377 bp, Artificial Sequence; identical to SEQ ID NO: 154265
  Description of Artificial Sequence: Synthetic coding sequence

SEQ ID NO: 154268 - DNA, 1377 bp, Artificial Sequence; identical to SEQ ID NO: 154265
  Description of Artificial Sequence: Synthetic coding sequence

SEQ ID NO: 154269 - DNA, 300 bp, Artificial Sequence
  Description of Artificial Sequence: Synthetic coding sequence
atgagcatcctgatcatcgaggccttctacggcggcagccacaagcagctggtggacctgctgcaggaggagctgggggactgtgtggtgtacaccctgcctgccaagaagtggcactggagggcccggaccagcgccctgtacttcagccagaccatccccatcagcgagcactaccgcaccctgtttgccagctctgtgctgaacctgacagagctggccgccctgcggccagacctgggcaagctgaagaagatcctgtacttccacgagaaccagctgatctaccctgtgaagtag

SEQ ID NO: 154270 - DNA, 522 bp, Artificial Sequence
  Description of Artificial Sequence: Synthetic coding sequence
atgagcatcctgatcatcgaggccttctacggcggcagccacaagcagctggtggacctgctgcaggaggagctgggggactgtgtggtgtacaccctgcctgccaagaagtggcactggagggcccggaccagcgccctgtacttcagccagaccatccccatcagcgagcactaccgcaccctgtttgccagctctgtgctgaacctgacagagctggccgccctgcggccagacctgggcaagctgaagaagatcctgtacttccacgagaaccagctgatctaccctgtgaagaagtgccaggagcgggacttccagtatggctacaaccagatcctgagctgcctggtggctgatgtggtggtgttcaacagcgtcttcaacatggagagcttcctgacctccatgggcaagttcatgaagctgatcccagaccaccggcccaaggacctggagagcatcatccggcccaagtgccaggtgatctacttccccatccgcttcccagatgtgtcctag

SEQ ID NO: 154271 - DNA, 1377 bp, Artificial Sequence; identical to SEQ ID NO: 154265
  Description of Artificial Sequence: Synthetic coding sequence

SEQ ID NO: 154272 - DNA, 2220 bp, Artificial Sequence
  Description of Artificial Sequence: Synthetic coding sequence
atgcccagccccaggcctgtgctgctgcggggggcccgggccgccctgctgctgctgctgcccccccggctgctggcccggcccagcctgctgctgcggcgcagcctgtctgctgccagctgcccccccatcagcctgcctgctgctgccagccgcagctccatggatggagctggagctgaggaggtgctggcccccctgcggctggccgtgcggcagcagggcgacctggtgaggaagctgaaggaggacaaggccccccaggtggatgtggacaaggctgtggccgagctgaaggccaggaagagggtgctggaggccaaggagctggccctgcagcccaaggatgacatcgtggaccgggccaagatggaggacaccctgaagaggcgcttcttctatgaccaggcctttgccatctatggaggagtgtctggcctgtatgactttggacctgtgggctgtgccctgaagaacaacatcatccagacctggaggcagcacttcatccaggaggagcagatcctggagattgactgcaccatgctgaccccagagcctgtgctgaagaccagcggccacgtggacaagtttgctgacttcatggtgaaggatgtgaagaatggagagtgcttccgggctgaccacctgctgaaggcccacctgcagaagctgatgtctgacaagaagtgcagcgtggagaagaagtctgagatggagagcgtgctggcccagctggacaactacggccagcaggagctggccgacctgtttgtgaactacaacgtgaagagccccatcactggaaatgacctgagcccccctgtgtccttcaacctgatgttcaagaccttcatcggccctgggggcaacatgcctggctacctgcggcctgagacagcccagggcatcttcctgaacttcaagaggctgctggagttcaaccagggcaagctgccctttgctgctgcccagatcggcaacagcttcagaaatgagatcagccccaggagcggcctcatccgggtgcgggagttcaccatggccgagattgagcactttgtggaccccagcgagaaggaccaccccaagttccagaatgtggccgacctgcacctgtacctgtacagcgccaaggcccaggtgtctggccagagcgccaggaagatgaggctgggagatgctgtggagcagggcgtcatcaacaacacagtgctgggctacttcatcggccgcatctacctgtacctgaccaaggtgggcatcagcccagacaagctgcgcttccggcagcacatggagaatgagatggcccactacgcctgtgactgctgggatgctgagagcaagaccagctatggctggattgagatcgtgggctgtgccgacaggagctgctatgacctgagctgccacgcccgggccaccaaggtgcccctggtggccgagaagcccctgaaggagcccaagacagtgaatgtggtgcagtttgagcccagcaaaggagccatcggcaaggcctacaagaaggatgccaagctggtgatggagtacctggccatctgtgatgagtgctacatcacagagatggagatgctgctgaatgaaaaaggagagttcaccatcgagacagagggcaagaccttccagctgaccaaggacatgatcaacgtgaagcgcttccagaagaccctgtatgtggaggaggtggtgcccaacgtgattgagcccagctttggcctgggccgcatcatgtacacagtgtttgagcacaccttccacgtgcgggagggagatgagcagaggaccttcttctccttccctgctgtggtggcccccttcaagtgcagcgtgctgcccctgagccagaaccaggagttcatgccctttgtgaaggagctgtctgaggccctgaccaggcatggagtgagccacaaggtggatgacagcagcggcagcatcggccgccgctatgccaggacagatgaaattggagtggccttcggcgtgaccatcgactttgacacagtgaacaagaccccccacacagccaccctgcgggaccgggacagcatgaggcagatccgggcagagatcagcgagctgcccagcatcgtgcaggacctggccaatggaaacatcacctgggcagatgtggaggcccgctaccccctgtttgagggccaggagaccgggaagaaggagaccatcgaggagtag

SEQ ID NO: 154273 - DNA, 555 bp, Artificial Sequence
  Description of Artificial Sequence: Synthetic coding sequence
atggccgagccccagccccccagcggcggcctgacagatgaagctgccctgagctgctgcagtgatgctgaccccagcaccaaggacttcctgctgcagcagaccatgctgcgggtgaaggaccccaagaagagcctggacttctacaccagggtgctgggcatgaccctcatccagaagtgtgacttccccatcatgaagttcagcctgtacttcctggcctatgaggacaagaatgacatccccaaggagaaggatgagaagatcgcctgggccctgagcaggaaggccaccctggagctgacccacaactggggcacagaagatgatgagacccagagctaccacaatggaaacagcgacccccggggcttcggccacatcggcattgctgtgcctgatgtgtacagcgcctgcaagagatttgaggagctgggcgtgaagtttgtgaagaagccagatgatggcaagatgaagggcctggccttcatccaggaccctgatggctactggattgagatcctgaaccccaacaagatggccaccctgatgtag

SEQ ID NO: 154274 - DNA, 987 bp, Artificial Sequence
  Description of Artificial Sequence: Synthetic coding sequence
atgaggcctgtgcggctgatgaaggtgtttgtgacccggcgcatcccagctgagggccgggtggccctggcccgggctgctgactgtgaggtggagcagtgggacagtgatgagcccatcccagccaaggagctggagcggggcgtggccggggcccacggcctgctgtgcctgctgagtgaccacgtggacaagaggatcctggatgctgctggggccaacctgaaggtgatcagcaccatgtctgtgggcatcgaccacctggccctggatgagatcaagaagaggggcatccgggtgggctacaccccagatgtgctgacagacaccacagctgagctggccgtgtccctgctgctgaccacctgccggcggctgcctgaggccatcgaggaggtgaagaatggaggctggacctcctggaagcccctgtggctgtgtggctacggcctgacccagagcacagtgggcatcatcggcctgggccgcatcggccaggccatcgcccggcggctgaagccctttggagtgcagcgcttcctgtacacaggccggcagcccaggcctgaggaggccgctgagttccaggccgagtttgtgtccaccccagagctggccgcccagagcgacttcatcgtggtggcctgcagcctgaccccagccacagagggcctgtgcaacaaggacttcttccagaagatgaaggagacagctgtgttcatcaacatcagcagaggagatgtggtgaaccaggatgacctgtaccaggccctggccagcggcaagattgctgctgctggcctggatgtgaccagccctgagcccctgcccaccaaccaccccctgctgaccctgaagaactgtgtgatcctgccccacatcggcagcgccacccacaggaccaggaacaccatgagcctgctggccgccaacaacctgctggccggcctgcggggggagcccatgcccagcgagctgaagctgtag

SEQ ID NO: 154275 - DNA, 1188 bp, Artificial Sequence
  Description of Artificial Sequence: Synthetic coding sequence
atgaggcctgtgcggctgatgaaggtgtttgtgacccggcgcatcccagctgagggccgggtggccctggcccgggctgctgactgtgaggtggagcagtgggacagtgatgagcccatcccagccaaggagctggagcggggcgtggccggggcccacggcctgctgtgcctgctgagtgaccacgtggacaagaggatcctggatgctgctggggccaacctgaaggtgatcagcaccatgtctgtgggcatcgaccacctggccctggatgagatcaagaagaggggcatccgggtgggctacaccccagatgtgctgacagacaccacagctgagctggccgtgtccctgctgctgaccacctgccggcggctgcctgaggccatcgaggaggtgaagaatggaggctggacctcctggaagcccctgtggctgtgtggctacggcctgacccagagcacagtgggcatcatcggcctgggccgcatcggccaggccatcgcccggcggctgaagccctttggagtgcagcgcttcctgtacacaggccggcagcccaggcctgaggaggccgctgagttccaggccgagtttgtgtccaccccagagctggccgcccagagcgacttcatcgtggtggcctgcagcctgaccccagccacagagggcctgtgcaacaaggacttcttccagaagatgaaggagacagctgtgttcatcaacatcagccgctacccccgggccaccctgcccagcaagccaggagaggagcccagccccctgctgcccagcggggacttcctgccccggggcctgctggtgcggccccaggccgagctggccggcttccacaagcccaacaaccagctgaggaacagctgggagtacacccggcccccctaccgggaggaggagcccagcgagtgggcctggcctgtgtgcttctctgctgtggcccccacccggcggggcctggcccacagctctgtggccagcggctctgtgccccgggagcccctgcaggcccactaccccccaccccagagagctggcctggaggacctgaagggccccctggaggccgccagccacacagctgagcccggctttgtgtggctgtggttcagtgacaccctgaacctgatgctgctgggcggccagaccctgaagctgacctggagctag

SEQ ID NO: 154276 - DNA, 759 bp, Artificial Sequence
  Description of Artificial Sequence: Synthetic coding sequence
atgctgggcggcgtgcccaccctgtgtggcactggaaatgagacctggaccctgctggccctgggccaggccatcgcccggcggctgaagcccttcggcgtgcagcgcttcctgtacacaggccggcagcccaggcctgaggaggccgctgagttccaggccgagtttgtgtccaccccagagctggccgcccagagcgacttcatcgtggtggcctgcagcctgaccccagccacagagggcctgtgcaacaaggacttcttccagaagatgaaggagacagctgtgttcatcaacatcagccgctacccccgggccaccctgcccagcaagccaggagaggagcccagccccctgctgcccagcggggacttcctgccccggggcctgctggtgcggccccaggccgagctggccggcttccacaagcccaacaaccagctgagaaattcctgggagtacaccaggcctccctaccgggaggaggagcccagcgagtgggcctggcctgtgtgcttctctgctgtggcccccacccggcggggcctggcccacagctctgtggccagcggctctgtgccccgggagcccctgcaggcccactaccccccaccccagagagctggcctggaggacctgaagggccccctggaggccgccagccacacagctgagcccggctttgtgtggctgtggttcagtgacaccctgaacctgatgctgctgggcggccagaccctgaagctgacctggagctag

SEQ ID NO: 154277 - DNA, 1677 bp, Artificial Sequence
  Description of Artificial Sequence: Synthetic coding sequence
atggagctgcgggcccggggctggtggctgctgtgtgccgctgctgccctggtggcctgtgcccggggggaccctgccagcaagagccgcagctgtggggaggtgcggcagatctatggagccaagggcttcagcctgagtgatgtgccccaggccgagatctctggagagcacctgcgcatctgcccccagggctacacctgctgcaccagcgagatggaggagaacctggccaacagaagccatgctgagctggagacagccctgcgggacagcagccgggtgctgcaggccatgctggccacccagctgcggagctttgatgaccacttccagcacctgctgaatgacagcgagaggaccctgcaggccaccttccctggggccttcggggagctgtacacccagaatgcccgggccttccgggacctgtacagcgagctgcggctgtactacagaggagccaacctgcacctggaggagaccctggccgagttctgggcccggctgctggagcggctcttcaagcagctgcacccccagctgctgctgcctgatgactacctggactgcctgggcaagcaggccgaggccctgcggccctttggagaggccccccgggagctgcggctgcgggccacccgggcctttgtggccgcccggagctttgtgcagggcctgggcgtggccagtgatgtggtgaggaaggtggcccaggtgcccctgggcccagaatgttccagagctgtgatgaagctggtgtactgtgcccactgcctgggcgtgcctggggcccggccctgcccagactactgcagaaatgtgctgaagggctgcctggccaaccaggccgacctggatgctgagtggaggaacctgctggacagcatggtgctgatcacagacaagttctggggcaccagcggcgtggagagcgtcatcggctctgtgcacacctggctggccgaggccatcaatgccctgcaggacaacagagacaccctgacagccaaggtgatccagggctgcggcaaccccaaggtgaacccccagggccctggccctgaggagaagagaagaagaggcaagctggccccccgggagcggccccccagcggcaccctggagaagctggtgtctgaggccaaggcccagctgagagatgtgcaggacttctggatcagcctgcccggcaccctgtgcagcgagaagatggccctgagcacagccagtgatgaccgctgctggaatggcatggcccggggccgctacctgcctgaggtgatgggagatggcctggccaaccagatcaacaaccctgaggtggaggtggacatcaccaagccagacatgaccatccggcagcagatcatgcagctgaagatcatgaccaaccggctgcggagcgcctacaatggaaatgatgtggacttccaggatgccagtgatgatggcagcggcagcggcagcggagatggctgcctggatgacctgtgcagcaggaaggtgtccaggaagagcagcagcagcaggacccccctgacccacgccctgcccggcctgtctgagcaggagggccagaagaccagcgctgccagctgcccccagccccccaccttcctgctgcccctgctgctcttcctggccctgactgtggcccggccccgctggaggtag

SEQ ID NO: 154278 - DNA, 1743 bp, Artificial Sequence
  Description of Artificial Sequence: Synthetic coding sequence
atggccggcaccgtgaggacagcctgcctggtggtggccatgctgctgagcctggacttccctggccaggcccagcccccacctcctcctccagatgccacctgccaccaggtgcgctccttcttccagaggctgcagcccggcctgaagtgggtgcctgagacccctgtgcccggcagtgacctgcaggtgtgcctgcccaagggccccacctgctgcagcaggaagatggaggagaagtaccagctgacagcccggctgaacatggagcagctgctgcagagcgcctccatggagctgaagttcctgatcatccagaatgctgctgtgttccaggaggcctttgaaattgtggtgagacatgccaagaactacaccaatgccatgttcaagaacaactaccccagcctgaccccccaggcctttgaatttgtgggggagttcttcacagatgtgtccctgtacatcctgggcagtgacatcaacgtggatgacatggtgaatgagctgtttgacagcctcttccctgtgatctacacccagctgatgaaccctggcctgcctgacagcgccctggacatcaatgaatgtctgcggggggcccggcgggacctgaaggtgtttggaaacttccccaagctgatcatgacccaggtgtccaagagcctgcaggtgacccgcatcttcctgcaggccctgaacctgggcattgaagtcatcaacaccacagaccacctgaagttcagcaaggactgtggccgcatgctgaccaggatgtggtactgcagctactgccagggcctgatgatggtgaagccctgtggcggctactgcaatgtggtgatgcagggctgcatggccggcgtggtggagattgacaagtactggagggagtacatcctgagcctggaggagctggtgaatggcatgtaccgcatctatgacatggagaatgtgctgctgggcctcttcagcaccatccatgacagcatccagtatgtgcagaagaatgctgggaagctgaccaccaccatcggcaagctgtgtgcccacagccagcagaggcagtacagaagtgcctactacccagaggacctcttcatcgacaagaaggtgctgaaggtggcccacgtggagcacgaggagaccctgagcagcagaagaagagagctgatccagaagctgaagagcttcatctccttctacagcgccctgcccggctacatctgcagccacagccctgtggctgaaaatgacaccctgtgctggaatggccaggagctggtggagcgctacagccagaaggccgccagaaatggcatgaagaaccagttcaacctgcacgagctgaagatgaagggccctgagcctgtggtgtcccagatcatcgacaagctgaagcacatcaaccagctgctgcggaccatgtccatgcccaagggccgggtgctggacaagaacctggatgaggagggctttgaaagtggggactgtggagatgatgaagatgagtgcatcggcggcagcggagatggcatgatcaaggtgaagaaccagctgcgcttcctggccgagctggcctatgacctggatgtggatgatgcccctggcaacagccagcaggccacccccaaggacaatgagatcagcaccttccacaacctgggcaatgtgcacagccccctgaagctgctgacctccatggccatctctgtggtgtgcttcttcttcctggtgcactag

SEQ ID NO: 154279 - DNA, 1812 bp, Artificial Sequence
  Description of Artificial Sequence: Synthetic coding sequence
atggccggcaccgtgaggacagcctgcctggtggtggccatgctgctgagcctggacttccctggccaggcccagcccccacctcctcctccagatgccacctgccaccaggtgcgctccttcttccagaggctgcagcccggcctgaagtgggtgcctgagacccctgtgcccggcagtgacctgcaggtgtgcctgcccaagggccccacctgctgcagcaggaagatggaggagaagtaccagctgacagcccggctgaacatggagcagctgctgcagagcgcctccatggagctgaagttcctgatcatccagaatgctgctgtgttccaggaggcctttgaaattgtggtgagacatgccaagaactacaccaatgccatgttcaagaacaactaccccagcctgaccccccaggcctttgaatttgtgggggagttcttcacagatgtgtccctgtacatcctgggcagtgacatcaacgtggatgacatggtgaatgagctgtttgacagcctcttccctgtgatctacacccagctgatgaaccctggcctgcctgacagcgccctggacatcaatgaatgtctgcggggggcccggcgggacctgaaggtgtttggaaacttccccaagctgatcatgacccaggtgtccaagagcctgcaggtgacccgcatcttcctgcaggccctgaacctgggcattgaagtcatcaacaccacagaccacctgaagttcagcaaggactgtggccgcatgctgaccaggatgtggtactgcagctactgccagggcctgatgatggtgaagccctgtggcggctactgcaatgtggtgatgcagggctgcatggccggcgtggtggagattgacaagtactggagggagtacatcctgagcctggaggagctggtgaatggcatgtaccgcatctatgacatggagaatgtgctgctgggcctcttcagcaccatccatgacagcatccagtatgtgcagaagaatgctgggaagctgaccaccacagaaacagagaagaagatctggcacttcaagtaccccatcttcttcctgtgcatcggcctggacctgcagatcggcaagctgtgtgcccacagccagcagaggcagtaccgcagcgcctactacccagaagatctcttcatcgacaagaaggtgctgaaggtggcccacgtggagcacgaggagaccctgagcagcagaagaagagagctgatccagaagctgaagagcttcatctccttctacagcgccctgcccggctacatctgcagccacagccctgtggccgagaatgacaccctgtgctggaatggccaggagctggtggagcgctacagccagaaggccgccagaaatggcatgaagaaccagttcaacctgcacgagctgaagatgaagggccctgagcctgtggtgtcccagatcatcgacaagctgaagcacatcaaccagctgctgcggaccatgtccatgcccaagggccgggtgctggacaagaacctggatgaggagggctttgagagcggggactgtggagatgatgaagatgaatgtattggaggcagcggagatggcatgatcaaggtgaagaaccagctgcgcttcctggccgagctggcctatgacctggatgtggatgatgcccctggcaacagccagcaggccacccccaaggacaatgagatcagcaccttccacaacctgggcaatgtgcacagccccctgaagctgctgacctccatggccatctctgtggtgtgcttcttcttcctggtgcactag

SEQ ID NO: 154280 - DNA, 771 bp, Artificial Sequence
  Description of Artificial Sequence: Synthetic coding sequence
tgaaaaccctgtggcggctactgcaatgtggtgatgcagggctgcatggccggcgtggtggagattgacaagtactggagggagtacatcctgagcctggaggagctggtgaatggcatgtaccgcatctatgacatggagaatgtgctgctgggcctcttcagcaccatccatgacagcatccagtatgtgcagaagaatgctgggaagctgaccaccaccatcggcaagctgtgtgcccacagccagcagaggcagtacagaagtgcctactacccagaggacctcttcatcgacaagaaggtgctgaaggtggcccacgtggagcacgaggagaccctgagcagcagaagaagagagctgatccagaagctgaagagcttcatctccttctacagcgccctgcccggctacatctgcagccacagccctgtggctgaaaatgacaccctgtgctggaatggccaggagctggtggagcgctacagccagaaggccgccagaaatggcatgaagaaccagttcaacctgcacgagctgaagatgaagggccctgagcctgtggtgtcccagatcatcgacaagctgaagcacatcaaccagctgctgcggaccatgtccatgcccaagggccgggtgctggacaagaacctggatgaggagggctttgaaagtggggactgtggagatgatgaagatgagtgcatcggcggcagcggagatggcatgatcaaggtgaagaaccagctgcgcttcctggccggcaactag

SEQ ID NO: 154281 - DNA, 1581 bp, Artificial Sequence
  Description of Artificial Sequence: Synthetic coding sequence
atggccggcaccgtgaggacagcctgcctggtggtggccatgctgctgagcctggacttccctggccaggcccagcccccacctcctcctccagatgccacctgccaccaggtgcgctccttcttccagaggctgcagcccggcctgaagtgggtgcctgagacccctgtgcctgaggcctttgaaattgtggtgagacatgccaagaactacaccaatgccatgttcaagaacaactaccccagcctgaccccccaggcctttgaatttgtgggggagttcttcacagatgtgtccctgtacatcctgggcagtgacatcaacgtggatgacatggtgaatgagctgtttgacagcctcttccctgtgatctacacccagctgatgaaccctggcctgcctgacagcgccctggacatcaatgaatgtctgcggggggcccggcgggacctgaaggtgtttggaaacttccccaagctgatcatgacccaggtgtccaagagcctgcaggtgacccgcatcttcctgcaggccctgaacctgggcattgaagtcatcaacaccacagaccacctgaagttcagcaaggactgtggccgcatgctgaccaggatgtggtactgcagctactgccagggcctgatgatggtgaagccctgtggcggctactgcaatgtggtgatgcagggctgcatggccggcgtggtggagattgacaagtactggagggagtacatcctgagcctggaggagctggtgaatggcatgtaccgcatctatgacatggagaatgtgctgctgggcctcttcagcaccatccatgacagcatccagtatgtgcagaagaatgctgggaagctgaccaccaccatcggcaagctgtgtgcccacagccagcagaggcagtacagaagtgcctactacccagaggacctcttcatcgacaagaaggtgctgaaggtggcccacgtggagcacgaggagaccctgagcagcagaagaagagagctgatccagaagctgaagagcttcatctccttctacagcgccctgcccggctacatctgcagccacagccctgtggctgaaaatgacaccctgtgctggaatggccaggagctggtggagcgctacagccagaaggccgccagaaatggcatgaagaaccagttcaacctgcacgagctgaagatgaagggccctgagcctgtggtgtcccagatcatcgacaagctgaagcacatcaaccagctgctgcggaccatgtccatgcccaagggccgggtgctggacaagaacctggatgaggagggctttgaaagtggggactgtggagatgatgaagatgagtgcatcggcggcagcggagatggcatgatcaaggtgaagaaccagctgcgcttcctggccgagctggcctatgacctggatgtggatgatgcccctggcaacagccagcaggccacccccaaggacaatgagatcagcaccttccacaacctgggcaatgtgcacagccccctgaagctgctgacctccatggccatctctgtggtgtgcttcttcttcctggtgcactag

SEQ ID NO: 154282 - DNA, 1671 bp, Artificial Sequence
  Description of Artificial Sequence: Synthetic coding sequence
atggcccgcttcggcctgcctgccctgctgtgcaccctggccgtgctgtctgctgccctgctggccgctgagctgaagagcaagagctgcagcgaggtgcggcggctgtatgtgtccaagggcttcaacaagaatgatgcccccctgcacgagatcaatggagaccacctgaagatctgcccccagggcagcacctgctgcagccaggagatggaggagaagtacagcctgcagagcaaggatgacttcaagtctgtggtgtctgagcagtgcaaccacctgcaggccgtgtttgccagccgctacaagaagtttgatgagttcttcaaggagctgctggagaatgctgagaagagcctgaatgacatgtttgtgaagacctacggccacctgtacatgcagaacagcgagctgttcaaggacctgtttgtggagctgaagcgctactacgtggtgggcaatgtgaacctggaggagatgctgaatgacttctgggcccggctgctggagaggatgttccggctggtgaacagccagtaccacttcacagatgagtacctggagtgtgtgtccaagtacacagagcagctgaagccctttggagatgtgcccaggaagctgaagctgcaggtgacccgggcctttgtggccgcccggacctttgcccagggcctggccgtggccggagatgtggtgtccaaggtgtctgtggtgaaccccacagcccagtgcacccacgccctgctgaagatgatctactgcagccactgccggggcctggtgacagtgaagccctgctacaactactgcagcaacatcatgaggggctgcctggccaaccagggcgacctggactttgagtggaacaacttcattgatgccatgctgatggtggccgagcggctggagggccccttcaacatcgagagcgtgatggaccccattgatgtgaagatcagtgatgccatcatgaacatgcaggacaacagcgtgcaggtgtcccagaaggtgttccagggctgcggcccccccaagcccctgcctgctggccgcatcagccgcagcatcagcgagagcgccttcagcgcccgcttccggccccaccaccctgaggagcggcccaccacagctgctggcaccagcctggaccggctggtgacagatgtgaaggagaagctgaagcaggccaagaagttctggagcagcctgcccagcaatgtgtgcaatgatgagaggatggctgctggaaatggaaatgaagatgactgctggaatggcaagggcaagagccgctacctgtttgctgtgactggaaatggcctggccaaccagggcaacaaccctgaggtgcaggtggacaccagcaagccagacatcctgatcctgcggcagatcatggccctgcgggtgatgaccagcaagatgaagaatgcctacaatggaaatgatgtggacttctttgacatcagtgatgagagcagcggggagggcagcggcagcggctgtgagtaccagcagtgccccagcgagtttgactacaatgccacagaccatgctgggaagagcgccaatgagaaggctgacagcgctggggtgcggcctggggcccaggcctacctgctgaccgtcttctgcatcctcttcctggtgatgcagcgggagtggaggtag

SEQ ID NO: 154283 - DNA, 1461 bp, Artificial Sequence
  Description of Artificial Sequence: Synthetic coding sequence
atggaggagaagtacagcctgcagagcaaggatgacttcaagtctgtggtgtctgagcagtgcaaccacctgcaggccgtgtttgccagccgctacaagaagtttgatgagttcttcaaggagctgctggagaatgctgagaagagcctgaatgacatgtttgtgaagacctacggccacctgtacatgcagaacagcgagctgttcaaggacctgtttgtggagctgaagcgctactacgtggtgggcaatgtgaacctggaggagatgctgaatgacttctgggcccggctgctggagaggatgttccggctggtgaacagccagtaccacttcacagatgagtacctggagtgtgtgtccaagtacacagagcagctgaagccctttggagatgtgcccaggaagctgaagctgcaggtgacccgggcctttgtggccgcccggacctttgcccagggcctggccgtggccggagatgtggtgtccaaggtgtctgtggtgaaccccacagcccagtgcacccacgccctgctgaagatgatctactgcagccactgccggggcctggtgacagtgaagccctgctacaactactgcagcaacatcatgaggggctgcctggccaaccagggcgacctggactttgagtggaacaacttcattgatgccatgctgatggtggccgagcggctggagggccccttcaacatcgagagcgtgatggaccccattgatgtgaagatcagtgatgccatcatgaacatgcaggacaacagcgtgcaggtgtcccagaaggtgttccagggctgcggcccccccaagcccctgcctgctggccgcatcagccgcagcatcagcgagagcgccttcagcgcccgcttccggccccaccaccctgaggagcggcccaccacagctgctggcaccagcctggaccggctggtgacagatgtgaaggagaagctgaagcaggccaagaagttctggagcagcctgcccagcaatgtgtgcaatgatgagaggatggctgctggaaatggaaatgaagatgactgctggaatggcaagggcaagagccgctacctgtttgctgtgactggaaatggcctggccaaccagggcaacaaccctgaggtgcaggtggacaccagcaagccagacatcctgatcctgcggcagatcatggccctgcgggtgatgaccagcaagatgaagaatgcctacaatggaaatgatgtggacttctttgacatcagtgatgagagcagcggggagggcagcggcagcggctgtgagtaccagcagtgccccagcgagtttgactacaatgccacagaccatgctgggaagagcgccaatgagaaggctgacagcgctggggtgcggcctggggcccaggcctacctgctgaccgtcttctgcatcctcttcctggtgatgcagcgggagtggaggtag

SEQ ID NO: 154284 - DNA, 1653 bp, Artificial Sequence
  Description of Artificial Sequence: Synthetic coding sequence
atggcccgcttcggcctgcctgccctgctgtgcaccctggccgtgctgtctgctgccctgctggccgctgagctgaagagcaagagctgcagcgaggtgcggcggctgtatgtgtccaagggcttcaacaagaatgatgcccccctgcacgagatcaatggagaccacgaggacctgagccctggcttctacctgctgctgagcagagatggcggctacagcctgcagagcaaggatgacttcaagtctgtggtgtctgagcagtgcaaccacctgcaggccgtgtttgccagccgctacaagaagtttgatgagttcttcaaggagctgctggagaatgctgagaagagcctgaatgacatgtttgtgaagacctacggccacctgtacatgcagaacagcgagctgttcaaggacctgtttgtggagctgaagcgctactacgtggtgggcaatgtgaacctggaggagatgctgaatgacttctgggcccggctgctggagaggatgttccggctggtgaacagccagtaccacttcacagatgagtacctggagtgtgtgtccaagtacacagagcagctgaagccctttggagatgtgcccaggaagctgaagctgcaggtgacccgggcctttgtggccgcccggacctttgcccagggcctggccgtggccggagatgtggtgtccaaggtgtctgtgcccagctgcacccacgccctgctgaagatgatctactgcagccactgccggggcctggtgacagtgaagccctgctacaactactgcagcaacatcatgaggggctgcctggccaaccagggcgacctggactttgagtggaacaacttcattgatgccatgctgatggtggccgagcggctggagggccccttcaacatcgagagcgtgatggaccccattgatgtgaagatcagtgatgccatcatgaacatgcaggacaacagcgtgcaggtgtcccagaaggtgttccagggctgcggcccccccaagcccctgcctgctggccgcatcagccgcagcatcagcgagagcgccttcagcgcccgcttccggccccaccaccctgaggagcggcccaccacagctgctggcaccagcctggaccggctggtgacagatgtgaaggagaagctgaagcaggccaagaagttctggagcagcctgcccagcaatgtgtgcaatgatgagaggatggctgctggaaatggaaatgaagatgactgctggaatggcaagggcaagagccgctacctgtttgctgtgactggaaatggcctggccaaccagggcaacaaccctgaggtgcaggtggacaccagcaagccagacatcctgatcctgcggcagatcatggccctgcgggtgatgaccagcaagatgaagaatgcctacaatggaaatgatgtggacttctttgacatcagtgatgagagcagcggggagggcagcggcagcggctgtgagtaccagcagtgccccagcgagtttgactacaatgccacagaccatgctgggaagagcgccaatgagaaggctgacagcgctggggtgcggcctggggcccaggcctacctgctgaccgtcttctgcatcctcttcctggtgatgcagcgggagtggaggtag

SEQ ID NO: 154285 - DNA, 1719 bp, Artificial Sequence
  Description of Artificial Sequence: Synthetic coding sequence
atggatgcccagacctggcctgtgggcttccgctgcctgctgctgctggccctggtgggcagcgcccggtctgagggcgtgcagacctgtgaggaggtgaggaagctgttccagtggaggctgctgggcgctgtgcggggcctgcctgacagcccccgggccggccctgacctgcaggtgtgcatcagcaagaagcccacctgctgcaccaggaagatggaggagcgctaccagattgctgcccggcaggacatgcagcagttcctgcagaccagcagcagcaccctgaagttcctgatcagcagaaatgctgctgccttccaggagaccctggagaccctcatcaagcaggccgagaactacaccagcatcctcttctgcagcacctacagaaacatggccctggaggccgccgcctctgtgcaggagttcttcacagatgtgggcctgtacctgtttggagcagatgtgaaccctgaggagtttgtgaaccgcttctttgacagcctcttccccctggtgtacaaccacctgatcaaccctggggtgacagacagcagcctggagtacagcgagtgcatccgcatggccaggagagatgtgagccccttcggcaacatcccccagagggtgatgggccagatgggccgcagcctgctgcccagcaggaccttcctgcaggccctgaacctgggcattgaagtcatcaacaccacagactacctgcacttcagcaaagaatgttcccgggccctgctgaagatgcagtactgcccccactgccagggcctggccctgaccaagccctgcatgggctactgcctgaatgtgatgaggggctgcctggcccacatggccgagctgaacccccactggcacgcctacatccgcagcctggaggagctgagtgatgccatgcacggcacctatgacatcggccacgtgctgctgaacttccacctgctggtgaatgatgctgtgctgcaggcccacctgaatggccagaagctgctggagcaggtgaaccgcatctgtggccggcctgtgaggacccccacccagagcccccgctgcagctttgaccagagcaaggagaagcacggcatgaagaccaccaccaggaacagcgaggagaccctggccaacagaaggaaggagttcatcaacagcctgcggctgtaccgctccttctacggcggcctggccgaccagctgtgtgccaatgagctggccgctgctgatggcctgccctgctggaatggagaggacatcgtgaagagctacacccagagggtggtgggcaatggcatcaaggcccagagcggcaaccctgaggtgaaggtgaagggcattgatcctgtgatcaaccagatcatcgacaagctgaagcacgtggtgcagctgctgcagggccgcagccccaagccagacaagtgggagctgctgcagctgggcagcggcggcggcatggtggagcaggtgtctggggactgtgatgatgaagatggctgcggcggcagcggcagcggggaggtgaagaggaccctgaagatcacagactggatgccagatgacatgaacttcagtgatgtgaagcagatccaccagacagacaccggcagcaccctggacaccaccggggccggctgtgctgtggccacagagagcatgaccttcaccctcatctctgtggtgatgctgctgcccggcatctggtag

SEQ ID NO: 154286 - DNA, 1668 bp, Artificial Sequence
  Description of Artificial Sequence: Synthetic coding sequence
atgcccagctggattggagctgtgatcctgcccctgctgggcctgctgctgagcctgcctgctggagcagatgtgaaggcccggagctgtggggaggtgcggcaggcctatggagccaagggcttcagcctggccgacatcccctaccaggagattgctggggagcacctgcgcatctgcccccaggagtacacctgctgcaccacagagatggaggacaagctgagccagcagagcaagctggagtttgagaacctggtggaggagaccagccactttgtgaggaccacctttgtgagccgccacaagaagtttgatgagttcttccgggagctgctggagaatgctgagaagagcctgaatgacatgtttgtgaggacctacggcatgctgtacatgcagaacagcgaggtgttccaggacctcttcacagagctgaagcgctactacacaggaggaaatgtgaacctggaggagatgctgaatgacttctgggcccggctgctggagaggatgttccagctgatcaacccccagtaccacttcagcgaggactacctggagtgtgtgtccaagtacacagaccagctgaagccctttggagatgtgcccaggaagctgaagatccaggtgacccgggccttcatcgccgcccggacctttgtgcagggcctgactgtgggccgggaggtggccaacagagtgtccaaggtgagccccaccccaggctgcatccgggccctgatgaagatgctgtactgcccctactgccggggcctgcccaccgtgcggccctgcaacaactactgcctgaatgtgatgaagggctgcctggccaaccaggccgacctggacacagagtggaacctcttcattgatgccatgctgctggtggccgagcggctggagggccccttcaacatcgagagcgtgatggaccccattgatgtgaagatcagcgaggccatcatgaacatgcaggagaacagcatgcaggtgtctgccaaggtgttccagggctgcggccagcccaagccagccccagccctgcggagcgcccggagcgcccctgagaacttcaacacccgcttccggccctacaaccctgaggagcggcccaccacagctgctggcaccagcctggaccggctggtgacagacatcaaggagaagctgaagctgagcaagaaggtgtggagcgccctgccctacaccatctgcaaggatgaatctgtgacagctggcaccagcaatgaggaggagtgctggaatggccacagcaaggcccgctacctgcctgagatcatgaatgatggcctgaccaaccagatcaacaaccctgaggtggatgtggacatcaccaggccagacaccttcatccggcagcagatcatggccctgcgggtgatgaccaacaagctgaagaatgcctacaatggaaatgatgtgaacttccaggacaccagtgatgagagcagcggcagcggcagcggcagcggctgcatggatgatgtgtgccccacagaatttgaatttgtgaccacagaggccccagctgtggaccctgaccggcgggaggtggacagcagcgctgcccagaggggccacagcctgctgtcctggagcctgacctgcatcgtgctggccctgcagaggctgtgcaggtag

SEQ ID NO: 154287 - DNA, 582 bp, Artificial Sequence
  Description of Artificial Sequence: Synthetic coding sequence
atgcagagcctgatgcaggcccccctgctgattgccctgggcctgctgctggccgccccagcccaggcccacctgaagaagcccagccagctgagcagcttctcctgggacaactgtgatgagggcaaggaccctgctgtgatccgcagcctgaccctggagccagaccccatcatcgtgcctggaaatgtgaccctgtctgtgatgggcagcacctctgtgcccctgagcagccccctgaaggtggacctggtgctggagaaggaggtggccggcctgtggatcaagatcccctgcacagactacatcggcagctgcacctttgagcacttctgtgatgtgctggacatgctgatccccactggagagccctgcccagagcccctgcggacctacggcctgccctgccactgccccttcaaggagggcacctacagcctgcccaagtcagaatttgtggtgcctgacctggagctgcccagctggctgaccactggaaactaccgcatcgagagcgtgctgagcagcagcggcaagaggctgggctgcatcaagattgctgccagcctgaagggcatctag

SEQ ID NO: 154288 - DNA, 1140 bp, Artificial Sequence
  Description of Artificial Sequence: Synthetic coding sequence
atgggctgcctgggcaacagcaagacagaggaccagagaaatgaggagaaggcccagcgggaggccaacaagaagattgagaagcagctgcagaaggacaagcaggtgtaccgggccacccaccggctgctgctgctgggcgctggggagagcggcaagagcaccatcgtgaagcagatgaggatcctgcacgtgaatggcttcaatggagatgagaaggccaccaaggtgcaggacatcaagaacaacctgaaggaggccatcgagaccatcgtggccgccatgagcaacctggtgccccctgtggagctggccaaccctgagaaccagttccgggtggactacatcctgtctgtgatgaatgtgcctgactttgacttccccccagagttctatgagcacgccaaggccctgtgggaggatgaaggagtgcgggcctgctatgaaagaagcaatgagtaccagctgattgactgtgcccagtacttcctggacaagattgatgtgatcaagcaggccgactatgtgcccagcgaccaggacctgctgcgctgccgggtgctgaccagcggcatctttgagaccaagttccaggtggacaaggtgaacttccacatgtttgatgtgggcggccagagagatgagaggaggaagtggatccagtgcttcaatgatgtgacagccatcatctttgtggtggccagcagcagctacaacatggtgatccgggaggacaaccagaccaaccggctgcaggaggccctgaacctcttcaagagcatctggaacaaccgctggctgcggaccatcagcgtcatcctcttcctgaacaagcaggacctgctggccgagaaggtgctggccggcaagagcaagattgaggactacttccctgagtttgcccgctacaccaccccagaagatgccaccccagagcctggagaggacccccgggtgacccgggccaagtacttcatcagagatgagttcctgcgcatcagcacagccagcggagatggccgccactactgctacccccacttcacctgtgctgtggacacagagaacatccggcgggtcttcaatgactgccgggacatcatccagaggatgcacctgcggcagtatgagctgctgtag

SEQ ID NO: 154289 - DNA, 1143 bp, Artificial Sequence
  Description of Artificial Sequence: Synthetic coding sequence
atgggctgcctgggcaacagcaagacagaggaccagagaaatgaggagaaggcccagcgggaggccaacaagaagattgagaagcagctgcagaaggacaagcaggtgtaccgggccacccaccggctgctgctgctgggcgctggggagagcggcaagagcaccatcgtgaagcagatgaggatcctgcacgtgaatggcttcaatggagacagcgagaaggccaccaaggtgcaggacatcaagaacaacctgaaggaggccatcgagaccatcgtggccgccatgagcaacctggtgccccctgtggagctggccaaccctgagaaccagttccgggtggactacatcctgtctgtgatgaatgtgcctgactttgacttccccccagagttctatgaacatgccaaggccctgtgggaggatgagggcgtgcgggcctgctatgaaagaagcaatgagtaccagctgattgactgtgcccagtacttcctggacaagattgatgtgatcaagcaggccgactatgtgcccagcgaccaggacctgctgcgctgccgggtgctgaccagcggcatctttgagaccaagttccaggtggacaaggtgaacttccacatgtttgatgtgggcggccagagagatgaaagaaggaagtggatccagtgcttcaatgatgtgacagccatcatctttgtggtggccagcagcagctacaacatggtgatccgggaggacaaccagaccaaccggctgcaggaggccctgaacctcttcaagagcatctggaacaaccgctggctgcggaccatcagcgtcatcctcttcctgaacaagcaggacctgctggccgagaaggtgctggccggcaagagcaagattgaggactacttccctgagtttgcccgctacaccaccccagaagatgccaccccagagcccggggaggacccccgggtgacccgggccaagtacttcatcagagatgagttcctgcgcatcagcacagccagcggagatggccgccactactgctacccccacttcacctgtgctgtggacacagagaacatcagaagagtcttcaatgactgccgggacatcatccagaggatgcacctgcggcagtatgagctgctgtag

SEQ ID NO: 154290 - DNA, 738 bp, Artificial Sequence
  Description of Artificial Sequence: Synthetic coding sequence
atggacagaagaagccgggcccagcagtggaggcgggcccggcacaactacaatgacctgtgcccccccatcggccggcgggccgccacagccctgctgtggctgagctgcagcatcgccctgctgcgggccctggccaccagcaatgcccgggcccagcagagagctgctgcccagcagaggaggagcttcctgaatgcccaccacaggtctggggcccaggtgtttcctgagagccctgagagcgagagtgaccacgagcacgaggaggccgacctggagctgagcctgcctgaatgtctggagtatgaggaggagtttgattatgaaacagaaagtgaaacagaaagtgaaattgaaagtgaaacagactttgaaacagagcctgagacagcccccaccacagagcctgagacagagccagaagatgaccggggccctgtggtgcccaagcacagcaccttcggccagagcctgacccagaggctgcacgccctgaagctgcggagcccagatgccagccccagccgggccccacccagcacccaggagccccagagcccccgggagggggaggagctgaagccagaggacaaggacccccgggaccctgaggagagcaaggagcccaaggaggagaagcagaggcggcgctgcaagcccaagaagcccaccaggagagatgccagccctgagagccccagcaagaagggccccatccccatcagaagacactag

SEQ ID NO: 154291 - DNA, 1188 bp, Artificial Sequence
  Description of Artificial Sequence: Synthetic coding sequence
atgggctgcctgggcaacagcaagacagaggaccagagaaatgaggagaaggcccagcgggaggccaacaagaagattgagaagcagctgcagaaggacaagcaggtgtaccgggccacccaccggctgctgctgctgggcgctggggagagcggcaagagcaccatcgtgaagcagatgaggatcctgcacgtgaatggcttcaatggagagggcggggaggaggacccccaggccgcccggagcaacagtgatggcagcgagaaggccaccaaggtgcaggacatcaagaacaacctgaaggaggccatcgagaccatcgtggccgccatgagcaacctggtgccccctgtggagctggccaaccctgagaaccagttccgggtggactacatcctgtctgtgatgaatgtgcctgactttgacttccccccagagttctatgagcacgccaaggccctgtgggaggatgaaggagtgcgggcctgctatgaaagaagcaatgagtaccagctgattgactgtgcccagtacttcctggacaagattgatgtgatcaagcaggccgactatgtgcccagcgaccaggacctgctgcgctgccgggtgctgaccagcggcatctttgagaccaagttccaggtggacaaggtgaacttccacatgtttgatgtgggcggccagagagatgagaggaggaagtggatccagtgcttcaatgatgtgacagccatcatctttgtggtggccagcagcagctacaacatggtgatccgggaggacaaccagaccaaccggctgcaggaggccctgaacctcttcaagagcatctggaacaaccgctggctgcggaccatcagcgtcatcctcttcctgaacaagcaggacctgctggccgagaaggtgctggccggcaagagcaagattgaggactacttccctgagtttgcccgctacaccaccccagaagatgccaccccagagcctggagaggacccccgggtgacccgggccaagtacttcatcagagatgagttcctgcgcatcagcacagccagcggagatggccgccactactgctacccccacttcacctgtgctgtggacacagagaacatccggcgggtcttcaatgactgccgggacatcatccagaggatgcacctgcggcagtatgagctgctgtag

SEQ ID NO: 154292 - DNA, 738 bp, Artificial Sequence; identical to SEQ ID NO: 154290
  Description of Artificial Sequence: Synthetic coding sequence

SEQ ID NO: 154293 - DNA, 483 bp, Artificial Sequence
  Description of Artificial Sequence: Synthetic coding sequence
atgggctgcctgggcaacagcaagacagaggaccagagaaatgaggagaaggcccagcgggaggccaacaaggaggacaaccagaccaaccggctgcaggaggccctgaacctcttcaagagcatctggaacaaccgctggctgcggaccatcagcgtcatcctcttcctgaacaagcaggacctgctggccgagaaggtgctggccggcaagagcaagattgaggactacttccctgagtttgcccgctacaccaccccagaagatgccaccccagagcccggggaggacccccgggtgacccgggccaagtacttcatcagagatgagttcctgcgcatcagcacagccagcggagatggccgccactactgctacccccacttcacctgtgctgtggacacagagaacatcagaagagtcttcaatgactgccgggacatcatccagaggatgcacctgcggcagtatgagctgctgtag

SEQ ID NO: 154294 - DNA, 1185 bp, Artificial Sequence
  Description of Artificial Sequence: Synthetic coding sequence
atgggctgcctgggcaacagcaagacagaggaccagagaaatgaggagaaggcccagcgggaggccaacaagaagattgagaagcagctgcagaaggacaagcaggtgtaccgggccacccaccggctgctgctgctgggcgctggggagagcggcaagagcaccatcgtgaagcagatgaggatcctgcacgtgaatggcttcaatggagagggcggggaggaggacccccaggccgcccggagcaacagtgatggagagaaggccaccaaggtgcaggacatcaagaacaacctgaaggaggccatcgagaccatcgtggccgccatgagcaacctggtgccccctgtggagctggccaaccctgagaaccagttccgggtggactacatcctgtctgtgatgaatgtgcctgactttgacttccccccagagttctatgaacatgccaaggccctgtgggaggatgagggcgtgcgggcctgctatgaaagaagcaatgagtaccagctgattgactgtgcccagtacttcctggacaagattgatgtgatcaagcaggccgactatgtgcccagcgaccaggacctgctgcgctgccgggtgctgaccagcggcatctttgagaccaagttccaggtggacaaggtgaacttccacatgtttgatgtgggcggccagagagatgaaagaaggaagtggatccagtgcttcaatgatgtgacagccatcatctttgtggtggccagcagcagctacaacatggtgatccgggaggacaaccagaccaaccggctgcaggaggccctgaacctcttcaagagcatctggaacaaccgctggctgcggaccatcagcgtcatcctcttcctgaacaagcaggacctgctggccgagaaggtgctggccggcaagagcaagattgaggactacttccctgagtttgcccgctacaccaccccagaagatgccaccccagagcccggggaggacccccgggtgacccgggccaagtacttcatcagagatgagttcctgcgcatcagcacagccagcggagatggccgccactactgctacccccacttcacctgtgctgtggacacagagaacatcagaagagtcttcaatgactgccgggacatcatccagaggatgcacctgcggcagtatgagctgctgtag

SEQ ID NO: 154295 - DNA, 1143 bp, Artificial Sequence; identical to SEQ ID NO: 154289
  Description of Artificial Sequence: Synthetic coding sequence

SEQ ID NO: 154296 - DNA, 738 bp, Artificial Sequence; identical to SEQ ID NO: 154290
  Description of Artificial Sequence: Synthetic coding sequence

SEQ ID NO: 154297 - DNA, 3114 bp, Artificial Sequence
  Description of Artificial Sequence: Synthetic coding sequence
atgggcgtgaggaactgcctgtatggcaacaacatgagcggccagagggacatccccccagagatcggggagcagcctgagcagccccccctggaggcccctggagctgctgcccctggagctggccccagccctgctgaggagatggagacagagcccccccacaatgagcccatccctgtggagaatgatggagaggcctgtggccccccagaggtgtcccggcccaacttccaggtgctgaacccagccttccgggaggccggggcccacggcagctacagccccccacctgaggaggccatgccctttgaggccgagcagcccagcctgggcggcttctggcccaccctggagcagcccggcttccccagcggcgtgcatgctggcctggaggccttcggccctgccctgatggagcccggggccttcagcggggcccggcccggcctgggcggctacagccccccacctgaggaggccatgccctttgaatttgaccagcctgcccagaggggctgcagccagctgctgctgcaggtgcctgacctggcccctgggggccctggagctgctggggtgcctggggcccctcctgaggagccccaggccctgcggcctgccaaggccggcagccggggcggctacagccccccacctgaggagaccatgccctttgagctggatggagagggctttggagatgacagccccccacctggcctgagcagggtcatcgcccaggtggatggcagcagccagtttgctgctgtggccgccagcagcgctgtgcggctgaccccagctgccaatgccccacccctgtgggtgcctggggccatcggcagccccagccaggaggccgtgcggccccccagcaacttcaccggcagcagcccctggatggagatcagcggccccccatttgaaattggcagcgccccagctggggtggatgacacccctgtgaacatggacagcccccccatcgccctggatggcccccccatcaaggtgtctggggccccagacaagcgggagagagctgagcggccccctgtggaggaggaggccgctgagatggagggcgctgctgatgctgctgagggcggcaaggtgcccagccctggctacggcagccctgctgctggagctgccagcgctgacacagctgcccgggccgccccagctgccccagctgaccctgacagcggggccaccccagaagatcctgattctggaacagccccagctgaccctgacagcggggcctttgctgctgaccctgattctggagctgccccagctgccccagctgaccctgattctggagctgccccagatgccccagctgaccctgattctggagctgccccagatgccccagctgaccctgatgctggagctgcccctgaggccccagctgccccagctgctgctgagacccgggccgcccacgtggccccagctgccccagatgctggggcccccacagccccagctgccagcgccaccagggctgcccaggtgagaagagctgccagcgctgccccagccagcggggcccggaggaagatccacctgcggccccccagccctgagatccaggccgctgacccccccaccccccggcccacccgggccagcgcctggaggggcaagtctgagagcagccggggcagaagagtgtactatgatgagggcgtggccagcagtgatgatgacagcagtggagatgaaagtgatgatggcaccagcggctgcctgcgctggttccagcacagaagaaacagaagaagaaggaagccccagaggaacctgctgaggaacttcctggtgcaggccttcggcggctgcttcggccgctctgagagcccccagcccaaggccagccgcagcctgaaggtgaagaaggtgcccctggccgagaagaggcggcagatgaggaaggaggccctggagaagagggcccagaagagagctgagaagaagaggagcaagctgattgacaagcagctgcaggatgagaagatgggctacatgtgcacccaccggctgctgctgctgggcgctggggagagcggcaagagcaccatcgtgaagcagatgaggatcctgcacgtgaatggcttcaacggggagggcggggaggaggacccccaggccgcccggagcaacagtgatggagagaaggccaccaaggtgcaggacatcaagaacaacctgaaggaggccatcgagaccatcgtggccgccatgagcaacctggtgccccctgtggagctggccaaccctgagaaccagttccgggtggactacatcctgtctgtgatgaatgtgcctgactttgacttccccccagagttctatgagcacgccaaggccctgtgggaggatgaaggagtgcgggcctgctatgaaagaagcaatgagtaccagctgattgactgtgcccagtacttcctggacaagattgatgtgatcaagcaggccgactatgtgcccagcgaccaggacctgctgcgctgccgggtgctgaccagcggcatctttgagaccaagttccaggtggacaaggtgaacttccacatgtttgatgtgggcggccagagagatgagaggaggaagtggatccagtgcttcaatgatgtgacagccatcatctttgtggtggccagcagcagctacaacatggtgatccgggaggacaaccagaccaaccggctgcaggaggccctgaacctcttcaagagcatctggaacaaccgctggctgcggaccatcagcgtcatcctcttcctgaacaagcaggacctgctggccgagaaggtgctggccggcaagagcaagattgaggactacttccctgagtttgcccgctacaccaccccagaagatgccaccccagagcctggagaggacccccgggtgacccgggccaagtacttcatcagagatgagttcctgcgcatcagcacagccagcggagatggccgccactactgctacccccacttcacctgtgctgtggacacagagaacatccggcgggtcttcaatgactgccgggacatcatccagaggatgcacctgcggcagtatgagctgctgtag

SEQ ID NO: 154298 - DNA, 342 bp, Artificial Sequence
  Description of Artificial Sequence: Synthetic coding sequence
tgaacaacagagcctgagacagagccagaagatgaccggggccctgtggtgcccaagcacagcaccttcggccagagcctgacccagaggctgcacgccctgaagctgcggagcccagatgccagccccagccgggccccacccagcacccaggagccccagagcccccgggagggggaggagctgaagccagaggacaaggacccccgggaccctgaggagagcaaggagcccaaggaggagaagcagaggcggcgctgcaagcccaagaagcccaccaggagagatgccagccctgagagccccagcaagaagggccccatccccatcagaagacactag

SEQ ID NO: 154299 - DNA, 501 bp, Artificial Sequence
  Description of Artificial Sequence: Synthetic coding sequence
cctgagagcgagagtgaccatgaacatgaggaggccgacctggagctgagcctgcctgagtgcctggagtatgaggaggagtttgattatgaaacagagagcgagacagagagcgagattgagagcgagacagactttgaaacagagcctgagacagcccccaccacagagcctgagacagagccagaagatgaccggggccctgtggtgcccaagcacagcaccttcggccagagcctgacccagaggctgcacgccctgaagctgcggagcccagatgccagccccagccgggccccacccagcacccaggagccccagagcccccgggagggggaggagctgaagccagaggacaaggacccccgggaccctgaggagagcaaggagcccaaggaggagaagcagaggcggcgctgcaagcccaagaagcccaccaggagagatgccagccctgagagccccagcaagaagggccccatccccatccgccgccactag

SEQ ID NO: 154300 - DNA, 5580 bp, Artificial Sequence
  Description of Artificial Sequence: Synthetic coding sequence
atggtggacaagaacatctacatcatccagggcgagatcaacatcgtggtgggcgccatcaagagaaatgcccgctggagcacccacacccccctggatgaggagcgggaccccctgctgcacagctttggccacctgaaggaggtgctgaacagcatcacagagctgtctgaaattgagcccaacgtgttcctgcggcccttcctggaggtgatccgctctgaggacaccaccggccccatcaccggcctggccctgacctctgtgaacaagttcctgtcctatgccctgattgaccccacccatgagggcacagctgagggcatggagaacatggctgatgctgtgacccacgccaggtttgtgggcacagatcctgccagtgatgaggtggtgctgatgaagatcctgcaggtgctgcggaccctgctgctgacccctgtgggcgcccacctgaccaatgaatctgtgtgtgagatcatgcagagctgcttccgcatctgctttgagatgaggctgtctgagctgctgaggaagtctgctgagcacaccctggtggacatggtgcagctgctcttcacccggctgccccagttcaaggaggagcccaagaactacgtgggcaccaacatgaagaagctgaagatgagagctgggggcatgtctgacagcagcaagtggaagaagcagaagaggagcccccggccccccaggcacatgaccaaggtgaccccaggcagcgagctgcccaccccaaatggcaccaccctgagcagcaacctgaccggcggcatgcccttcattgatgtgcccacccccatcagcagcgccagcagcgaggccgccagcgctgtggtgagccccagcacagacagcggcctggagttcagcagccagaccaccagcaaggaggacctgacagacctggagcagcccggcagccctggctacagcacagccacagagcccggcagcagcgagctgggcgtgcctgagcagcctgacctgcaggagggcacccacgtggagaagagccagagcgcctctgtggagagcatccctgaggtgctggaggagtgcaccagccctgctgaccacagcgacagcgcctctgtgcatgacatggactatgtgaacccccggggcgtgcgcttcacccagagcagccagaaggagggcacagccctggtgccctacggcctgccctgcatccgggagctgttccgcttcctgatcagcctgaccaacccccatgacagacacaacagcgaggtgatgatccacatgggcctgcacctgctgactgtggccctggagagcgcccctgtggcccagtgccagaccctgctgggcctcatcaaggatgagatgtgccgccacctgttccagctgctgagcattgagcggctgaacctgtatgctgccagcctgcgggtgtgcttcctgctgtttgagagcatgagggagcacctgaagttccagatggagatgtacatcaagaagctgatggagatcatcaccgtggagaaccccaagatgccctatgagatgaaggagatggccctggaggccatcgtgcagctgtggaggatccccagctttgtgacagagctgtacatcaactatgactgtgactactactgcagcaacctgtttgaggagctgaccaagctgctgagcaagaatgccttccctgtgtctggccagctgtacaccacccacctgctgagcctggatgccctgctgactgtgattgacagcacagaggcccactgccaggccaaggtgctgaacagcctgacccagcaggagaagaaggagacagcccggcccagctgtgaaattgtggatggcacccgggaggccagcaacacagagaggacagccagtgatggcaaggctgtgggcatggccagtgacatccctggcctgcacctgcccggcggcggccgcctgcccccagagcacggcaagagcggctgcagcgacctggaggaggccgtggacagcggggctgacaagaagtttgccaggaagccaccccgcttcagctgcctgctgcctgacccccgggagctgattgagatcaagaacaagaagaagctgctgatcactggaacagagcagttcaaccagaagcccaagaagggcatccagttcctgcaggagaagggcctgctgaccatccccatggacaacacagaggtggcccagtggctgcgggagaacccccggctggacaagaagatgattggagaatttgtgtctgacaggaagaacatcgacctgctggagagctttgtgtccaccttctccttccagggcctgcggctggatgaggccctgcggctgtacctggaggccttccggctgcccggggaggcccctgtgatccagaggctgctggaggccttcacagagcgctggatgaactgcaatggcagcccctttgccaacagtgatgcctgcttcagcctggcctatgctgtgatcatgctgaacacagaccagcacaaccacaacgtgaggaagcagaatgcccccatgaccctggaggagttcaggaagaacctgaagggcgtgaatggaggcaaggactttgagcaggacatcctggaggacatgtaccacgccatcaagaatgaggagatcgtgatgcctgaggagcagacaggcctggtgcgggagaactacgtgtggaatgtgctgctgcacagaggagccaccccagagggcatcttcctgcgggtgcccacagccagctatgacctggacctcttcaccatgacctggggccccaccatcgccgccctgtcctatgtgtttgacaagagcctggaggagaccatcatccagaaggccatcagcggcttcagaaaatgtgccatgatcagcgcccactacggcctgagtgatgtgtttgacaacctgatcatcagcctgtgcaagttcaccgccctgagcagcgagagcattgagaacctgcccagcgtgtttggcagcaaccccaaggcccacatcgccgccaagacagtgttccacctggcccacagacatggagacatcctgcgggagggctggaagaacatcatggaggccatgctgcagctgttccgggcccagctgctgcccaaggccatgattgaggtggaggactttgtggaccccaacgggaagatcagcctgcagcgggaggagacccccagcaacagaggagagagcacagtgctgagctttgtgtcctggctgaccctgagcggccctgagcagagctctgtgcggggccccagcacagagaaccaggaggccaagagggtggccctggagtgcatcaagcagtgtgaccctgagaagatgatcacagagagcaagttcctgcagctggagagcctgcaggagctgatgaaggccctggtgtctgtgaccccagatgaggagacctatgatgaagaagatgctgccttctgcctggagatgctgctgagaattgtgctggagaacagagacagagtgggctgtgtgtggcagacagtgcgggaccacctgtaccacctgtgtgtgcaggcccaggacttctgcttcctggtggagagagctgtggtgggcctgctgcggctggccatccggctgctgcggcgggaggagatcagcgcccaggtgctgctgagcctgcgcatcctgctgctgatgaagcccagcgtgctgagccgggtgagccaccaggtggcctacggcctgcacgagctgctgaagaccaatgctgccaacatccacagcggagatgactgggccaccctcttcaccctgctggagtgcatcggcagcggcgtgaagcccccagctgccctgcaggccacagcccgggcagatgccccagatgctggggcccagagcgacagcgagctgcccagctaccaccagaatgatgtgtccctggaccggggctacaccagtgacagcgaggtgtacacagaccacggccggcctgggaagatccacaggtctgccacagatgctgatgtggtgaacagcggctggctggtggtgggcaaggatgatgtggacaacagcaagccaggccccagccggcccggccccagccccctcatcaaccagtacagcctgactgtgggcctggacctgggcccccatgacaccaagagcctgctgaagtgtgtggagagcctgtccttcatcgtgagagatgctgcccacatcaccccagacaactttgagctgtgtgtgaagaccctgcgcatctttgtggaggccagcctgaatggaggctgcaagagccaggagaagaggggcaagagccacaagtatgacagcaaaggaaaccgcttcaagaagaagagcaaggagggctccatgctgcggcggcccaggaccagcagccagcacgccagccggggcggccagagtgatgatgatgaagatgagggcgtgcctgccagctaccacacagtgtccctgcaggtgtcccaggacctgctggacctgatgcacaccctgcacaccagggctgccagcatctacagctcctgggccgaggagcagaggcacctggagactggaggccagaagattgaggccgacagcaggaccctgtgggcccactgctggtgccccctgctgcagggcatcgcctgcctgtgctgtgatgcccggcggcaggtgaggatgcaggccctgacctacctgcagagggccctgctggtgcatgacctgcagaagctggatgccctggagtgggagagctgcttcaacaaggtgctcttccccctgctgaccaagctgctggagaacatcagccctgcagatgtgggcggcatggaggagaccaggatgagggccagcaccctgctgagcaaggtgttcctgcagcacctgagccccctgctgagcctgagcacctttgctgccctgtggctgaccatcctggacttcatggacaagtacatgcatgctggcagcagtgacctgctgtctgaggccatccctgagagcctgaagaacatgctgctggtgatggacacagctgagatcttccacagcgcagatgcccggggcggcggccccagcgccctgtgggagatcacctgggagagaattgactgcttcctgccccacctgagagatgagctgttcaagcagaccgtcatccaggaccccatgcccatggagccccagggccagaagcccctggccagcgcccacctgaccagcgctgctggggacaccaggaccccaggccaccccccacctcctgagatccccagcgagctgggcgcctgtgactttgagaagccagagagcccccgggccgccagcagcagcagccctggcagccctgtggccagcagccccagccggctgagccccaccccagatggccccccacccctggcccagcccccactcatcctgcagcccctggccagccccctgcaggtgggcgtgccccccatgaccctgcccatcatcctgaacccagccctgattgaggccaccagccctgtgcccctgctggccaccccccggcccacagaccccatccccaccagcgaggtgaactag

SEQ ID NO: 154301 - DNA, 1749 bp, Artificial Sequence
  Description of Artificial Sequence: Synthetic coding sequence
atgggcggcagcagccctgtgaccagcaaggccatcgtggatgctgatggccgcatctacatccggaactggcagggcggcatcctgagcggcggctttgagaagaaccccaagcccatcttcacagagggcaagaaccagctggagatccagaacctgcaggaggactgggaccactttgagcccctgctgagcagcctgctgcggaggatgcctgagctggagaccctggagatcatgaagctggtgaactgcccagagaccttcaccccagacatgcgctgcatcatgggagagagccctgctgtgcagggctactttgtgctggccggcatgaacagcgctggcctgagctttggaggaggagctgggaagtacctggccgagtggatggtgcacggctaccccagtgaaaatgtgtgggagctggacctgaagagatttggagccctgcagagcagcaggaccttcctgcggcaccgggtgatggaggtgatgcccctgatgtatgacctgaaggtgccccgctgggacttccagacaggccggcagctgcggaccagccccctgtatgaccggctggatgcccagggcgcccgctggatggagaagcacggctttgagcggcccaagtactttgtgcccccagacaaggacctgctggccctggagcagagcaagaccttctacaagccagactggtttgatattgtggagagcgaggtgaagtgctgcaaggaggccgtgtgtgtgattgacatgagcagcttcaccaagtttgagatcaccagcactggagaccaggccctggaggtgctgcagtacctgttcagcaatgacctggatgtgcctgtgggccacatcgtgcacacaggcatgctgaatgaaggaggcggctatgaaaatgactgcagcatcgcccggctgaacaagaggagcttcttcatgatcagccccacagaccagcaggtgcactgctgggcctggctgaagaagcacatgcccaaggacagcaacctgctgctggaggatgtgacctggaagtacacagccctgaacctgattggccccagggctgtggatgtgctgtctgagctgtcctatgcccccatgaccccagaccacttccccagcctcttctgcaaggagatgtctgtgggctacgccaacggcatccgggtgatgtccatgacccacactggagagcccggcttcatgctgtacatccccatcgagggcatggacttcatcggcagagatgccctgctgcagcagaagcagaatggagtgtacaagaggctgaccatgttcatcctggatgaccatgacagcgacctggacctgtggccctggtggggcgagcccatctacagaaatggccagtatgtgggcaagaccaccagcagcgcctacagctacagcctggagcggcacgtgtgcctgggctttgtgcacaacttctctgaagatactggagaggagcaggtggtgacagctgacttcatcaacagaggagaatatgaaattgatattgctggctaccgcttccaggccaaggccaagctgtaccctgtggccagcctcttcacccagaagaggaggaaggatgacatggagctgagcgccttcctggccctgcccccacctccacccaacatccacagcggcctcttcttccccagccaccccagcctgtccttctcctggtggcaggaggtgtgcctgaccggccagaagcaggccccctag

SEQ ID NO: 154302 - DNA, 3540 bp, Artificial Sequence
  Description of Artificial Sequence: Synthetic coding sequence
atggccgcctgtggccgggtgcggaggatgttccggctgtctgctgccctgcacctgctgctgctgtttgctgctggagctgagaagctgcccggccagggcgtgcacagccagggccagggccctggggccaactttgtgtcctttgtgggccaggccggcggcggcggccctgctggccagcagctgccccagctgccccagagcagccagctgcagcagcagcagcagcagcagcagcagcagcagcagccccagcccccccagccccccttccctgctgggggccccccagcccggcggggcggggccggggccggcggcggctggaagctggccgaggaggagagctgccgggaggatgtgaccagggtgtgccccaagcacacctggagcaacaacctggccgtgctggagtgcctgcaggatgtgcgggagccagaaaatgagatcagcagtgactgcaaccacctgctgtggaactacaagctgaacctgaccacagaccccaagtttgagagcgtggcccgggaggtgtgcaagagcaccatcacagagatcaaggaatgtgctgatgagcctgtgggcaagggctacatggtgtcctgcctggtggaccaccggggcaacatcacagagtaccagtgccaccagtacatcaccaagatgacagccatcatcttcagtgactaccgcctcatctgtggcttcatggatgactgcaagaatgacatcaacatcctgaagtgtggcagcatccggctgggggagaaggatgcccacagccagggcgaggtggtgtcctgcctggagaagggcctggtgaaggaggccgaggagcgggagcccaagatccaggtgtctgagctgtgcaagaaggccatcctgcgggtggccgagctgagcagtgatgacttccacctggacagacacctgtactttgcctgcagagatgaccgggagcgcttctgtgagaacacccaggccggggagggccgggtgtacaagtgcctcttcaaccacaagtttgaggagagcatgtctgagaagtgccgggaggccctgaccacccggcagaagctgattgcccaggactacaaggtgtcctacagcctggccaagagctgcaagagtgacctgaagaagtaccgctgcaatgtggagaacctgcccaggagccgggaggcccggctgagctacctgctgatgtgcctggagagcgctgtgcaccggggccggcaggtgtcctctgagtgccagggcgagatgctggactacagaaggatgctgatggaggacttcagcctgagccctgagatcatcctgagctgccgcggggagattgagcaccactgcagcggcctgcacaggaagggccgcaccctgcactgcctgatgaaggtggtgcggggggagaagggcaacctgggcatgaactgccagcaggccctgcagaccctcatccaggagacagatcctggagctgactacagaattgaccgggccctgaatgaggcctgtgagagcgtcatccagacagcctgcaagcacatccgcagcggggaccccatgatcctgagctgcctgatggagcacctgtacacagagaagatggtggaggactgtgagcaccggctgctggagctgcagtacttcatcagccgggactggaagctggaccctgtgctgtacaggaagtgccagggagatgccagccggctgtgccacacccacggctggaatgagaccagcgagttcatgccccagggcgctgtgttcagctgcctgtacagacatgcctacagaacagaggagcagggccggcggctgagcagagaatgtagagctgaggtgcagaggatcctgcaccagagggccatggatgtgaagctggaccctgccctgcaggacaagtgcctgattgacctgggcaagtggtgcagcgagaagacagaaacaggccaggagctggagtgcctgcaggaccacctggatgacctggtggtggagtgccgggacatcgtgggcaacctgacagagctggagagcgaggacatccagatcgaggccctgctgatgagggcctgtgagcccatcatccagaacttctgccatgatgtggccgacaaccagattgacagcggggacctgatggagtgcctgatccagaacaagcaccagaaggacatgaatgaaaaatgtgccatcggcgtgacccacttccagctggtgcagatgaaggacttccgcttctcctacaagttcaagatggcctgcaaggaggatgtgctgaagctgtgccccaacatcaagaagaaggtggatgtggtgatctgcctgagcaccaccgtgagaaatgacaccctgcaggaggccaaggagcaccgggtgtccctgaagtgccggcggcagctgcgggtggaggagctggagatgacagaggacatccggctggagccagacctgtatgaggcctgcaagagtgacatcaagaacttctgcagcgctgtgcagtatggaaatgcccagatcatcgagtgcctgaaggagaacaagaagcagctgagcacccgctgccaccagaaggtgttcaagctgcaggagacagagatgatggaccctgagctggactacaccctgatgagggtgtgcaagcagatgatcaagcgcttctgcccagaggccgacagcaagaccatgctgcagtgcctgaagcagaacaagaacagcgagctgatggaccccaagtgcaagcagatgatcaccaagaggcagatcacccagaacacagactaccgcctgaaccccatgctgaggaaggcctgcaaggctgacatccccaagttctgccacggcatcctgaccaaggccaaggatgattctgagctggagggccaggtgatcagctgcctgaagctgcgctatgctgaccagaggctgagcagtgactgtgaggaccagatccgcatcatcatccaggagagcgccctggactaccgcctggacccccagctgcagctgcactgcagtgatgagatcagcagcctgtgtgccgaggaggccgccgcccaggagcagacaggccaggtggaggagtgcctgaaggtgaacctgctgaagatcaagacagagctgtgcaagaaggaggtgctgaacatgctgaaggagagcaaggctgacatctttgtggaccctgtgctgcacacagcctgtgccctggacatcaagcaccactgtgccgccatcaccccaggccggggccggcagatgagctgcctgatggaggccctggaggacaagagggtgcggctgcagcctgagtgcaagaagaggctgaatgaccgcatcgagatgtggagctatgctgccaaggtggccccagcagatggcttcagtgacctggccatgcaggtgatgaccagccccagcaagaactacatcctgagcgtcatcagcggcagcatctgcatcctcttcctgattggcctgatgtgtggccgcatcaccaagagggtgacccgggagctgaaggacagatag

SEQ ID NO: 154303 - DNA, 3579 bp, Artificial Sequence
  Description of Artificial Sequence: Synthetic coding sequence
atggccgcctgtggccgggtgcggaggatgttccggctgtctgctgccctgcacctgctgctgctgtttgctgctggagctgagaagctgcccggccagggcgtgcacagccagggccagggccctggggccaactttgtgtcctttgtgggccaggccggcggcggcggccctgctggccagcagctgccccagctgccccagagcagccagctgcagcagcagcagcagcagcagcagcagcagcagcagccccagcccccccagccccccttccctgctgggggccccccagcccggcggggcggggccggggccggcggcggctggaagctggccgaggaggagagctgccgggaggatgtgaccagggtgtgccccaagcacacctggagcaacaacctggccgtgctggagtgcctgcaggatgtgcgggagctgctgtggaactacaagctgaacctgaccacagaccccaagtttgaatctgtggcccgggaggtgtgcaagagcaccatcacagagatcaaggaatgtgctgatgagcctgtgggcaagggctacatggtgtcctgcctggtggaccaccggggcaacatcacagagtaccagtgccaccagtacatcaccaagatgacagccatcatcttcagtgactaccgcctcatctgtggcttcatggatgactgcaagaatgacatcaacatcctgaagtgtggcagcatccggctgggggagaaggatgcccacagccagggcgaggtggtgtcctgcctggagaagggcctggtgaaggaggccgaggagcgggagcccaagatccaggtgtctgagctgtgcaagaaggccatcctgcgggtggccgagctgagcagtgatgacttccacctggacagacacctgtactttgcctgcagagatgaccgggagcgcttctgtgagaacacccaggccggggagggccgggtgtacaagtgcctcttcaaccacaagtttgaggagagcatgtctgagaagtgccgggaggccctgaccacccggcagaagctgattgcccaggactacaaggtgtcctacagcctggccaagagctgcaagagtgacctgaagaagtaccgctgcaatgtggagaacctgcccaggagccgggaggcccggctgagctacctgctgatgtgcctggagagcgctgtgcaccggggccggcaggtgtcctctgagtgccagggcgagatgctggactacagaaggatgctgatggaggacttcagcctgagccctgagatcatcctgagctgccgcggggagattgagcaccactgcagcggcctgcacaggaaaggaagaaccctgcactgcctgatgaaggtggtgcggggggagaagggcaacctgggcatgaactgccagcaggccctgcagaccctcatccaggagacagaccccggggctgactacagaattgaccgggccctgaatgaggcctgtgagagcgtcatccagacagcctgcaagcacatccgcagcggggaccccatgatcctgagctgcctgatggagcacctgtacacagagaagatggtggaggactgtgagcaccggctgctggagctgcagtacttcatcagccgggactggaagctggaccctgtgctgtacaggaagtgccagggagatgccagccggctgtgccacacccacggctggaatgagaccagcgagttcatgccccagggcgctgtgttcagctgcctgtacagacatgcctacagaacagaggagcagggccgccgcctgagccgggagtgcagagctgaggtgcagaggatcctgcaccagagggccatggatgtgaagctggaccctgccctgcaggacaagtgcctgattgacctgggcaagtggtgcagcgagaagacagagaccggccaggagctggagtgcctgcaggaccacctggatgacctggtggtggagtgccgggacatcgtgggcaacctgacagagctggagagcgaggacatccagatcgaggccctgctgatgagggcctgtgagcccatcatccagaacttctgccatgatgtggccgacaaccagattgattctggggacctgatggagtgcctgatccagaacaagcaccagaaggacatgaatgagaagtgtgccatcggcgtgacccacttccagctggtgcagatgaaggacttccgcttctcctacaagttcaagatggcctgcaaggaggatgtgctgaagctgtgccccaacatcaagaagaaggtggatgtggtgatctgcctgagcaccaccgtgagaaatgacaccctgcaggaggccaaggagcaccgggtgtccctgaagtgccggcggcagctgcgggtggaggagctggagatgacagaggacatccggctggagccagacctgtatgaggcctgcaagagtgacatcaagaacttctgcagcgctgtgcagtatggaaatgcccagatcattgaatgtctgaaggagaacaagaagcagctgagcacccgctgccaccagaaggtgttcaagctgcaggagacagagatgatggaccctgagctggactacaccctgatgagggtgtgcaagcagatgatcaagcgcttctgcccagaggccgacagcaagaccatgctgcagtgcctgaagcagaacaagaacagcgagctgatggaccccaagtgcaagcagatgatcaccaagaggcagatcacccagaacacagactaccgcctgaaccccatgctgaggaaggcctgcaaggctgacatccccaagttctgccacggcatcctgaccaaggccaaggatgacagcgagctggagggccaggtgatcagctgcctgaagctgcgctatgctgaccagaggctgagcagtgactgtgaggaccagatccgcatcatcatccaggagagcgccctggactaccgcctggacccccagctgcagctgcactgcagtgatgagatcagcagcctgtgtgccgaggaggccgccgcccaggagcagacaggccaggtggaggagtgcctgaaggtgaacctgctgaagatcaagacagagctgtgcaagaaggaggtgctgaacatgctgaaggagagcaaggctgacatctttgtggaccctgtgctgcacacagcctgtgccctggacatcaagcaccactgtgccgccatcaccccaggccggggccggcagatgagctgcctgatggaggccctggaggacaagagggtgcggctgcagcctgagtgcaagaagaggctgaatgacagaattgagatgtggagctatgctgccaaggtggccccagcagatggcttcagtgacctggccatgcaggtgatgaccagccccagcaagaactacatcctgagcgtcatcagcggcagcatctgcatcctcttcctgattggcctgatgtgtggccgcatcaccaagagggtgacccgggagctgaaggaccggctgcagtacagaagtgagaccatggcctacaagggcctggtgtggagccaggatgtgacaggcagccctgcctag

SEQ ID NO: 154304 - DNA, 2091 bp, Artificial Sequence
  Description of Artificial Sequence: Synthetic coding sequence
atgggaaatggcatgtgcagcaggaagcagaagaggatcttccagaccctgctgctgctgactgtggtgtttggcttcctgtatggagccatgctgtactatgagctgcagacccagctgaggaaggccgaggccgtggccctgaagtaccagcagcaccaggagagcctgagcgcccagctgcaggtggtgtatgagcacaggagccggctggagaagagcctgcagaaggagcggctggagcacaagaaggccaaggaggacttcctggtgtacaagctggaggcccaggagaccctgaacaagggccggcaggacagcaacagccgctacagcgccctgaatgtgcagcaccagatgctgaagagccagcacgaggagctgaagaagcagcacagcgacctggaggaggagcacaggaagcagggcgaggacttcagcaggaccttcaatgaccacaagcagaagtacctgcagctgcagcaggagaaggagcaggagctgagcaagctgaaggagaccgtgtacaacctgcgggaggagaaccggcagctgaggaaggcccaccaggacatccacacccagctgcaggatgtgaagcagcagcacaagaacctgctgtctgagcacgagcagctggtggtgaccctggaggaccacaagagcgccctggccgccgcccagacccaggtggccgagtacaagcagctgaaggacaccctgaaccgcatccccagcctgaggaagccagaccctgctgagcagcagaatgtgacccaggtggcccacagcccccagggctacaacacagcccgggagaagcccacccgggaggtgcaggaggtgtccaggaacaatgatgtgtggcagaaccacgaggccgtgcccggccgggcagaggacaccaagctgtatgcccccacccacaaggaggccgagttccaggcccctcctgagcccatccagcaggaggtggagcggcgggagcctgaggagcaccaggtggaggaggagcacaggaaggccctggaggaggaggagatggagcaggtgggccaggccgagcacctggaggaggagcatgaccccagccctgaggagcaggaccgggagtggaaggagcagcacgagcagcgggaggccgccaacctgctggagggccacgcccgggcagaggtgtaccccagcgccaagcccatgatcaagttccagagcccctatgaggagcagctggagcagcagaggctggccgtgcagcaggtggaggaggcccagcagctgcgggagcaccaggaggccctgcaccagcagaggctgcagggccacctgctgcggcagcaggagcagcagcagcagcaggtggcccgggagatggccctgcagaggcaggccgagctggaggagggccggccccagcaccaggagcagctgcggcagcaggcccactatgatgccatggacaatgacatcgtgcagggcgctgaggaccagggcatccagggcgaggagggcgcctatgaaagagacaaccagcaccaggatgaggccgagggggaccccggcaacagacatgagccccgggagcagggcccccgggaggccgaccctgagagcgaggccgacagagctgctgtggaggacatcaacccagcagatgaccccaacaaccagggagaagatgaatttgaggaggccgagcaggtgcgggaggagaacctgcctgatgaaaatgaggagcagaagcagagcaaccagaagcaggagaacacagaggtggaggagcacctggtgatggccggcaacccagaccagcaggaggacaacgtggatgagcagtaccaggaggaggccgaggaggaggtgcaggaggacctgacagaggagaagaagcgggagctggagcacaatgctgaggagacctatggagaaaatgatgagaacacagatgacaagaacaatgatggagaggagcaggaggtgagagatgacaaccggcccaagggccgggaggagcactatgaggaggaggaggaggaggaggaggatggagctgctgtggccgagaagagccaccggcgggcagagatgtag

SEQ ID NO: 154305 - DNA, 897 bp, Artificial Sequence
  Description of Artificial Sequence: Synthetic coding sequence
atgaccagcctgacccagaggagcagcggcctggtgcagaggagaacagaggccagcagaaatgctgctgacaaggagagagctgctgggggcggggccggcagcagtgaagatgatgcccagagcagaagagatgagcaggatgatgatgacaagggggacagcaaggagacccggctgaccctgatggaggaggtgctgctgctgggcctgaaggaccgggagggctacaccagcttctggaatgactgcatcagcagcggcctgcggggctgcatgctgattgagctggccctgcggggccgcctgcagctggaggcctgtggcatgaggaggaagagcctgctgaccaggaaggtgatctgcaagagtgatgcccccactggagatgtgctgctggatgaggccctgaagcacgtgaaggagacccagcccccagagaccgtgcagaactggattgagctgctgtctggagagacctggaaccccctgaagctgcactaccagctgagaaatgtgcgggagcggctggccaagaacctggtggagaagggcgtgctgaccacagagaagcagaacttcctgctgtttgacatgaccacccaccccctgaccaacaacaacatcaagcagaggctcatcaagaaggtgcaggaggccgtgctggacaagtgggtgaatgacccccacaggatggaccggcggctgctggccctgatctacctggcccacgccagtgatgtgctggagaatgcctttgcccccctgctggatgagcagtatgacctggccaccaagagggtgcggcagctgctggacctggaccctgaggtggagtgcctgaaggccaacaccaatgaggtgctgtgggccgtggtggccgccttcaccaagtag

SEQ ID NO: 154306 - DNA, 846 bp, Artificial Sequence
  Description of Artificial Sequence: Synthetic coding sequence
atgaccagcctgacccagaggagcagcggcctggtgcagaggagaacagaggccagcagaaatgctgctgacagcagaagagatgagcaggatgatgatgacaagggggacagcaaggagacccggctgaccctgatggaggaggtgctgctgctgggcctgaaggaccgggagggctacaccagcttctggaatgactgcatcagcagcggcctgcggggctgcatgctgattgagctggccctgcggggccgcctgcagctggaggcctgtggcatgaggaggaagagcctgctgaccaggaaggtgatctgcaagagtgatgcccccactggagatgtgctgctggatgaggccctgaagcacgtgaaggagacccagcccccagagaccgtgcagaactggattgagctgctgagcggggagacctggaaccccctgaagctgcactaccagctgagaaatgtgcgggagcggctggccaagaacctggtggagaagggcgtgctgaccacagagaagcagaacttcctgctgtttgacatgaccacccaccccctgaccaacaacaacatcaagcagaggctcatcaagaaggtgcaggaggccgtgctggacaagtgggtgaatgacccccacaggatggaccggcggctgctggccctgatctacctggcccacgccagtgatgtgctggagaatgcctttgcccccctgctggatgagcagtatgacctggccaccaagagggtgcggcagctgctggacctggaccctgaggtggagtgcctgaaggccaacaccaatgaggtgctgtgggccgtggtggccgccttcaccaagtag

SEQ ID NO: 154307 - DNA, 858 bp, Artificial Sequence
  Description of Artificial Sequence: Synthetic coding sequence
atgaccaccctgacccaccgggccaggagaacagagatcagcaagaacagcgagaagaagatggagagcgaggaggacagcaactgggagaagagcccagacaatgaagacagcggggacagcaaggacatccggctgaccctgatggaggaggtgctgctgctgggcctgaaggacaaggagggctacaccagcttctggaatgactgcatcagcagcggcctgcggggcggcatcctgattgagctggccatgaggggccgcatctacctggagccccccaccatgaggaagaagaggctgctggacaggaaggtgctgctgaagagtgacagccccactggagatgtgctgctggatgagaccctgaagcacatcaaggccacagagcccacagagaccgtgcagacctggattgagctgctgactggagagacctggaaccccttcaagctgcagtaccagctgagaaatgtgcgggagagaattgccaagaacctggtggagaagggcatcctgaccacagagaagcagaacttcctgctgtttgacatgaccacccaccctgtgaccaacaccacagagaagcagaggctggtgaagaagctgcaggacagcgtgctggagcgctgggtgaatgacccccagaggatggacaagaggaccctggccctgctggtgctggcccacagcagtgatgtgctggagaatgtgttcagcagcctgacagatgacaagtatgatgtggccatgaacagagccaaggacctggtggagctggaccctgaggtggagggcaccaagcccagcgccacagagatgatctgggccgtgctggccgccttcaacaagagctag

SEQ ID NO: 154308 - DNA, 924 bp, Artificial Sequence
  Description of Artificial Sequence: Synthetic coding sequence
atgaccaccctgacccaccgggccaggagaacagagatcagcaagaacagcgagaagaagatggagagcgaggaggacagcaactgggagaagagcccagacaatgaagacagcggggacagcaaggacatccggctgaccctgatggaggaggtgctgctgctgggcctgaaggacaaggaggccaacatcaacagctggatcacccgctggctgacccctgtgatcccagccctgtggggcgctgagggctacaccagcttctggaatgactgcatcagcagcggcctgcggggcggcatcctgattgagctggccatgaggggccgcatctacctggagccccccaccatgaggaagaagaggctgctggacaggaaggtgctgctgaagagtgacagccccactggagatgtgctgctggatgagaccctgaagcacatcaaggccacagagcccacagagaccgtgcagacctggattgagctgctgactggagagacctggaaccccttcaagctgcagtaccagctgagaaatgtgcgggagagaattgccaagaacctggtggagaagggcatcctgaccacagagaagcagaacttcctgctgtttgacatgaccacccaccctgtgaccaacaccacagagaagcagaggctggtgaagaagctgcaggacagcgtgctggagcgctgggtgaatgacccccagaggatggacaagaggaccctggccctgctggtgctggcccacagcagtgatgtgctggagaatgtgttcagcagcctgacagatgacaagtatgatgtggccatgaacagagccaaggacctggtggagctggaccctgaggtggagggcaccaagcccagcgccacagagatgatctgggccgtgctggccgccttcaacaagagctag

SEQ ID NO: 154309 - DNA, 810 bp, Artificial Sequence
  Description of Artificial Sequence: Synthetic coding sequence
atgaccaccctgacccaccgggccaggagaacagagatcagcaagaacagcgagaagaagatggagagcgaggaggacagcaactgggagaagagcccagacaatgaagacagcggggacagcaaggacatccggctgaccctgatggaggaggtgctgctgctgggcctgaaggacaaggaggccaacatcaacagctggatcacccgctggctgacccctgtgatcccagccctgtggggcgctgagggctacaccagcttctggaatgactgcatcagcagcggcctgcggggcggcatcctgattgagctggccatgaggggccgcatctacctggagccccccaccatgaggaagaagaggctgctggacaggaaggtgctgctgaagagtgacagccccactggagatgtgctgctggatgagaccctgaagcacatcaaggccacagagcccacagagaccgtgcagacctggattgagctgctgactggagagacctggaaccccttcaagctgcagtaccagctgagaaatgtgcgggagagaattgccaagaacctggtggagaagggcatcctgaccacagagaagcagaacttcctgctgtttgacatgaccacccaccctgtgaccaacaccacagagaagcagaggctggtgaagaagctgcaggacagcgtgctggagcgctgggtgaatgacccccagaggatggacaagaggaccctggccctgctggtgctggcccacagcagtgatgtgctggagaatgtgttcagcagcctgacagatgacaagtactag

SEQ ID NO: 154310 - DNA, 726 bp, Artificial Sequence
  Description of Artificial Sequence: Synthetic coding sequence
atgaccaccctgacccaccgggccaggagaacagagatcagcaagaacagcgagaagaagatggagagcgaggaggacagcaactgggagaagagcccagacaatgaagacagcggggacagcaaggacatccggctgaccctgatggaggaggtgctgctgctgggcctgaaggacaaggaggtgctgctgaagagtgacagccccactggagatgtgctgctggatgagaccctgaagcacatcaaggccacagagcccacagagaccgtgcagacctggattgagctgctgactggagagacctggaaccccttcaagctgcagtaccagctgagaaatgtgcgggagagaattgccaagaacctggtggagaagggcatcctgaccacagagaagcagaacttcctgctgtttgacatgaccacccaccctgtgaccaacaccacagagaagcagaggctggtgaagaagctgcaggacagcgtgctggagcgctgggtgaatgacccccagaggatggacaagaggaccctggccctgctggtgctggcccacagcagtgatgtgctggagaatgtgttcagcagcctgacagatgacaagtatgatgtggccatgaacagagccaaggacctggtggagctggaccctgaggtggagggcaccaagcccagcgccacagagatgatctgggccgtgctggccgccttcaacaagagctag

SEQ ID NO: 154311 - DNA, 1323 bp, Artificial Sequence
  Description of Artificial Sequence: Synthetic coding sequence
atgggcctgggcgtgtctgctgagcagcctgctggaggagctgagggcttccacctgcacggcgtgcaggagaacagccctgcccagcaggccggcctggagccctactttgacttcatcatcaccatcggccacagccggctgaacaaggaaaatgacaccctgaaggccctgctgaaggccaacgtggagaagcctgtgaagctggaggtgttcaacatgaagaccatgagggtgcgggaggtggaggtggtgcccagcaacatgtggggcggccagggcctgctgggcgcctctgtgcgcttctgcagcttccggcgggccagcgagcaggtgtggcacgtgctggatgtggagcccagcagccctgctgccctggccggcctgcggccctacacagattatgtggtgggcagtgaccagatcctgcaggagagcgaggacttcttcaccctgattgagagccatgagggcaagcccctgaagctgatggtgtacaacagcaagagtgacagctgccgggaggtgacagtgaccccaaatgctgcctggggcggggagggcagcctgggctgcggcatcggctacggctacctgcaccgcatccccacccagccccccagctaccacaagaagcccccaggcaccccaccacccagcgccctgcccctgggcgcccctcctccagatgccctgcccccaggccccaccccagaggacagccccagcctggagaccggcagccggcagagcgactacatggaggccctgctgcaggcccctggcagctccatggaggaccccctgcccggccctggcagccccagccacagcgccccagaccctgatggcctgccccacttcatggagacccccctgcagcccccacctcctgtgcagagggtgatggaccccggcttcctggatgtgtctggcatcagcctgctggacaacagcaatgcctctgtgtggcccagcctgcccagcagcacagagctgaccaccacagctgtgtccaccagcggccctgaggacatctgcagcagcagcagcagccatgagcggggcggggaggccacctggagcggcagcgagtttgaggtgtccttcctggacagccctggggcccaggcccaggccgaccacctgccccagctgaccctgcctgacagcctgaccagcgctgccagcccagaagatggcctgtctgctgagctgctggaggcccaggccgaggaggagcccgccagcacagagggcctggacacaggaacagaagctgagggcctggacagccaggcccagatcagcaccacagaatag

SEQ ID NO: 154312 - DNA, 4143 bp, Artificial Sequence
  Description of Artificial Sequence: Synthetic coding sequence
atggccagcggcagagatgagaggcctccctggaggctgggccgcctgctgctgctgatgtgcctgctgctgctgggcagcagcgcccgggccgcccacatcaagaaggccgaggccaccaccaccaccaccagcgctggagctgaggccgctgagggccagtttgaccgctactaccacgaggaggagctggagagcgccctgcgggaggccgctgctgctggcctgcccggcctggcccggctcttcagcatcggccgctctgtggagggccggcccctgtgggtgctgcggctgacagctggcctgggcagcctcatcccagaaggagatgctggcccagatgctgctggcccagatgctgctggccccctgctgcccggccggccccaggtgaagctggtgggcaacatgcatggagatgaaacagtgtcccggcaggtgctgatctacctggcccgggagctggccgccggctacagaagaggagacccccggctggtgcggctgctgaacaccacagatgtgtacctgctgcccagcctgaacccagatggctttgagcgggcccgggagggggactgtggctttggagatggcggccccagcggggccagcggccgggacaacagccggggccgggacctgaacagaagcttcccagaccagttcagcactggagagcccccagccctggatgaggtgcctgaggtgcgggccctgattgagtggatcagaagaaacaagtttgtgctgagcggcaacctgcatggaggctctgtggtggccagctacccctttgatgacagccctgagcacaaggccaccggcatctacagcaagaccagtgatgatgaggtgttcaagtacctggccaaggcctatgccagcaaccaccccatcatgaagacaggagagccccactgccctggagatgaagatgagaccttcaaggatggcatcaccaatggagcccactggtatgatgtggagggcggcatgcaggactacaactacgtgtgggccaactgctttgagatcaccctggagctgagctgctgcaagtaccccccagccagccagctgcggcaggagtgggagaacaaccgggagagcctcatcaccctgattgagaaggtgcacatcggcgtgaagggctttgtgaaggacagcatcactggaagtggcctggagaatgccaccatctctgtggccggcatcaaccacaacatcaccaccggccgctttggagacttctaccgcctgctggtgcccggcacctacaacctgactgtggtgctgaccggctacatgcccctgactgtgaccaacgtggtggtgaaggagggccctgccacagaggtggacttcagcctgcggcccaccgtgaccagcgtcatcccagacaccacagaagctgtgtccacagccagcacagtggccatccccaacatcctgagcggcaccagcagcagctaccagcccatccagcccaaggacttccaccaccaccacttcccagacatggagatcttcctgcggagatttgccaatgagtaccccaacatcacccggctgtacagcctgggcaagtctgtggagagccgggagctgtatgtgatggagatcagtgacaaccctggggtgcatgagcccggggagcctgagttcaagtacatcggcaacatgcacggcaatgaggtggtgggccgggagctgctgctgaacctgattgagtacctgtgcaagaactttggaacagatcctgaggtgacagacctggtgcacaacacccgcatccacctgatgcccagcatgaacccagatggctatgagaagagccaggagggggacagcatctctgtgattggaagaaacaacagcaacaactttgacctgaacagaaacttcccagaccagtttgtgcagatcacagaccccacccagcctgagaccatcgctgtgatgtcctggatgaagagctacccctttgtgctgagcgccaacctgcatggaggcagcctggtggtgaactacccctttgatgatgatgagcagggcctggccacctacagcaagagcccagatgatgctgtgttccagcagatcgccctgagctacagcaaggagaacagccagatgttccagggccggccctgcaagaacatgtacccaaatgagtacttcccccacggcatcaccaatggagcctcctggtacaacgtgcctgggggcatgcaggactggaactacctgcagaccaactgctttgaggtgaccatcgagctgggctgtgtgaagtaccccctggagaaggagctgcccaacttctgggagcagaacagaagaagcctcatccagttcatgaagcaggtgcaccagggcgtgcggggctttgtgctggatgccacagatggccggggcatcctgaatgccaccatctctgtggccgagatcaaccaccctgtgaccacctacaagacaggagactactggaggctgctggtgcccggcacctacaagatcacagccagcgcccggggctacaaccctgtgaccaagaatgtgacagtgaagtctgagggcgccatccaggtgaacttcaccctggtgcgcagcagcacagacagcaacaatgaaagcaagaagggcaaaggagccagcagcagcaccaatgatgccagtgaccccaccaccaaggagtttgagaccctcatcaaggacctgtctgcagaaaatggcctggagagcctgatgctgcggagcagcagcaacctggccctggccctgtaccgctaccacagctacaaggacctgtctgagttcctgcggggcctggtgatgaactacccccacatcaccaacctgaccaacctgggccagagcacagagtaccgccacatctggagcctggagatcagcaacaagcccaacgtgtctgagcctgaggagcccaagatccgctttgtggccggcatccacggcaatgcccctgtgggcacagagctgctgctggccctggccgagttcctgtgcctgaactacaagaagaacccagctgtgacccagctggtggacaggacccgcatcgtcatcgtgcccagcctgaacccagatggccgggagcgggcccaggagaaggactgcaccagcaagattggccagaccaatgcccggggcaaggacctggacacagacttcaccaacaatgccagccagcctgagaccaaggccatcattgaaaatctcatccagaagcaggacttcagcctgtctgtggccctggatggcggctccatgctggtgacctacccctatgacaagcctgtgcagacagtggagaacaaggagaccctgaagcacctggccagcctgtatgccaacaaccaccccagcatgcacatgggccagcccagctgccccaacaagagtgatgagaacatccctggaggagtgatgagaggagctgagtggcacagccacctgggctccatgaaggactacagcgtgacctacggccactgcccagagatcaccgtgtacaccagctgctgctacttccccagcgctgcccggctgcccagcctgtgggccgacaacaagaggagcctgctgtccatgctggtggaggtgcacaagggcgtgcacggctttgtgaaggacaagacaggcaagcccatcagcaaggccgtcatcgtgctgaatgaaggcatcaaggtgcagaccaaggagggcggctacttccacgtgctgctggcccctggggtgcacaacatcatcgccatcgcagatggctaccagcagcagcacagccaggtgtttgtgcaccatgatgctgccagctctgtggtgattgtgtttgacacagacaaccgcatcttcggcctgccccgggagctggtggtgacagtgtctggggccaccatgtctgccctgatcctgacagcctgcatcatctggtgcatctgcagcatcaagagcaacagacacaaggatggcttccaccggctgcggcagcaccatgatgaatatgaagatgagatccgcatgatgagcacaggcagcaagaagagcctgctgagccatgagttccaggatgaaacagacacagaggaggagaccctgtacagcagcaagcactag

SEQ ID NO: 154313 - DNA, 558 bp, Artificial Sequence
  Description of Artificial Sequence: Synthetic coding sequence
atgtttgagaccatggccattgaaattgagcagctgctggcccggctgactggagtgaatgacaagatggccgagtacaccaacagcgctggggtgcccagcctgaatgctgccctgatgcacaccctgcagaggcaccgggacatcctgcaggactacacccatgagttccacaagaccaaggccaacttcatggccatccgggagcgggagaacctgatgggctctgtgaggaaggacatcgagagctacaagagcggcagcggcgtgaacaacagaagaacagagctgttcctgaaggagcatgaccacctgaggaacagcgacaggctcatcgaggagaccatcagcatcgccatggccaccaaggagaacatgaccagccagaggggcatgctgaagagcatccacagcaagatgaacaccctggccaaccgcttccctgctgtgaacagcctcatccagaggatcaacctgaggaagaggcgggacagcctcatcctgggcggcgtcatcggcatctgcaccatcctgctgctgctgtatgccttccactag

SEQ ID NO: 154314 - DNA, 525 bp, Artificial Sequence
  Description of Artificial Sequence: Synthetic coding sequence
atggctgctggcaccagcagctactgggaggacctgaggaagcaggcccggcagctggagaatgagctggacctgaagctggtgtccttcagcaagctgtgcaccagctacagccacagcagcaccagagatggccggcgggacagcagtgacaccacccccctgctgaatggcagcagccaggacaggatgtttgagaccatggccatcgagattgagcagctgctggcccggctgactggagtgaatgacaagatggccgagtacaccaacagcgctggggtgcccagcctgaatgctgccctgatgcacaccctgcagaggcaccgggacatcctgcaggactacacccatgagttccacaagaccaaggccaacttcatggccatccgggagcgggagaacctgatgggctctgtgaggaaggacatcgagagctacaagagcggcagcggcgtgaacaacagaagaacagagctgttcctgaaggagcatgaccacctgaggaagggcttccagtggtag

SEQ ID NO: 154315 - DNA, 747 bp, Artificial Sequence
  Description of Artificial Sequence: Synthetic coding sequence
atggctgctggcaccagcagctactgggaggacctgaggaagcaggcccggcagctggagaatgagctggacctgaagctggtgtccttcagcaagctgtgcaccagctacagccacagcagcaccagagatggccggcgggacagcagtgacaccacccccctgctgaatggcagcagccaggacaggatgtttgagaccatggccatcgagattgagcagctgctggcccggctgactggagtgaatgacaagatggccgagtacaccaacagcgctggggtgcccagcctgaatgctgccctgatgcacaccctgcagaggcaccgggacatcctgcaggactacacccatgagttccacaagaccaaggccaacttcatggccatccgggagcgggagaacctgatgggctctgtgaggaaggacatcgagagctacaagagcggcagcggcgtgaacaacagaagaacagagctgttcctgaaggagcatgaccacctgaggaacagcgaccggctgattgaggagaccatcagcatcgccatggccaccaaggagaacatgaccagccagaggggcatgctgaagagcatccacagcaagatgaacaccctggccaaccgcttccctgctgtgaacagcctcatccagaggatcaacctgaggaagagaagagacagcctcatcctgggcggcgtgattggcatctgcaccatcctgctgctgctgtatgccttccactag

SEQ ID NO: 154316 - DNA, 528 bp, Artificial Sequence
  Description of Artificial Sequence: Synthetic coding sequence
atggctgctggcaccagcagctactgggaggacctgaggaagcaggcccggcagctggagaatgagctggacctgaagctggtgtccttcagcaagctgtgcaccagctacagccacagcagcaccagagatggccggcgggaccgctacagcagtgacaccacccccctgctgaatggcagcagccaggacaggatgtttgagaccatggccatcgagattgagcagctgctggcccggctgactggagtgaatgacaagatggccgagtacaccaacagcgctggggtgcccagcctgaatgctgccctgatgcacaccctgcagaggcaccgggacatcctgcaggtgatctactgggccagagatgtgttcatcatcaccggggtgtgggtgttcttcttcaacccctgcatcggctacgtgcacatctacctgaagggccagcgggagaagtctgagaagatcaatgccatgctgaagggcctggtgctgctcttcttcggcgtgaccatcatcaagttctag

SEQ ID NO: 154317 - DNA, 558 bp, Artificial Sequence; identical to SEQ ID NO: 154313
  Description of Artificial Sequence: Synthetic coding sequence

SEQ ID NO: 154318 - DNA, 1350 bp, Artificial Sequence
  Description of Artificial Sequence: Synthetic coding sequence
atgaccagcttctacagcaccagcagctgccccctgggctgcaccatggcccctggggccagaaatgtgtttgtgagccccattgatgtgggctgccagcctgtggccgaggccaatgctgcctccatgtgcctgctggccaacgtggcccacgccaacagagtgcgggtgggcagcacccccctgggccggcccagcctgtgcctgccccccaccagccacacagcctgccccctgcccggcacctgccacatccctggcaacatcggcatctgtggggcctacggcaagaacaccctgaatggacatgagaaggagaccatgaagttcctgaatgaccggctggccaactacctggagaaggtgcggcagctggagcaggagaatgctgagctggagaccaccctgctggagaggagcaaatgtcatgagagcacagtgtgcccagactaccagagctacttccgcaccatcgaggagctgcagcagaagatcctgtgcagcaaggcagaaaatgcccggctcatcgtgcagattgacaatgccaagctggccgcagatgacttccgcatcaagctggagagcgagaggagcctgcaccagctggtggaggccgacaagtgtggcacccagaagctgctggatgatgccaccctggccaaggctgacctggaggcccagcaggagagcctgaaggaggagcagctgagcctgaagagcaaccacgagcaggaggtgaagatcctgcggagccagctgggggagaagttcagaattgagctggacatcgagcccaccatcgacctgaacagagtgctgggggagatgagggcccagtatgaggccatggtggagaccaaccaccaggatgtggagcagtggttccaggcccagagcgagggcatcagcctgcaggccatgagctgcagcgaggagctgcagtgctgccagagcgagatcctggagctgcgctgcaccgtgaatgccctggaggtggagcggcaggcccagcacaccctgaaggactgcctgcagaacagcctgtgtgaggccgaggacagatatggaacagagctggcccagatgcagagcctcatcagcaacctggaggagcagctgtctgagatccgggctgacctggagcggcagaaccaggagtaccaggtgctgctggatgtgaaggcccggctggagaatgaaattgccacctacagaaacctgctggagagcgaggactgcaagctgccctgcaacccctgcagcaccccagccagctgcaccagctgccccagctgtggccctgtgactggaggcagccccagcggccatggagcctccatgggccgctag

SEQ ID NO: 154319 - DNA, 639 bp, Artificial Sequence
  Description of Artificial Sequence: Synthetic coding sequence
atggaccccctcttccagcagacccacaagcaggtgcatgagatccagagctgcatgggccgcctggagacagctgacaagcagagcgtgcacatcgtggagaatgagatccaggccagcattgaccagatcttcagccggctggagcggctggagatcctgagcagcaaggagccccccaacaagaggcagaatgcccggctgcgggtggaccagctgaagtatgatgtgcagcacctgcagacagccctgaggaacttccagcacagaagacatgcccgggagcagcaggagcggcagcgggaggagctgctgagcaggaccttcaccaccaatgacagcgacaccaccatccccatggatgagagcctgcagttcaacagcagcctgcagaaggtgcacaacggcatggatgacctgatcctggatggccacaacatcctggatggcctgcggacccagaggctgaccctgaagggcacccagaagaagatcctggacatcgccaacatgctgggcctgagcaacacagtgatgaggctcatcgagaagagggccttccaggacaagtacttcatgattggaggcatgctgctgacctgtgtggtgatgttcctggtggtgcagtacctgacctag

SEQ ID NO: 154320 - DNA, 588 bp, Artificial Sequence
  Description of Artificial Sequence: Synthetic coding sequence
atggaccccctcttccagcagacccacaagcaggtgcatgagatccagagctgcatgggccgcctggagacagctgacaagcagagcgtgcacatcgtggagaatgagatccaggccagcattgaccagatcttcagccggctggagcggctggagatcctgagcagcaaggagccccccaacaagaggcagaatgcccggctgcgggtggaccagctgaagtatgatgtgcagcacctgcagacagccctgaggaacttccagcacagaagacatgcccgggagcagcaggagcggcagcgggaggagctgctgagcaggaccttcaccaccaatgacagcgacaccaccatccccatggatgagagcctgcagttcaacagcagcctgcagaaggtgcacaacggcatggatgacctgatcctggatggccacaacatcctggatggcctgcggacccagaggctgaccctgaaggtgggcagcctgctgggggaccgggagaaggccagctgcttcagcctcatccagcagttcagcaactgtgtgtacatcctgatcacctgcccccagatcgtcatcttctag

SEQ ID NO: 154321 - DNA, 699 bp, Artificial Sequence
  Description of Artificial Sequence: Synthetic coding sequence
atggaccccctcttccagcagacccacaagcaggtgcatgagatccagagctgcatgggccgcctggagacagctgacaagcagagcgtgcacatcgtggagaatgagatccaggccagcattgaccagatcttcagccggctggagcggctggagatcctgagcagcaaggagccccccaacaagaggcagaatgcccggctgcgggtggaccagctgaagtatgatgtgcagcacctgcagacagccctgaggaacttccagcacagaagacatgcccgggagcagcaggagcggcagcgggaggagctgctgagcaggaccttcaccaccaatgacagcgacaccaccatccccatggatgagagcctgcagttcaacagcagcctgcagaaggtgcacaacggcatggatgacctgatcctggatggccacaacatcctggatggcctgcggacccagaggctgaccctgaagggcacccagaagaagatcctggacatcgccaacatgctgggcctgagcaacacagtgatgaggctcatcgagaagagggccttccaggacaagtacttcatgattgagaccaggagccaccacgtggcccagaatggacctgagctgctgagcagccgggaccccccagccagcgccagccgctctgctggcatcatcgagttcagcgagaagatcacctag

SEQ ID NO: 154322 - DNA, 984 bp, Artificial Sequence
  Description of Artificial Sequence: Synthetic coding sequence
atggctgctgctgctgccatggccgagcaggagagcgccagaaatggaggcaggaacagaggaggagtgcagagggtggagggcaagctgcgggcctctgtggagaagggggactactatgaggcccaccagatgtaccgcaccctcttcttccgctacatgagccagagcaagcacacagaggcccgggagctgatgtacagcggggccctgctcttcttcagccacggccagcagaacagcgctgctgacctgtccatgctggtgctggagagcctggagaaggccgaggtggaggtggctgatgagctgctggagaacctggccaaggtgttcagcctgatggaccccaacagccctgagcgggtgacctttgtgtcccgggccctgaagtggagcagcggcggcagcggcaagctgggccacccccggctgcaccagctgctggccctgaccctgtggaaggagcagaactactgtgagagccgctaccacttcctgcacagcgcagatggagagggctgtgccaacatgctggtggagtacagcaccagccggggcttccgctctgaggtggacatgtttgtggcccaggccgtgctgcagttcctgtgcctgaagaacaagagcagcgcctctgtggtgttcaccacctacacccagaagcaccccagcattgaagatggccccccatttgtggagcccctgctgaacttcatctggttcctgctgctggccgtggatggcggcaagctgactgtgttcaccgtgctgtgtgagcagtaccagcccagcctgcggcgggaccccatgtacaatgagtacctggacagaattggccagctgttcttcggcgtgccccccaagcagaccagcagctatggaggcctgctgggcaacctgctgaccagcctgatgggcagcagcgagcaggaggatggagaggagagccccagtgatggcagccccatcgagctggactag

SEQ ID NO: 154323 - DNA, 1779 bp, Artificial Sequence
  Description of Artificial Sequence: Synthetic coding sequence
atggccctgcctgaggaggccaagatcaaggatgcctaccacatgctgaagaggcagggcatcgtgcagagcgacccccccatccctgtggacaggaccctcatccccagccccccaccccggcccaagaaccctgtgtttgatgatgaggagaagagcaagctgctggccaagctgctgaagagcaagaacccagatgacctgcaggaggccaacaagctgatcaagtccatggtgaaggaggatgaggcccgcatccagaaggtgaccaagaggctgcacaccctggaggaggtgaacaacaacgtgcggctgctgtctgagatgctgctgcactacagccaggaggacagcagtgatggagaccgggagctgatgaaggagctgtttgaccagtgtgagaacaagaggaggaccctcttcaagctggccagcgagacagaggacaatgacaacagcctgggggacatcctgcaggccagtgacaacctgagcagggtcatcaacagctacaagaccatcatcgagggccaggtgatcaatggagaggtggccaccctgaccctgcctgacagcgagggcaacagccagtgcagcaaccagggcaccctgattgacctggccgagctggacaccaccaacagcctgagctctgtgctggccccagcccccaccccacccagcagcggcatccccatcctgcccccaccaccccaggccagcggccccccaagaagccgcagcagcagccaggccgaggccaccctgggccccagcagcaccagcaatgccctgtcctggctggatgaggagctgctgtgcctgggcctggccgaccctgccccaaatgtgccccccaaggagagcgctggcaacagccagtggcacctgctgcagcgggagcagagcgacctggacttcttcagcccccggcccggcacagctgcctgtggggccagtgatgcccccctgctgcagcccagcgcccccagcagcagcagcagccaggcccccctgcccccacccttccctgcccctgtggtgcctgcctctgtgcctgcccccagcgctggcagcagcctcttcagcactggagtggccccagccctggcccccaaggtggagcctgctgtgcccggccaccacggcctggccctgggcaacagcgccctgcaccacctggatgccctggaccagctgctggaggaggccaaggtgaccagcggcctggtgaagcccaccaccagccccctcatccccaccaccaccccagcccggcccctgctgcccttcagcactggacctggcagccccctcttccagcccctgtccttccagagccagggcagcccccccaagggccctgagctgagcctggccagcatccacgtgcccctggagagcatcaagcccagcagcgccctgcctgtgacagcctatgacaagaatggcttccgcatcctcttccactttgccaaggagtgccccccaggccgcccagatgtgctggtggtggtggtgtccatgctgaacacagcccccctgcctgtgaagagcatcgtgctgcaggccgctgtgcccaagtccatgaaggtgaagctgcagccccccagcggcacagagctgagccccttcagccccatccagcccccagctgccatcacccaggtgatgctgctggccaaccccctgaagaagcaggtgctgtccttcctgggcaaggcctgcctgcagccctggggccaggccatcctgctgaccaccagctgcctggcctag

SEQ ID NO: 154324 - DNA, 1956 bp, Artificial Sequence
  Description of Artificial Sequence: Synthetic coding sequence
atgaagaactgtggccgccgcttccacaatgaggtgggcaagttccgcttcctgaatgaactcatcaaggtggtgagccccaagtacctgggggacagagtgtctgagaaggtgaagaccaaggtgattgagctgctgtacagctggaccatggccctgcctgaggaggccaagatcaaggatgcctaccacatgctgaagaggcagggcatcgtgcagagcgacccccccatccctgtggacaggaccctcatccccagccccccaccccggcccaagaaccctgtgtttgatgatgaggagaagagcaagctgctggccaagctgctgaagagcaagaacccagatgacctgcaggaggccaacaagctgatcaagtccatggtgaaggaggatgaggcccgcatccagaaggtgaccaagaggctgcacaccctggaggaggtgaacaacaacgtgcggctgctgtctgagatgctgctgcactacagccaggaggacagcagtgatggagaccgggagctgatgaaggagctgtttgaccagtgtgagaacaagaggaggaccctcttcaagctggccagcgagacagaggacaatgacaacagcctgggggacatcctgcaggccagtgacaacctgagcagggtcatcaacagctacaagaccatcatcgagggccaggtgatcaatggagaggtggccaccctgaccctgcctgacagcgagggcaacagccagtgcagcaaccagggcaccctgattgacctggccgagctggacaccaccaacagcctgagctctgtgctggccccagcccccaccccacccagcagcggcatccccatcctgcccccaccaccccaggccagcggccccccaagaagccgcagcagcagccaggccgaggccaccctgggccccagcagcaccagcaatgccctgtcctggctggatgaggagctgctgtgcctgggcctggccgaccctgccccaaatgtgccccccaaggagagcgctggcaacagccagtggcacctgctgcagcgggagcagagcgacctggacttcttcagcccccggcccggcacagctgcctgtggggccagtgatgcccccctgctgcagcccagcgcccccagcagcagcagcagccaggcccccctgcccccacccttccctgcccctgtggtgcctgcctctgtgcctgcccccagcgctggcagcagcctcttcagcactggagtggccccagccctggcccccaaggtggagcctgctgtgcccggccaccacggcctggccctgggcaacagcgccctgcaccacctggatgccctggaccagctgctggaggaggccaaggtgaccagcggcctggtgaagcccaccaccagccccctcatccccaccaccaccccagcccggcccctgctgcccttcagcactggacctggcagccccctcttccagcccctgtccttccagagccagggcagcccccccaagggccctgagctgagcctggccagcatccacgtgcccctggagagcatcaagcccagcagcgccctgcctgtgacagcctatgacaagaatggcttccgcatcctcttccactttgccaaggagtgccccccaggccgcccagatgtgctggtggtggtggtgtccatgctgaacacagcccccctgcctgtgaagagcatcgtgctgcaggccgctgtgcccaagtccatgaaggtgaagctgcagccccccagcggcacagagctgagccccttcagccccatccagcccccagctgccatcacccaggtgatgctgctggccaaccccctgaaggagaaggtgcggctgcgctacaagctgacctttgccctgggggagcagctgagcacagaggtgggggaggtggaccagtttcctcctgtggagcagtggggcaacctgtag

SEQ ID NO: 154325 - DNA, 1365 bp, Artificial Sequence
  Description of Artificial Sequence: Synthetic coding sequence
atgtctgctgggggcccctgcccagctgctgctgggggcggccctggaggagccagctgcagcgtgggcgcccctggaggagtgtccatgttccgctggctggaggtgctggagaaggagtttgacaaggcctttgtggatgtggacctgctgctgggggagattgatcctgaccaggccgacatcacctatgagggccggcagaagatgaccagcctgagcagctgctttgcccagctgtgccacaaggcccagagcgtgtcccagatcaaccacaagctggaggcccagctggtggacctgaagtctgagctgacagagacccaggccgagaaggtggtgctggagaaggaggtgcatgaccagctgctgcagctgcacagcatccagctgcagctgcacgccaagacaggccagagcgctgacagcggcaccatcaaggccaagctggagcgggagctggaggccaacaagaaggagaagatgaaggaggcccagctggaggccgaggtgaagctgctgaggaaagaaaatgaggccctgcggcggcacatcgctgtgctgcaggccgaggtgtatggagcccggctggccgccaagtacctggacaaggagctggccggccgggtgcagcagatccagctgctgggccgggacatgaagggccctgcccatgacaagctgtggaaccagctggaggccgagatccacctgcaccgccacaagacagtcatccgggcctgccggggcagaaatgacctgaagaggcccatgcaggcccctcctggccatgaccaggacagcctgaagaagagccagggcgtgggccccatcaggaaggtgctgctgctgaaggaggaccacgagggcctgggcatcagcatcaccggcggcaaggagcacggcgtgcccatcctgatcagcgagatccaccctggccagcctgctgacagatgtggcggcctgcacgtgggagatgccatcctggccgtgaatggagtgaacctgcgggacaccaagcacaaggaggccgtgaccatcctgagccagcagagaggagaaattgaatttgaggtggtgtatgtggcccctgaggtggacagtgatgatgaaaatgtggagtatgaagatgaaagtggccaccgctaccgcctgtacctggatgagctggagggcggcggcaaccctggggccagctgcaaggacaccagcggggagatcaaggtgctgcagggcttcaacaagaaggctgtgacagacacccatgaaaatggagacctgggcacagccagcgagacccccctggatgatggagccagcaagctggatgacctgcacaccctgtaccacaagaagagctactag

SEQ ID NO: 154326 - DNA, 1389 bp, Artificial Sequence
  Description of Artificial Sequence: Synthetic coding sequence
atgtctgctgggggcccctgcccagctgctgctgggggcggccctggaggagccagctgcagcgtgggcgcccctggaggagtgtccatgttccgctggctggaggtgctggagaaggagtttgacaaggcctttgtggatgtggacctgctgctgggggagattgatcctgaccaggccgacatcacctatgagggccggcagaagatgaccagcctgagcagctgctttgcccagctgtgccacaaggcccagagcgtgtcccagatcaaccacaagctggaggcccagctggtggacctgaagtctgagctgacagagacccaggccgagaaggtggtgctggagaaggaggtgcatgaccagctgctgcagctgcacagcatccagctgcagctgcacgccaagacaggccagagcgctgacagcggcaccatcaaggccaagctgagcggccccagcgtggaggagctggagcgggagctggaggccaacaagaaggagaagatgaaggaggcccagctggaggccgaggtgaagctgctgaggaaagaaaatgaggccctgcggcggcacatcgctgtgctgcaggccgaggtgtatggagcccggctggccgccaagtacctggacaaggagctggccggccgggtgcagcagatccagctgctgggccgggacatgaagggccctgcccatgacaagctgtggaaccagctggaggccgagatccacctgcaccgccacaagacagtcatccgggcctgccggggcagaaatgacctgaagaggcccatgcaggcccctcctggccatgaccaggacagcctgaagaagagccagggcgtgggccccatcaggaaggtgctgctgctgaaggaggaccacgagggcctgggcatcagcatcaccggcggcaaggagcacggcgtgcccatcctgatcagcgagatccaccctggccagcctgctgacagatgtggcggcctgcacgtgggagatgccatcctggccgtgaatggagtgaacctgcgggacaccaagcacaaggaggccgtgaccatcctgagccagcagagaggagaaattgaatttgaggtggtgtatgtggcccctgaggtggacagtgatgatgaaaatgtggagtatgaagatgaaagtggccaccgctaccgcctgtacctggatgagctggagggcggcggcaaccctggggccagctgcaaggacaccagcggggagatcaaggtgctgcagggcttcaacaagaaggctgtgacagacacccatgaaaatggagacctgggcacagccagcgagacccccctggatgatggagccagcaagctggatgacctgcacaccctgtaccacaagaagagctactag

SEQ ID NO: 154327 - DNA, 1389 bp, Artificial Sequence
  Description of Artificial Sequence: Synthetic coding sequence
atgtctgctgggggcccctgcccagctgctgctgggggcggccctggaggagccagctgcagcgtgggcgcccctggaggagtgtccatgttccgctggctggaggtgctggagaaggagtttgacaaggcctttgtggatgtggacctgctgctgggggagattgatcctgaccaggccgacatcacctatgagggccggcagaagatgaccagcctgagcagctgctttgcccagctgtgccacaaggcccagagcgtgtcccagatcaaccacaagctggaggcccagctggtggacctgaagtctgagctgacagagacccaggccgagaaggtggtgctggagaaggaggtgcatgaccagctgctgcagctgcacagcatccagctgcagctgcacgccaagacaggccagagcgctgacagcggcaccatcaaggccaagctggtgagccgcagcagcagcaagatggagcgggagctggaggccaacaagaaggagaagatgaaggaggcccagctggaggccgaggtgaagctgctgaggaaagaaaatgaggccctgcggcggcacatcgctgtgctgcaggccgaggtgtatggagcccggctggccgccaagtacctggacaaggagctggccggccgggtgcagcagatccagctgctgggccgggacatgaagggccctgcccatgacaagctgtggaaccagctggaggccgagatccacctgcaccgccacaagacagtcatccgggcctgccggggcagaaatgacctgaagaggcccatgcaggcccctcctggccatgaccaggacagcctgaagaagagccagggcgtgggccccatcaggaaggtgctgctgctgaaggaggaccacgagggcctgggcatcagcatcaccggcggcaaggagcacggcgtgcccatcctgatcagcgagatccaccctggccagcctgctgacagatgtggcggcctgcacgtgggagatgccatcctggccgtgaatggagtgaacctgcgggacaccaagcacaaggaggccgtgaccatcctgagccagcagagaggagaaattgaatttgaggtggtgtatgtggcccctgaggtggacagtgatgatgaaaatgtggagtatgaagatgaaagtggccaccgctaccgcctgtacctggatgagctggagggcggcggcaaccctggggccagctgcaaggacaccagcggggagatcaaggtgctgcagggcttcaacaagaaggctgtgacagacacccatgaaaatggagacctgggcacagccagcgagacccccctggatgatggagccagcaagctggatgacctgcacaccctgtaccacaagaagagctactag

SEQ ID NO: 154328 - DNA, 1659 bp, Artificial Sequence
  Description of Artificial Sequence: Synthetic coding sequence
atggagcccgccatggagcctgagaccctggaggcccgcatcaacagagccaccaaccccctgaacaaggagctggactgggccagcatcaatggcttctgtgagcagctgaatgaagattttgagggcccccccctggccacccggctgctggcccacaagatccagagcccccaggagtgggaggccatccaggccctgactgtgctggagacctgcatgaagagctgtgggaagcgcttccatgatgaggtgggcaagttccgcttcctgaatgagctgatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgaagagcagccaccctgaggacctgcgggccgccaacaagctgatcaaggagatggtgcaggaggaccagaagaggatggagaagatcagcaagagggtgaatgccatcgaggaggtgaacaacaacgtgaagctgctgacagagatggtgatgagccacagccagggcggcgctgctgctggcagcagcgaggacctgatgaaggagctgtaccagagatgtgagaggatgaggcccaccctcttccggctggccagtgacacagaagataatgatgaggccctgggcctgagtgaccccaccccacccagcggccccagcctggatggcaccggctggaacagcttccagagcagtgatgccacagagcccccagccccagccctggcccaggcccccagcatggagagccggcccccagcccagaccagcctgcctgccagcagcggcctggatgacctggacctgctgggcaagaccctgctgcagcagagcctgcccccagagagccagcaggtgcgctgggagaagcagcagcccaccccccggctgaccctgcgggacctgcagaacaagagcagcagctgcagcagccccagcagcagcgccaccagcctgctgcacacagtgtccccagagccccccaggcctccccagcagcctgtgcccacagagctgagcctggccagcatcaccgtgcccctggagagcatcaagcccagcaacatcctgcctgtgacagtgtatgaccagcacggcttccgcatcctcttccactttgcccgggaccccctgcccggccgcagtgatgtgctggtggtggtggtgtccatgctgagcacagccccccagcccatcagaaatattgtgttccagagcgctgtgcccaaggtgatgaaggtgaagctgcagcccccatctggaacagagctgcctgccttcaaccccatcgtgcaccccagcgccatcacccaggtgctgctgctggccaacccccagaaggagaaggtgcggctgcgctacaagctgaccttcaccatgggagaccagacctacaatgagatgggagatgtggaccagttccccccacctgagacctggggcagcctgtag

SEQ ID NO: 154329 - DNA, 117 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgtag

SEQ ID NO: 154330 - DNA, 1821 bp, Artificial Sequence
  Description of Artificial Sequence: Synthetic coding sequence
atggagcccgccatggagcctgagaccctggaggcccgcatcaacagagccaccaaccccctgaacaaggagctggactgggccagcatcaatggcttctgtgagcagctgaatgaagattttgagggcccccccctggccacccggctgctggcccacaagatccagagcccccaggagtgggaggccatccaggccctgacctacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgaagagcagccaccctgaggacctgcgggccgccaacaagctgatcaaggagatggtgcaggaggaccagaagaggatggagaagatcagcaagagggtgaatgccatcgaggaggtgaacaacaacgtgaagctgctgacagagatggtgatgagccacagccagggcggcgctgctgctggcagcagcgaggacctgatgaaggagctgtaccagagatgtgagaggatgaggcccaccctcttccggctggccagtgacacagaggacaatgatgaggccctggccgagatcctgcaggccaatgacaacctgacccaggtgatcaacctgtacaagcagctggtgcggggggaggaggtgaatggagatgccacagctggcagcatccctggcagcaccagcgccctgctggacctgagcggcctggacctgcccccagctggcaccacctacccagccatgcccaccaggcctggagagcaggccagccctgagcagcccagcgcctctgtgtccctgctggatgatgagctgatgagcctgggcctgagtgaccccaccccacccagcggccccagcctggatggcaccggctggaacagcttccagagcagtgatgccacagagcccccagccccagccctggcccaggcccccagcatggagagccggcccccagcccagaccagcctgcctgccagcagcggcctggatgacctggacctgctgggcaagaccctgctgcagcagagcctgcccccagagagccagcaggtgcgctgggagaagcagcagcccaccccccggctgaccctgcgggacctgcagaacaagagcagcagctgcagcagccccagcagcagcgccaccagcctgctgcacacagtgtccccagagccccccaggcctccccagcagcctgtgcccacagagctgagcctggccagcatcaccgtgcccctggagagcatcaagcccagcaacatcctgcctgtgacagtgtatgaccagcacggcttccgcatcctcttccactttgcccgggaccccctgcccggccgcagtgatgtgctggtggtggtggtgtccatgctgagcacagccccccagcccatcagaaatattgtgttccagagcgctgtgcccaaggtgatgaaggtgaagctgcagcccccatctggaacagagctgcctgccttcaaccccatcgtgcaccccagcgccatcacccaggtgctgctgctggccaacccccagaaggagaaggtgcggctgcgctacaagctgaccttcaccatgggagaccagacctacaatgagatgggagatgtggaccagttccccccacctgagacctggggcagcctgtag

SEQ ID NO: 154331 - DNA, 1920 bp, Artificial Sequence
  Description of Artificial Sequence: Synthetic coding sequence
atggagcccgccatggagcctgagaccctggaggcccgcatcaacagagccaccaaccccctgaacaaggagctggactgggccagcatcaatggcttctgtgagcagctgaatgaagattttgagggcccccccctggccacccggctgctggcccacaagatccagagcccccaggagtgggaggccatccaggccctgactgtgctggagacctgcatgaagagctgtgggaagcgcttccatgatgaggtgggcaagttccgcttcctgaatgagctgatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgaagagcagccaccctgaggacctgcgggccgccaacaagctgatcaaggagatggtgcaggaggaccagaagaggatggagaagatcagcaagagggtgaatgccatcgaggaggtgaacaacaacgtgaagctgctgacagagatggtgatgagccacagccagggcggcgctgctgctggcagcagcgaggacctgatgaaggagctgtaccagagatgtgagaggatgaggcccaccctcttccggctggccagtgacacagaagataatgatgaggccctggccgagatcctgcaggccaatgacaacctgacccaggtgatcaacctgtacaagcagctggtgcggggggaggaggtgaatggagatgccacagctggcagcatccctggcagcaccagcgccctgctggacctgagcggcctggacctgcccccagctggcaccacctacccagccatgcccaccaggcctggagagcaggccagccctgagcagcccagcgcctctgtgtccctgctggatgatgagctgatgagcctgggcctgagtgaccccaccccaccttctggccccagcctggatggcaccggctggaacagcttccagagcagtgatgccacagagcccccagccccagccctggcccaggcccccagcatggagagccggcccccagcccagaccagcctgcctgccagcagcggcctggatgacctggacctgctgggcaagaccctgctgcagcagagcctgcccccagagagccagcaggtgcgctgggagaagcagcagcccaccccccggctgaccctgcgggacctgcagaacaagagcagcagctgcagcagccccagcagcagcgccaccagcctgctgcacacagtgtccccagagcccccccggcccccccagcagcctgtgcccacagagctgagcctggccagcatcaccgtgcccctggagagcatcaagcccagcaacatcctgcctgtgacagtgtatgaccagcacggcttccgcatcctcttccactttgcccgggaccccctgcccggccgcagtgatgtgctggtggtggtggtgtccatgctgagcacagccccccagcccatccggaacatcgtgttccagagcgctgtgcccaaggtgatgaaggtgaagctgcagccccccagcggcacagagctgcctgccttcaaccccatcgtgcaccccagcgccatcacccaggtgctgctgctggccaacccccagaaggagaaggtgcggctgcgctacaagctgaccttcaccatgggagaccagacctacaatgagatgggagatgtggaccagtttcctcctcctgagacctggggcagcctgtag

SEQ ID NO: 154332 - DNA, 1971 bp, Artificial Sequence
  Description of Artificial Sequence: Synthetic coding sequence
atggagcccgccatggagcctgagaccctggaggcccgcatcaacagagccaccaaccccctgaacaaggagctggactgggccagcatcaatggcttctgtgagcagctgaatgaagattttgagggcccccccctggccacccggctgctggcccacaagatccagagcccccaggagtgggaggccatccaggccctgactgtgcggcggggggaggccaccatccggcccccaccctgtgatgacaccaaggtgctggagacctgcatgaagagctgtgggaagcgcttccatgatgaggtgggcaagttccgcttcctgaatgaactcatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgaagagcagccaccctgaggacctgcgggccgccaacaagctgatcaaggagatggtgcaggaggaccagaagaggatggagaagatcagcaagagggtgaatgccatcgaggaggtgaacaacaacgtgaagctgctgacagagatggtgatgagccacagccagggcggcgctgctgctggcagcagcgaggacctgatgaaggagctgtaccagagatgtgagaggatgaggcccaccctcttccggctggccagtgacacagaggacaatgatgaggccctggccgagatcctgcaggccaatgacaacctgacccaggtgatcaacctgtacaagcagctggtgcggggggaggaggtgaatggagatgccacagctggcagcatccctggcagcaccagcgccctgctggacctgagcggcctggacctgcccccagctggcaccacctacccagccatgcccaccaggcctggagagcaggccagccctgagcagcccagcgcctctgtgtccctgctggatgatgagctgatgagcctgggcctgagtgaccccaccccacccagcggccccagcctggatggcaccggctggaacagcttccagagcagtgatgccacagagcccccagccccagccctggcccaggcccccagcatggagagccggcccccagcccagaccagcctgcctgccagcagcggcctggatgacctggacctgctgggcaagaccctgctgcagcagagcctgcccccagagagccagcaggtgcgctgggagaagcagcagcccaccccccggctgaccctgcgggacctgcagaacaagagcagcagctgcagcagccccagcagcagcgccaccagcctgctgcacacagtgtccccagagccccccaggcctccccagcagcctgtgcccacagagctgagcctggccagcatcaccgtgcccctggagagcatcaagcccagcaacatcctgcctgtgacagtgtatgaccagcacggcttccgcatcctcttccactttgcccgggaccccctgcccggccgcagtgatgtgctggtggtggtggtgtccatgctgagcacagccccccagcccatcagaaatattgtgttccagagcgctgtgcccaaggtgatgaaggtgaagctgcagcccccatctggaacagagctgcctgccttcaaccccatcgtgcaccccagcgccatcacccaggtgctgctgctggccaacccccagaaggagaaggtgcggctgcgctacaagctgaccttcaccatgggagaccagacctacaatgagatgggagatgtggaccagttccccccacctgagacctggggcagcctgtag

SEQ ID NO: 154333 - DNA, 1701 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgaagagcagccaccctgaggacctgcgggccgccaacaagctgatcaaggagatggtgcaggaggaccagaagaggatggagaagatcagcaagagggtgaatgccatcgaggaggtgaacaacaacgtgaagctgctgacagagatggtgatgagccacagccagggcggcgctgctgctggcagcagcgaggacctgatgaaggagctgtaccagagatgtgagaggatgaggcccaccctcttccggctggccagtgacacagaggacaatgatgaggccctggccgagatcctgcaggccaatgacaacctgacccaggtgatcaacctgtacaagcagctggtgcggggggaggaggtgaatggagatgccacagctggcagcatccctggcagcaccagcgccctgctggacctgagcggcctggacctgcccccagctggcaccacctacccagccatgcccaccaggcctggagagcaggccagccctgagcagcccagcgcctctgtgtccctgctggatgatgagctgatgagcctgggcctgagtgaccccaccccacccagcggccccagcctggatggcaccggctggaacagcttccagagcagtgatgccacagagcccccagccccagccctggcccaggcccccagcatggagagccggcccccagcccagaccagcctgcctgccagcagcggcctggatgacctggacctgctgggcaagaccctgctgcagcagagcctgcccccagagagccagcaggtgcgctgggagaagcagcagcccaccccccggctgaccctgcgggacctgcagaacaagagcagcagctgcagcagccccagcagcagcgccaccagcctgctgcacacagtgtccccagagccccccaggcctccccagcagcctgtgcccacagagctgagcctggccagcatcaccgtgcccctggagagcatcaagcccagcaacatcctgcctgtgacagtgtatgaccagcacggcttccgcatcctcttccactttgcccgggaccccctgcccggccgcagtgatgtgctggtggtggtggtgtccatgctgagcacagccccccagcccatcagaaatattgtgttccagagcgctgtgcccaaggtgatgaaggtgaagctgcagcccccatctggaacagagctgcctgccttcaaccccatcgtgcaccccagcgccatcacccaggtgctgctgctggccaacccccagaaggagaaggtgcggctgcgctacaagctgaccttcaccatgggagaccagacctacaatgagatgggagatgtggaccagttccccccacctgagacctggggcagcctgtag

SEQ ID NO: 154334 - DNA, 123 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgaagaactag

SEQ ID NO: 154335 - DNA, 330 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgtag

SEQ ID NO: 154336 - DNA, 270 bp, Artificial Sequence
  Description of Artificial Sequence: Synthetic coding sequence
atggagcccgccatggagcctgagaccctggaggcccgcatcaacagagccaccaaccccctgaacaaggagctggactgggccagcatcaatggcttctgtgagcagctgaatgaagattttgagggcccccccctggccacccggctgctggcccacaagatccagagcccccaggagtgggaggccatccaggccctgactgtgcggcggggggaggccaccatccggcccccaccctgtgatgacaccaagggcggccaggactag

SEQ ID NO: 154337 - DNA, 330 bp, Artificial Sequence; identical to SEQ ID NO: 154335
  Description of Artificial Sequence: Synthetic coding sequence

SEQ ID NO: 154338 - DNA, 327 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgtag

SEQ ID NO: 154339 - DNA, 57 bp, Artificial Sequence
  Description of Artificial Sequence: Synthetic coding sequence
atgaagagctgtgggaagcgcttccatgatgaggtgggcaagttccgcttcctgtag

SEQ ID NO: 154340 - DNA, 183 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgaagaacaagatcctggagctgctgtacagctggacagtgggcctgcctgaggaggtgaagatcgcctag

SEQ ID NO: 154341 - DNA, 87 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtag

SEQ ID NO: 154342 - DNA, 741 bp, Artificial Sequence
  Description of Artificial Sequence: Synthetic coding sequence
atgaccccaggcacagccaacagagccaccaaccccctgaacaaggagctggactgggccagcatcaatggcttctgtgagcagctgaatgaagattttgagggcccccccctggccacccggctgctggcccacaagatccagagcccccaggagtgggaggccatccaggccctgactgtgctggagacctgcatgaagagctgtgggaagcgcttccatgatgaggtgggcaagttccgcttcctgaatgagctgatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggcatcgtgaagagtgaccccaagctgcctgatgacaccaccttccccctgcccccaccccggcccaagaatgtcatctttgaagatgaggagaagagcaagatgctggcccggctgctgaagagcagccaccctgaggacctgcgggccgccaacaagctgatcaaggagatggtgcaggaggaccagaagaggatggagaagatcagcaagagggtgaatgccatcgaggaggtgaacaacaacgtgaagctgctgacagagatggtgatgagccacagccagggcggcgctgctgctggcagcagcgaggacctgatgaaggagctgtaccagtag

SEQ ID NO: 154343 - DNA, 213 bp, Artificial Sequence
  Description of Artificial Sequence: Synthetic coding sequence
atgaagagctgtgggaagcgcttccatgatgaggtgggcaagttccgcttcctgaatgaactcatcaaggtggtgagccccaagtacctgggcagcaggaccagcgagaaggtgaagaacaagatcctggagctgctgtacagctggacagtgggcctgcctgaggaggtgaagattgctgaggcctaccagatgctgaagaagcagggctag

SEQ ID NO: 154344 - DNA, 2172 bp, Artificial Sequence
  Description of Artificial Sequence: Synthetic coding sequence
atggccgaggccgagggggagagcctggagagctggctgaacaaggccaccaaccccagcaaccggcaggaggactgggagtacatcatcggcttctgtgaccagatcaacaaggagctggagggcccccagattgctgtgcggctgctggcccacaagatccagagcccccaggagtgggaggccctgcaggccctgactgtgctggaggcctgcatgaagaactgtggccgccgcttccacaatgaggtgggcaagttccgcttcctgaatgaactcatcaaggtggtgagccccaagtacctgggggacagagtgtctgagaaggtgaagaccaaggtgattgagctgctgtacagctggaccatggccctgcctgaggaggccaagatcaaggatgcctaccacatgctgaagaggcagggcatcgtgcagagcgacccccccatccctgtggacaggaccctcatccccagccccccaccccggcccaagaaccctgtgtttgatgatgaggagaagagcaagctgctggccaagctgctgaagagcaagaacccagatgacctgcaggaggccaacaagctgatcaagtccatggtgaaggaggatgaggcccgcatccagaaggtgaccaagaggctgcacaccctggaggaggtgaacaacaacgtgcggctgctgtctgagatgctgctgcactacagccaggaggacagcagtgatggagaccgggagctgatgaaggagctgtttgaccagtgtgagaacaagaggaggaccctcttcaagctggccagcgagacagaggacaatgacaacagcctgggggacatcctgcaggccagtgacaacctgagcagggtcatcaacagctacaagaccatcatcgagggccaggtgatcaatggagaggtggccaccctgaccctgcctgacagcgagggcaacagccagtgcagcaaccagggcaccctgattgacctggccgagctggacaccaccaacagcctgagctctgtgctggccccagcccccaccccacccagcagcggcatccccatcctgcccccaccaccccaggccagcggccccccaagaagccgcagcagcagccaggccgaggccaccctgggccccagcagcaccagcaatgccctgtcctggctggatgaggagctgctgtgcctgggcctggccgaccctgccccaaatgtgccccccaaggagagcgctggcaacagccagtggcacctgctgcagcgggagcagagcgacctggacttcttcagcccccggcccggcacagctgcctgtggggccagtgatgcccccctgctgcagcccagcgcccccagcagcagcagcagccaggcccccctgcccccacccttccctgcccctgtggtgcctgcctctgtgcctgcccccagcgctggcagcagcctcttcagcactggagtggccccagccctggcccccaaggtggagcctgctgtgcccggccaccacggcctggccctgggcaacagcgccctgcaccacctggatgccctggaccagctgctggaggaggccaaggtgaccagcggcctggtgaagcccaccaccagccccctcatccccaccaccaccccagcccggcccctgctgcccttcagcactggacctggcagccccctcttccagcccctgtccttccagagccagggcagcccccccaagggccctgagctgagcctggccagcatccacgtgcccctggagagcatcaagcccagcagcgccctgcctgtgacagcctatgacaagaatggcttccgcatcctcttccactttgccaaggagtgccccccaggccgcccagatgtgctggtggtggtggtgtccatgctgaacacagcccccctgcctgtgaagagcatcgtgctgcaggccgctgtgcccaagtccatgaaggtgaagctgcagccccccagcggcacagagctgagccccttcagccccatccagcccccagctgccatcacccaggtgatgctgctggccaaccccctgaaggagaaggtgcggctgcgctacaagctgacctttgccctgggggagcagctgagcacagaggtgggggaggtggaccagtttcctcctgtggagcagtggggcaacctgtag

SEQ ID NO: 154345 - DNA, 2073 bp, Artificial Sequence
  Description of Artificial Sequence: Synthetic coding sequence
atggccgaggccgagggggagagcctggagagctggctgaacaaggccaccaaccccagcaaccggcaggaggactgggagtacatcatcggcttctgtgaccagatcaacaaggagctggagggcccccagattgctgtgcggctgctggcccacaagatccagagcccccaggagtgggaggccctgcaggccctgacctacctgggggacagagtgtctgagaaggtgaagaccaaggtgattgagctgctgtacagctggaccatggccctgcctgaggaggccaagatcaaggatgcctaccacatgctgaagaggcagggcatcgtgcagagcgacccccccatccctgtggacaggaccctcatccccagccccccaccccggcccaagaaccctgtgtttgatgatgaggagaagagcaagctgctggccaagctgctgaagagcaagaacccagatgacctgcaggaggccaacaagctgatcaagtccatggtgaaggaggatgaggcccgcatccagaaggtgaccaagaggctgcacaccctggaggaggtgaacaacaacgtgcggctgctgtctgagatgctgctgcactacagccaggaggacagcagtgatggagaccgggagctgatgaaggagctgtttgaccagtgtgagaacaagaggaggaccctcttcaagctggccagcgagacagaagataatgacaacagcctgggggacatcctgcaggccagtgacaacctgagcagggtcatcaacagctacaagaccatcatcgagggccaggtgatcaacggggaggtggccaccctgaccctgcctgattctgagggcaacagccagtgcagcaaccagggcaccctgattgacctggccgagctggacaccaccaacagcctgagctctgtgctggccccagcccccaccccacccagcagcggcatccccatcctgcccccaccaccccaggccagcggcccccccaggagccgcagcagcagccaggccgaggccaccctgggccccagcagcaccagcaatgccctgtcctggctggatgaggagctgctgtgcctgggcctggccgaccctgcccccaacgtgccccccaaggagagcgctggcaacagccagtggcacctgctgcagcgggagcagagcgacctggacttcttcagccccaggcctggaacagctgcctgtggggccagtgatgcccccctgctgcagcccagcgcccccagcagcagcagcagccaggcccccctgcccccacccttccctgcccctgtggtgcctgcctctgtgcctgcccccagcgctggcagcagcctcttcagcactggagtggccccagccctggcccccaaggtggagcctgctgtgcccggccaccacggcctggccctgggcaacagcgccctgcaccacctggatgccctggaccagctgctggaggaggccaaggtgaccagcggcctggtgaagcccaccaccagccccctcatccccaccaccaccccagcccggcccctgctgcccttcagcacaggccctggcagccccctcttccagcccctgtccttccagagccagggcagcccccccaagggccctgagctgagcctggccagcatccacgtgcccctggagagcatcaagcccagcagcgccctgcctgtgacagcctatgacaagaatggcttccgcatcctcttccactttgccaaggaatgtcctcctggccgcccagatgtgctggtggtggtggtgtccatgctgaacacagcccccctgcctgtgaagagcatcgtgctgcaggccgctgtgcccaagtccatgaaggtgaagctgcagcccccatctggaacagagctgagccccttcagccccatccagcccccagctgccatcacccaggtgatgctgctggccaaccccctgaaggagaaggtgcggctgcgctacaagctgacctttgccctgggggagcagctgagcacagaggtgggggaggtggaccagttcccccctgtggagcagtggggcaacctgtag

SEQ ID NO: 154346 - DNA, 1956 bp, Artificial Sequence; identical to SEQ ID NO: 154324
  Description of Artificial Sequence: Synthetic coding sequence

SEQ ID NO: 154347 - DNA, 462 bp, Artificial Sequence
  Description of Artificial Sequence: Synthetic coding sequence
atggccgaggccgagggggagagcctggagagctggctgaacaaggccaccaaccccagcaaccggcaggaggactgggagtacatcatcggcttctgtgaccagatcaacaaggagctggagggcccccagattgctgtgcggctgctggcccacaagatccagagcccccaggagtgggaggccctgcaggccctgactgtgctggaggcctgcatgaagaactgtggccgccgcttccacaatgaggtgggcaagttccgcttcctgaatgaactcatcaaggtggtgagccccaagtacctgggggacagagtgtctgagaaggtgaagaccaaggtgattgagctgctgtacagctggaccatggccctgcctgaggaggccaagatcaaggatgcctaccacatgctgaagaggcaggccttcagccaggccgctgagaagcagaagcccaggtag

SEQ ID NO: 154348 - DNA, 1806 bp, Artificial Sequence
  Description of Artificial Sequence: Synthetic coding sequence
atggccctgcctgaggaggccaagatcaaggatgcctaccacatgctgaagaggcagggcatcgtgcagagcgacccccccatccctgtggacaggaccctcatccccagccccccaccccggcccaagaaccctgtgtttgatgatgaggagaagagcaagctgctggccaagctgctgaagagcaagaacccagatgacctgcaggaggccaacaagctgatcaagtccatggtgaaggaggatgaggcccgcatccagaaggtgaccaagaggctgcacaccctggaggaggtgaacaacaacgtgcggctgctgtctgagatgctgctgcactacagccaggaggacagcagtgatggagaccgggagctgatgaaggagctgtttgaccagtgtgagaacaagaggaggaccctcttcaagctggccagcgagacagaggacaatgacaacagcctgggggacatcctgcaggccagtgacaacctgagcagggtcatcaacagctacaagaccatcatcgagggccaggtgatcaatggagaggtggccaccctgaccctgcctgacagcgagggcaacagccagtgcagcaaccagggcaccctgattgacctggccgagctggacaccaccaacagcctgagctctgtgctggccccagcccccaccccacccagcagcggcatccccatcctgcccccaccaccccaggccagcggccccccaagaagccgcagcagcagccaggccgaggccaccctgggccccagcagcaccagcaatgccctgtcctggctggatgaggagctgctgtgcctgggcctggccgaccctgccccaaatgtgccccccaaggagagcgctggcaacagccagtggcacctgctgcagcgggagcagagcgacctggacttcttcagcccccggcccggcacagctgcctgtggggccagtgatgcccccctgctgcagcccagcgcccccagcagcagcagcagccaggcccccctgcccccacccttccctgcccctgtggtgcctgcctctgtgcctgcccccagcgctggcagcagcctcttcagcactggagtggccccagccctggcccccaaggtggagcctgctgtgcccggccaccacggcctggccctgggcaacagcgccctgcaccacctggatgccctggaccagctgctggaggaggccaaggtgaccagcggcctggtgaagcccaccaccagccccctcatccccaccaccaccccagcccggcccctgctgcccttcagcactggacctggcagccccctcttccagcccctgtccttccagagccagggcagcccccccaagggccctgagctgagcctggccagcatccacgtgcccctggagagcatcaagcccagcagcgccctgcctgtgacagcctatgacaagaatggcttccgcatcctcttccactttgccaaggagtgccccccaggccgcccagatgtgctggtggtggtggtgtccatgctgaacacagcccccctgcctgtgaagagcatcgtgctgcaggccgctgtgcccaagtccatgaaggtgaagctgcagccccccagcggcacagagctgagccccttcagccccatccagcccccagctgccatcacccaggtgatgctgctggccaaccccctgaaggagaaggtgcggctgcgctacaagctgacctttgccctgggggagcagctgagcacagaggtgggggaggtggaccagtttcctcctgtggagcagtggggcaacctgtag

SEQ ID NO: 154349 - DNA, 918 bp, Artificial Sequence
  Description of Artificial Sequence: Synthetic coding sequence
atggctgctggcctggcccggctgctgctgctgctgggcctgtctgctgggggccctgccccagctggggccgccaagatgaaggtggtggaggagcccaatgccttcggcgtgaacaaccccttcctgccccaggccagccggctgcaggccaagagggaccccagccctgtgtctggccctgtgcacctgttccggctgagcggcaagtgcttcagcctggtggagagcacctacaagtatgagttctgccccttccacaacgtgacccagcacgagcagaccttccgctggaatgcctacagcggcatcctgggcatctggcatgagtgggagatcgccaacaacaccttcaccggcatgtggatgagagatggagatgcctgccgcagccgcagccggcagagcaaggtggagctggcctgtgggaagagcaaccggctggcccacgtgtctgagcccagcacctgtgtgtatgccctgacctttgagacccccctggtgtgccacccccacgccctgctggtgtaccccaccctgcctgaggccctgcagaggcagtgggaccaggtggagcaggacctggctgatgagctgatcaccccccagggccacgagaagctgctgcggaccctgtttgaagatgctggctacctgaagaccccagaggagaatgagcccacccagctggagggcggccctgacagcctgggctttgagaccctggagaactgcaggaaggcccacaaggagctgagcaaggagatcaagaggctgaagggcctgctgacccagcacggcatcccctacacccggcccacagagaccagcaacctggagcacctgggccacgagaccccccgggccaagagccctgagcagctgcggggggaccccggcctgcggggcagcctgtag

SEQ ID NO: 154350 - DNA, 4497 bp, Artificial Sequence; identical to SEQ ID NO: 146687
  Description of Artificial Sequence: Synthetic coding sequence

SEQ ID NO: 154351 - DNA, 4173 bp, Artificial Sequence
  Description of Artificial Sequence: Synthetic coding sequence
atggatggagccagcgctgagcaggacggcctgcaggaggacaggagccacagcggccccagcagcctgcctgaggcccccctgaagcccccaggccccctggtgcccccagaccagcaggacaaggtgcagtgtgccgaggtgaacagagccagcacagaaggagagagcccagatggccctggccagggcggcctgtgccagaatggccccaccccacccttcccagacccccccagcagcctggaccccaccaccagccctgtgggcccagatgccagccctggggtggccggcttccatgacaacctgaggaagagccagggcaccagcgctgagggctctgtgaggaaggaggccctgcagagcctgcggctgagcctgcccatgcaggagacccagctgtgcagcacagacagccccctgcccctggagaaggaggagcaggtgcggctgcaggccaggaagtggctggaggagcagctgaagcagtacagagtgaagaggcagcaggagaggagcagccagcctgccaccaagaccaggctcttcagcaccctggaccctgagctgatgctgaaccctgagaacctgccccgggccagcaccctggccatgaccaaggagtacagcttcctgcggacctctgtgccccggggccccaaggtgggcagcctgggcctgcctgcccacccccgggagaagaagaccagcaagagcagcaagatccgcagcctggccgactacagaacagaggacagcaatgccggcaacagcggcggcaatgtgcctgccccagacagcaccaagggcagcctgaagcagaacagaagcagcgctgcctctgtggtgtctgagatcagcctgagcccagacacagatgaccggctggagaacaccagcctggccggggacagcgtgtctgaggtggatggaaatgacagcgacagcagcagctacagcagcgccagcacccggggcacctacggcatcctgagcaagacagtgggcacccaggacaccccctacatggtgaatggccaggagatcccagctgacaccctgggccagttccccagcatcaaggatgtgctgcaggccgctgctgctgagcaccaggaccagggccaggaggtgaatggagaggtgcgcagccggcgggacagcatctgcagctctgtgtccctggagagcagcgctgctgagacccaggaggagatgctgcaggtgctgaaggagaagatgaggctggagggccagctggaggccctgagcctggaggccagccaggccctgaaggagaaggccgagctgcaggcccagctggccgccctgagcaccaagctgcaggcccaggtggagtgcagccacagcagccagcagaggcaggacagcctgagcagcgaggtggacaccctgaagcagagctgctgggacctggagcgggccatgacagacctgcagaacatgctggaggccaagaatgccagcctggccagcagcaacaatgacctgcaggtggccgaggagcagtaccagaggctgatggccaaggtggaggacatgcagaggtccatgctgagcaaggacaacacagtgcatgacctgcggcagcagatgacagccctgcagagccagctgcagcaggtgcagctggagaggaccaccctgaccagcaagctgaaggccagccaggccgagatcagcagcctgcagagcgtgcggcagtggtaccagcagcagctggccctggcccaggaggcccgggtgcggctgcagggcgagatggcccacatccaggtgggccagatgacccaggccggcctgctggagcacctgaagctggagaatgtgtccctgagccagcagctgacagagacccagcaccgctccatgaaggagaagggcagaattgctgcccagctgcagggcattgaagctgacatgctggaccaggaggccgccttcatgcagatccaggaggccaagaccatggtggaggaggacctgcagaggcggctggaggagtttgaaggagagcgggagcggctgcagaggatggctgacagcgctgccagcctggagcagcagctggagcaggtgaagctgaccctgctgcagagggaccagcagctggaggccctgcagcaggagcacctggacctgatgaagcagctgaccctgacccaggaggccctgcagagccgggagcagagcctggatgccctgcagacccactatgatgagctgcaggcccggctgggggagctgcagggcgaggccgccagccgggaggacaccatctgcctgctgcagaatgagaagatcatcctggaggccgccctgcaggccgccaagagcggcaaggaggagctggacagaggagcccggcggctggaggagggcacagaggagaccagcgagaccctggagaagctgcgggaggagctggccatcaagagcggccaggtggagcacctgcagcaggagacagctgccctgaagaagcagatgcagaagatcaaggagcagttcctgcagcagaaggtgatggtggaggcctacagaagagatgccaccagcaaggaccagctgatcagcgagctgaaggccaccaggaagaggctggacagcgagctgaaggagctgcggcaggagctgatgcaggtgcatggagagaagaggacagctgaggccgagctgagccggctgcaccgggaggtggcccaggtgcggcagcacatggctgacctggagggccacctgcagagcgcccagaaggagagagatgagatggagacccacctgcagagcctgcagtttgacaaggagcagatggtggccgtgacagaggccaatgaggccctgaagaagcagatcgaggagctgcagcaggaggccaggaaggccatcacagagcagaagcagaagatgaggcggctgggcagtgacctgaccagcgcccagaaggagatgaagaccaagcacaaggcctatgaaaatgctgtgggcatcctgagccggcggctgcaggaggccctggccgccaaggaggccgcagatgctgagctgggccagctgcgggcccagggcggcagcagtgacagcagcctggccctgcacgagcgcatccaggccctggaggccgagctgcaggccgtgagccacagcaagaccctgctggagaaggagctgcaggaggtgattgccctgaccagccaggagctggaggagagccgggagaaggtgctggagctggaggatgagctgcaggagagccggggcttcaggaagaagatcaagaggctggaggagagcaacaagaagctggccctggagctggagcacgagaagggcaagctgaccggcctgggccagagcaatgctgccctgcgggagcacaacagcatcctggagacagccctggccaagcgggaggccgacctggtgcagctgaacctgcaggtgcaggccgtgctgcagaggaaggaggaggaggaccggcagatgaagcacctggtgcaggccctgcaggccagcctggagaaggagaaggagaaggtgaacagcctgaaggagcaggtggccgccgccaaggtggaggccggccacaacagaagacacttcaaggccgccagcctggagctgtctgaggtgaagaaggagctgcaggccaaggagcacctggtgcagaagctgcaggccgaggctgatgacctgcagatccgggagggcaagcacagccaggagatcgcccagttccaggccgagctggccgaggcccgggcccagctgcagctgctgcagaagcagctggatgagcagctgagcaagcagcctgtgggcaaccaggagatggagaacctgaagtgggaggtggaccagaaggagcgggagatccagagcctgaagcagcagctggacctgacagagcagcagggcaggaaggagctggagggcctgcagcagctgctgcagaatgtgaagtctgagctggagatggcccaggaggacctgtccatgacccagaaggacaagttcatgctgcaggccaaggtgtctgagctgaagaacaacatgaagaccctgctgcagcagaaccagcagctgaagctggacctgcggcggggggccgccaagacagtgctgcggcctgccagcctgcctggatag

SEQ ID NO: 154352 - DNA, 3405 bp, Artificial Sequence
  Description of Artificial Sequence: Synthetic coding sequence
atggatggagccagcgctgagcaggacggcctgcaggaggacaggagccacagcggccccagcagcctgcctgaggcccccctgaagcccccaggccccctggtgcccccagaccagcaggacaaggtgcagtgtgccgaggtgaacagagccagcacagaaggagagagcccagatggccctggccagggcggcctgtgccagaatggccccaccccacccttcccagacccccccagcagcctggaccccaccaccagccctgtgggcccagatgccagccctggggtggccggcttccatgacaacctgaggaagagccagggcaccagcgctgagggctctgtgaggaaggaggccctgcagagcctgcggctgagcctgcccatgcaggagacccagctgtgcagcacagacagccccctgcccctggagaaggaggagcaggtgcggctgcaggccaggaagtggctggaggagcagctgaagcagtacagagtgaagaggcagcaggagaggagcagccagcctgccaccaagaccaggctcttcagcaccctggaccctgagctgatgctgaaccctgagaacctgccccgggccagcaccctggccatgaccaaggagtacagcttcctgcggacctctgtgccccggggccccaaggtgggcagcctgggcctgcctgcccacccccgggagaagaagaccagcaagagcagcaagatccgcagcctggccgactacagaacagaggacagcaatgccggcaacagcggcggcaatgtgcctgccccagacagcaccaagggcagcctgaagcagaacagaagcagcgctgcctctgtggtgtctgagatcagcctgagcccagacacagatgaccggctggagaacaccagcctggccggggacagcgtgtctgaggtggatggaaatgacagcgacagcagcagctacagcagcgccagcacccggggcacctacggcatcctgagcaagacagtgggcacccaggacaccccctacatggtgaatggccaggagatcccagctgacaccctgggccagttccccagcatcaaggatgtgctgcaggccgctgctgctgagcaccaggaccagggccaggaggtgaatggagaggtgcgcagccggcgggacagcatctgcagctctgtgtccctggagagcagcgctgctgagacccaggaggagatgctgcaggtgctgaaggagaagatgaggctggagggccagctggaggccctgagcctggaggccagccaggccctgaaggagaaggccgagctgcaggcccagctggccgccctgagcaccaagctgcaggcccaggtggagtgcagccacagcagccagcagaggcaggacagcctgagcagcgaggtggacaccctgaagcagagctgctgggacctggagcgggccatgacagacctgcagaacatgctggaggccaagaatgccagcctggccagcagcaacaatgacctgcaggtggccgaggagcagtaccagaggctgatggccaaggtggaggacatgcagaggtccatgctgagcaaggacaacacagtgcatgacctgcggcagcagatgacagccctgcagagccagctgcagcaggtgcagctggagaggaccaccctgaccagcaagctgaaggccagccaggccgagatcagcagcctgcagagcgtgcggcagtggtaccagcagcagctggccctggcccaggaggcccgggtgcggctgcagggcgagatggcccacatccaggtgggccagatgacccaggccggcctgctggagcacctgaagctggagaatgtgtccctgagccagcagctgacagagacccagcaccgctccatgaaggagaagggcagaattgctgcccagctgcagggcattgaagctgacatgctggaccaggaggccgccttcatgcagatccaggaggccaagaccatggtggaggaggacctgcagaggcggctggaggagtttgaaggagagcgggagcggctgcagaggatggctgacagcgctgccagcctggagcagcagctggagcaggtgaagctgaccctgctgcagagggaccagcagctggaggccctgcagcaggagcacctggacctgatgaagcagctgaccctgacccaggaggccctgcagagccgggagcagagcctggatgccctgcagacccactatgatgagctgcaggcccggctgggggagctgcagggcgaggccgccagccgggaggacaccatctgcctgctgcagaatgagaagatcatcctggaggccgccctgcaggccgccaagagcggcaaggaggagctggacagaggagcccggcggctggaggagggcacagaggagaccagcgagaccctggagaagctgcgggaggagctggccatcaagagcggccaggtggagcacctgcagcaggagacagctgccctgaagaagcagatgcagaagatcaaggagcagttcctgcagcagaaggtgatggtggaggcctacagaagagatgccaccagcaaggaccagctgatcagcgagctgaaggccaccaggaagaggctggacagcgagctgaaggagctgcggcaggagctgatgcaggtgcatggagagaagaggacagctgaggccgagctgagccggctgcaccgggaggtggcccaggtgcggcagcacatggctgacctggagggccacctgcagagcgcccagaaggagagagatgagatggagacccacctgcagagcctgcagtttgacaaggagcagatggtggccgtgacagaggccaatgaggccctgaagaagcagatcgaggagctgcagcaggaggccaggaaggccatcacagagcagaagcagaagatgaggcggctgggcagtgacctgaccagcgcccagaaggagatgaagaccaagcacaaggcctatgaaaatgctgtgggcatcctgagccggcggctgcaggaggccctggccgccaaggaggccgcagatgctgagctgggccagctgcgggcccagggcggcagcagtgacagcagcctggccctgcacgagcgcatccaggccctggaggccgagctgcaggccgtgagccacagcaagaccctgctggagaaggagctgcaggaggtgattgccctgaccagccaggagctggaggagagccgggagaaggtgctggagctggaggatgaggtgcggcccggccacctgctgtggaggcagagaggagctggccacgtgtccccaggccacgccgccacccgggagaccaggaggaccaagctgcaccgggtgcccagcgtggccacctttggagtggccaccttctag

SEQ ID NO: 154353 - DNA, 6693 bp, Artificial Sequence
  Description of Artificial Sequence: Synthetic coding sequence
atgttcaagaagctgaagcagaagatcagcgaggagcagcagcagctgcagcaggccctggccccagcccaggccagcagcaacagcagcacccccaccaggatgaggagcaggaccagcagcttcacagagcagctggatgagggcacccccaaccgggagagcggggacacccagagctttgcccagaagctgcagctgcgggtgcccagcgtggagagcctcttccgcagccccatcaaggagagcctcttccgcagcagcagcaaggagagcctggtgaggaccagcagccgggagagcctgaaccggctggacctggacagcagcacagccagctttgacccccccagcgacatggacagcgaggccgaggacctggtgggcaacagcgacagcctgaacaaggagcagctgatccagaggctgcggaggatggagaggagcctgagcagctaccggggcaagtacagcgagctggtgacagcctaccagatgctgcagcgggagaagaagaagctgcagggcatcctgagccagagccaggacaagagcctgcggagaattgctgagctgcgggaggagctgcagatggaccagcaggccaagaagcacctgcaggaggagtttgatgccagcctggaggagaaggaccagtacatctctgtgctgcagacccaggtgtccctgctgaagcagaggctgagaaatggccccatgaatgtggatgtgctgaagcccctgccccagctggagccccaggccgaggtgttcaccaaggaggagaaccctgagagtgatggagagcctgtggtggaggatggcacctctgtgaagaccctggagaccctgcagcagagggtgaagaggcaggagaacctgctgaagcgctgcaaggagaccatccagagccacaaggagcagtgcaccctgctgaccagcgagaaggaggccctgcaggagcagctggatgagcggctgcaggagctggagaagatcaaggacctgcacatggccgagaagaccaagctgatcacccagctgagagatgccaagaacctgattgagcagctggagcaggacaagggcatggtgattgctgagaccaagaggcagatgcatgagaccctggagatgaaggaggaggagatcgcccagctgcggagccgcatcaagcagatgaccacccagggcgaggagctgcgggagcagaaggagaagtcagaaagagctgcctttgaggagctggagaaggccctgagcacagcccagaagacagaggaggcccggaggaagctgaaggccgagatggatgagcagatcaagaccatcgagaagaccagcgaggaggagcgcatcagcctgcagcaggagctgagccgggtgaagcaggaggtggtggatgtgatgaagaagagcagcgaggagcagatcgccaagctgcagaagctgcacgagaaggagctggccaggaaggagcaggagctgaccaagaagctgcagacccgggagcgggagttccaggagcagatgaaggtggccctggagaagagccagagcgagtacctgaagatcagccaggagaaggagcagcaggagagcctggccctggaggagctggagctgcagaagaaggccatcctgacagaaagtgagaacaagctgcgggacctgcagcaggaggccgagacctaccgcacccgcatcctggagctggagagcagcctggagaagagcctgcaggagaacaagaaccagagcaaggacctggccgtgcacctggaggccgagaagaacaagcacaacaaggagatcaccgtgatggtggagaagcacaagacagagctggagagcctgaagcaccagcaggatgccctgtggacagagaagctgcaggtgctgaagcagcagtaccagacagagatggagaagctgcgggagaagtgtgagcaggagaaggagaccctgctgaaggacaaggagatcatcttccaggcccacatcgaggagatgaatgagaagaccctggagaagctggatgtgaagcagacagagctggagagcctgagcagcgagctgtctgaggtgctgaaggcccggcacaagctggaggaggagctgtctgtgctgaaggaccagacagacaagatgaagcaggagctggaggccaagatggatgagcagaagaaccaccaccagcagcaggtggacagcatcatcaaggagcacgaggtgtccatccagaggacagagaaggccctgaaggaccagatcaaccagctggagctgctgctgaaggagcgggacaagcacctgaaggagcaccaggcccacgtggagaacctggaggccgacatcaagaggtctgagggggagctgcagcaggccagcgccaagctggatgtgttccagagctaccagagcgccacccatgagcagaccaaggcctatgaggagcagctggcccagctgcagcagaagctgctggacctggagacagagcgcatcctgctgaccaagcaggtggccgaggtggaggcccagaagaaggatgtgtgcacagagctggatgcccacaagatccaggtgcaggacctgatgcagcagctggagaagcagaacagcgagatggagcagaaggtgaagagcctgacccaggtgtatgagagcaagctggaggatggcaacaaggagcaggagcagaccaagcagatcctggtggagaaggagaacatgatcctgcagatgagggagggccagaagaaggagattgagatcctgacccagaagctgagcgccaaggaggacagcatccacatcctgaatgaggagtatgagaccaagttcaagaaccaggagaagaagatggagaaggtgaagcagaaggccaaggagatgcaggagaccctgaagaagaagctgctggaccaggaggccaagctgaagaaggagctggagaacacagccctggagctgagccagaaggagaagcagttcaatgccaagatgctggagatggcccaggccaacagcgctggcatcagtgatgctgtgtcccggctggagaccaaccagaaggagcagatcgagagcctgacagaggtgcacagaagagagctgaatgatgtgatcagcatctgggagaagaagctgaaccagcaggccgaggagctgcaggagatccacgagatccagctgcaggagaaggagcaggaggtggccgagctgaagcagaagatcctgctgtttggctgtgagaaggaggagatgaacaaggagatcacctggctgaaggaggagggcgtgaagcaggacaccaccctgaatgagctgcaggagcagctgaagcagaagagcgcccacgtgaacagcctggcccaggatgagaccaagctgaaggcccacctggagaagctggaggtggacctgaacaagagcctgaaggagaacaccttcctgcaggagcagctggtggagctgaagatgctggccgaggaggacaagaggaaggtgtctgagctgaccagcaagctgaagaccacagatgaggagttccagagcctgaagagcagccatgagaagagcaacaagagcctggaggacaagagcctggagttcaagaagctgtctgaggagctggccatccagctggacatctgctgcaagaagacagaggccctgctggaggccaagaccaatgaactcatcaacatcagcagcagcaagaccaatgccatcctgagccgcatcagccactgccagcacaggaccaccaaggtgaaggaggccctgctgatcaagacctgcaccgtgtctgagctggaggcccagctgcggcagctgacagaggagcagaacaccctgaacatctccttccagcaggccacccaccagctggaggagaaggagaaccagatcaagtccatgaaggctgacatcgagagcctggtgacagagaaggaggccctgcagaaggagggcggcaaccagcagcaggccgccagcgagaaggagagctgcatcacccagctgaagaaggagctgtctgagaacatcaatgctgtgaccctgatgaaggaggagctgaaggagaagaaggtggagatcagcagcctgagcaagcagctgacagacctgaatgtgcagctgcagaacagcatcagcctgtctgagaaggaggccgccatcagcagcctgaggaagcagtatgatgaggagaagtgtgagctgctggaccaggtgcaggacctgtccttcaaggtggacaccctgagcaaggagaagatcagcgccctggagcaggtggatgactggagcaacaagttcagcgagtggaagaagaaggcccagagccgcttcacccagcaccagaacacagtgaaggagctgcagatccagctggagctgaagagcaaggaggcctatgagaaggatgagcagatcaacctgctgaaggaggagctggaccagcagaacaagagatttgactgcctgaagggggagatggaggatgacaagagcaagatggagaagaaggagagcaacctggagacagagctgaagagccagacagcccgcatcatggagctggaggaccacatcacccagaagaccattgaaattgagagcctgaatgaggtgctgaagaactacaaccagcagaaggacatcgagcacaaggagctggtgcagaagctgcagcacttccaggagctgggggaggagaaggacaacagagtgaaggaggccgaggagaagatcctgaccctggagaaccaggtgtacagcatgaaggccgagctggagaccaagaagaaggagctggagcacgtgaacctgtctgtgaagagcaaggaggaggagctgaaggccctggaggaccggctggagagcgagagcgctgccaagctggccgagctgaagaggaaggccgagcagaagattgctgccatcaagaagcagctgctgagccagatggaggagaaggaggagcagtacaagaagggcacagagagccacctgtctgagctgaacaccaagctgcaggagcgggagcgggaggtgcacatcctggaggagaagctgaagtctgtggagagcagccagagcgagaccctgattgtgcccaggtctgccaagaatgtggccgcctacacagagcaggaggaggccgacagccagggctgtgtgcagaagacctatgaggagaagatctctgtgctgcagaggaacctgacagagaaggagaagctgctgcagagggtgggccaggagaaggaggagaccgtgagcagccactttgagatgcgctgccagtaccaggagcggctcatcaagctggagcacgccgaggccaagcagcacgaggaccagagcatgattggccacctgcaggaggagctggaggagaagaacaagaagtacagcctgattgtggcccagcacgtggagaaggagggcggcaagaacaacatccaggccaagcagaacctggagaatgtgtttgatgatgtgcagaagaccctgcaggagaaggagctgacctgccagatcctggagcagaagatcaaggagctggacagctgcctggtgcggcagaaggaggtgcaccgggtggagatggaggagctgaccagcaaatatgagaagctgcaggccctgcagcagatggatggaagaaacaagcccacagagctgctggaggagaacacagaggagaagagcaagagccacctggtgcagcccaagctgctgagcaacatggaggcccagcacaatgacctggagttcaagctggccggggctgagcgggagaagcagaagctgggcaaggagatcgtgcggctgcagaaggacctgaggatgctgaggaaggagcaccagcaggagctggagatcctgaagaaggagtatgaccaggagcgggaggagaagatcaagcaggagcaggaggacctggagctgaagcacaacagcaccctgaagcagctgatgagggagttcaacacccagctggcccagaaggagcaggagctggagatgaccatcaaggagaccatcaacaaggcccaggaggtggaggccgagctgctggagagccaccaggaggagaccaaccagctgctgaagaagattgctgagaaggatgatgacctgaagaggacagccaagagatatgaggagatcctggatgcccgggaggaggagatgacagccaaggtgcgggacctgcagacccagctggaggagctgcagaagaagtaccagcagaagctggagcaggaggagaaccctggaaatgacaacgtgaccatcatggagctgcagacccagctggcccagaagaccaccctcatcagtgacagcaagctgaaggagcaggagttccgggagcagatccacaacctggaggaccggctgaagaagtatgagaagaatgtgtatgccaccaccgtgggcaccccctacaagggcggcaacctgtaccacacagatgtgtccctgtttggagagcccacagaatttgagtacctgaggaaggtgctgtttgagtacatgatgggccgggagaccaagaccatggccaaggtgatcaccaccgtgctgaagttcccagatgaccagacccagaagatcctggagcgggaggatgcccggctgatgttcaccagccccaggagcggcatcttctag

SEQ ID NO: 154354 - DNA, 6732 bp, Artificial Sequence
  Description of Artificial Sequence: Synthetic coding sequence
atgttcaagaagctgaagcagaagatcagcgaggagcagcagcagctgcagcaggccctggccccagcccaggccagcagcaacagcagcacccccaccaggatgaggagcaggaccagcagcttcacagagcagctggatgagggcacccccaaccgggagaatgccagcacccacgccagcaagagcccagacagcgtgaatggcagcgagcccagcatcccccagagcggggacacccagagctttgcccagaagctgcagctgcgggtgcccagcgtggagagcctcttccgcagccccatcaaggagagcctcttccgcagcagcagcaaggagagcctggtgaggaccagcagccgggagagcctgaaccggctggacctggacagcagcacagccagctttgacccccccagcgacatggacagcgaggccgaggacctggtgggcaacagcgacagcctgaacaaggagcagctgatccagaggctgcggaggatggagaggagcctgagcagctaccggggcaagtacagcgagctggtgacagcctaccagatgctgcagcgggagaagaagaagctgcagggcatcctgagccagagccaggacaagagcctgcggagaattgctgagctgcgggaggagctgcagatggaccagcaggccaagaagcacctgcaggaggagtttgatgccagcctggaggagaaggaccagtacatctctgtgctgcagacccaggtgtccctgctgaagcagaggctgagaaatggccccatgaatgtggatgtgctgaagcccctgccccagctggagccccaggccgaggtgttcaccaaggaggagaaccctgagagtgatggagagcctgtggtggaggatggcacctctgtgaagaccctggagaccctgcagcagagggtgaagaggcaggagaacctgctgaagcgctgcaaggagaccatccagagccacaaggagcagtgcaccctgctgaccagcgagaaggaggccctgcaggagcagctggatgagcggctgcaggagctggagaagatcaaggacctgcacatggccgagaagaccaagctgatcacccagctgagagatgccaagaacctgattgagcagctggagcaggacaagggcatggtgattgctgagaccaagaggcagatgcatgagaccctggagatgaaggaggaggagatcgcccagctgcggagccgcatcaagcagatgaccacccagggcgaggagctgcgggagcagaaggagaagtcagaaagagctgcctttgaggagctggagaaggccctgagcacagcccagaagacagaggaggcccggaggaagctgaaggccgagatggatgagcagatcaagaccatcgagaagaccagcgaggaggagcgcatcagcctgcagcaggagctgagccgggtgaagcaggaggtggtggatgtgatgaagaagagcagcgaggagcagatcgccaagctgcagaagctgcacgagaaggagctggccaggaaggagcaggagctgaccaagaagctgcagacccgggagcgggagttccaggagcagatgaaggtggccctggagaagagccagagcgagtacctgaagatcagccaggagaaggagcagcaggagagcctggccctggaggagctggagctgcagaagaaggccatcctgacagaaagtgagaacaagctgcgggacctgcagcaggaggccgagacctaccgcacccgcatcctggagctggagagcagcctggagaagagcctgcaggagaacaagaaccagagcaaggacctggccgtgcacctggaggccgagaagaacaagcacaacaaggagatcaccgtgatggtggagaagcacaagacagagctggagagcctgaagcaccagcaggatgccctgtggacagagaagctgcaggtgctgaagcagcagtaccagacagagatggagaagctgcgggagaagtgtgagcaggagaaggagaccctgctgaaggacaaggagatcatcttccaggcccacatcgaggagatgaatgagaagaccctggagaagctggatgtgaagcagacagagctggagagcctgagcagcgagctgtctgaggtgctgaaggcccggcacaagctggaggaggagctgtctgtgctgaaggaccagacagacaagatgaagcaggagctggaggccaagatggatgagcagaagaaccaccaccagcagcaggtggacagcatcatcaaggagcacgaggtgtccatccagaggacagagaaggccctgaaggaccagatcaaccagctggagctgctgctgaaggagcgggacaagcacctgaaggagcaccaggcccacgtggagaacctggaggccgacatcaagaggtctgagggggagctgcagcaggccagcgccaagctggatgtgttccagagctaccagagcgccacccatgagcagaccaaggcctatgaggagcagctggcccagctgcagcagaagctgctggacctggagacagagcgcatcctgctgaccaagcaggtggccgaggtggaggcccagaagaaggatgtgtgcacagagctggatgcccacaagatccaggtgcaggacctgatgcagcagctggagaagcagaacagcgagatggagcagaaggtgaagagcctgacccaggtgtatgagagcaagctggaggatggcaacaaggagcaggagcagaccaagcagatcctggtggagaaggagaacatgatcctgcagatgagggagggccagaagaaggagattgagatcctgacccagaagctgagcgccaaggaggacagcatccacatcctgaatgaggagtatgagaccaagttcaagaaccaggagaagaagatggagaaggtgaagcagaaggccaaggagatgcaggagaccctgaagaagaagctgctggaccaggaggccaagctgaagaaggagctggagaacacagccctggagctgagccagaaggagaagcagttcaatgccaagatgctggagatggcccaggccaacagcgctggcatcagtgatgctgtgtcccggctggagaccaaccagaaggagcagatcgagagcctgacagaggtgcacagaagagagctgaatgatgtgatcagcatctgggagaagaagctgaaccagcaggccgaggagctgcaggagatccacgagatccagctgcaggagaaggagcaggaggtggccgagctgaagcagaagatcctgctgtttggctgtgagaaggaggagatgaacaaggagatcacctggctgaaggaggagggcgtgaagcaggacaccaccctgaatgagctgcaggagcagctgaagcagaagagcgcccacgtgaacagcctggcccaggatgagaccaagctgaaggcccacctggagaagctggaggtggacctgaacaagagcctgaaggagaacaccttcctgcaggagcagctggtggagctgaagatgctggccgaggaggacaagaggaaggtgtctgagctgaccagcaagctgaagaccacagatgaggagttccagagcctgaagagcagccatgagaagagcaacaagagcctggaggacaagagcctggagttcaagaagctgtctgaggagctggccatccagctggacatctgctgcaagaagacagaggccctgctggaggccaagaccaatgaactcatcaacatcagcagcagcaagaccaatgccatcctgagccgcatcagccactgccagcacaggaccaccaaggtgaaggaggccctgctgatcaagacctgcaccgtgtctgagctggaggcccagctgcggcagctgacagaggagcagaacaccctgaacatctccttccagcaggccacccaccagctggaggagaaggagaaccagatcaagtccatgaaggctgacatcgagagcctggtgacagagaaggaggccctgcagaaggagggcggcaaccagcagcaggccgccagcgagaaggagagctgcatcacccagctgaagaaggagctgtctgagaacatcaatgctgtgaccctgatgaaggaggagctgaaggagaagaaggtggagatcagcagcctgagcaagcagctgacagacctgaatgtgcagctgcagaacagcatcagcctgtctgagaaggaggccgccatcagcagcctgaggaagcagtatgatgaggagaagtgtgagctgctggaccaggtgcaggacctgtccttcaaggtggacaccctgagcaaggagaagatcagcgccctggagcaggtggatgactggagcaacaagttcagcgagtggaagaagaaggcccagagccgcttcacccagcaccagaacacagtgaaggagctgcagatccagctggagctgaagagcaaggaggcctatgagaaggatgagcagatcaacctgctgaaggaggagctggaccagcagaacaagagatttgactgcctgaagggggagatggaggatgacaagagcaagatggagaagaaggagagcaacctggagacagagctgaagagccagacagcccgcatcatggagctggaggaccacatcacccagaagaccattgaaattgagagcctgaatgaggtgctgaagaactacaaccagcagaaggacatcgagcacaaggagctggtgcagaagctgcagcacttccaggagctgggggaggagaaggacaacagagtgaaggaggccgaggagaagatcctgaccctggagaaccaggtgtacagcatgaaggccgagctggagaccaagaagaaggagctggagcacgtgaacctgtctgtgaagagcaaggaggaggagctgaaggccctggaggaccggctggagagcgagagcgctgccaagctggccgagctgaagaggaaggccgagcagaagattgctgccatcaagaagcagctgctgagccagatggaggagaaggaggagcagtacaagaagggcacagagagccacctgtctgagctgaacaccaagctgcaggagcgggagcgggaggtgcacatcctggaggagaagctgaagtctgtggagagcagccagagcgagaccctgattgtgcccaggtctgccaagaatgtggccgcctacacagagcaggaggaggccgacagccagggctgtgtgcagaagacctatgaggagaagatctctgtgctgcagaggaacctgacagagaaggagaagctgctgcagagggtgggccaggagaaggaggagaccgtgagcagccactttgagatgcgctgccagtaccaggagcggctcatcaagctggagcacgccgaggccaagcagcacgaggaccagagcatgattggccacctgcaggaggagctggaggagaagaacaagaagtacagcctgattgtggcccagcacgtggagaaggagggcggcaagaacaacatccaggccaagcagaacctggagaatgtgtttgatgatgtgcagaagaccctgcaggagaaggagctgacctgccagatcctggagcagaagatcaaggagctggacagctgcctggtgcggcagaaggaggtgcaccgggtggagatggaggagctgaccagcaaatatgagaagctgcaggccctgcagcagatggatggaagaaacaagcccacagagctgctggaggagaacacagaggagaagagcaagagccacctggtgcagcccaagctgctgagcaacatggaggcccagcacaatgacctggagttcaagctggccggggctgagcgggagaagcagaagctgggcaaggagatcgtgcggctgcagaaggacctgaggatgctgaggaaggagcaccagcaggagctggagatcctgaagaaggagtatgaccaggagcgggaggagaagatcaagcaggagcaggaggacctggagctgaagcacaacagcaccctgaagcagctgatgagggagttcaacacccagctggcccagaaggagcaggagctggagatgaccatcaaggagaccatcaacaaggcccaggaggtggaggccgagctgctggagagccaccaggaggagaccaaccagctgctgaagaagattgctgagaaggatgatgacctgaagaggacagccaagagatatgaggagatcctggatgcccgggaggaggagatgacagccaaggtgcgggacctgcagacccagctggaggagctgcagaagaagtaccagcagaagctggagcaggaggagaaccctggaaatgacaacacccagctggcccagaagaccaccctcatcagtgacagcaagctgaaggagcaggagttccgggagcagatccacaacctggaggaccggctgaagaagtatgagaagaatgtgtatgccaccaccgtgggcaccccctacaagggcggcaacctgtaccacacagatgtgtccctgtttggagagcccacagaatttgagtacctgaggaaggtgctgtttgagtacatgatgggccgggagaccaagaccatggccaaggtgatcaccaccgtgctgaagttcccagatgaccagacccagaagatcctggagagagaagatgcccggctgatgtcctggctgcggagcagcagctag

SEQ ID NO: 154355 - DNA, 2196 bp, Artificial Sequence
  Description of Artificial Sequence: Synthetic coding sequence
atgtcctggtttgtggacctggccggcaaggccgaggacctgctgaacagagtggaccagggcgccgccacagccctgagcaggaaggacaatgccagcaacatctacagcaagaacacagactacacagagctgcaccagcagaacacagacctgatctaccagacaggccccaagagcacctacatcagcagcgctgctgacaacatccggaaccagaaggccaccatcctggccggcacagccaacgtgaaggtgggcagcaggacccctgtggaggccagccaccctgtggagaatgcctctgtgccccggcccagcagccactttgtgcggaggaagaagtctgagccagatgatgagctgctgtttgacttcctgaacagcagccagaaggagcccaccggccgggtggagatcaggaaggagaagggcaagacccctgtgttccagagcagccagaccagctctgtgtcctctgtgaaccccagcgtgaccaccatcaagaccattgaagaaaattcctttggcagccagacccatgaagctgccagcaacagcgacagcagccatgagggccaggaggagagcagcaaagaaaatgtgagcagcaatgctgcctgcccagaccacacccccaccccaaatgatgatggcaagagccatgagctgagcaacctgcggctggagaaccagctgctgagaaatgaggtgcagagcctgaaccaggagatggccagcctgctgcagaggagcaaggagacccaggaggagctgaacaaggcccgggcccgggtggagaagtggaatgctgaccacagcaagagtgacaggatgacccggggcctgcgggcccaggtggatgacctgacagaagctgtggccgccaaggacagccagctggccgtgctgaaggtgcggctgcaggaggccgaccagctgctgagcaccaggacagaggccctggaggccctgcagagcgagaagagccgcatcatgcaggaccagagcgagggcaacagcctgcagaaccaggccctgcagaccttccaggagcggctgcatgaagcagatgccaccctgaagcgggagcaggagagctacaagcagatgcagagcgagtttgctgcccggctgaacaaggtggagatggagcggcagaacctggccgaggccatcaccctggccgagaggaagtacagtgatgagaagaagagggtggatgagctgcagcagcaggtgaagctgtacaagctgaacctggagagcagcaagcaggagctgattgactacaagcagaaggccacccgcatcctgcagagcaaggagaagctgatcaacagcctgaaggagggcagcggctttgagggcctggacagcagcacagccagctccatggagctggaggagctgcggcatgagaaggagatgcagcgggaggagatccagaagctgatgggccagatccaccagctgcggtctgagctgcaggacatggaggcccagcaggtgaatgaagctgagagcgcccgggagcagctgcaggacctgcatgaccagattgctggccagaaggccagcaagcaggagctggagacagagctggagcggctgaagcaggagttccactacattgaagaagatctctaccgcaccaagaacaccctgcagagccgcatcaaggacagagatgaggagatccagaagctgaggaaccagctgaccaacaagaccctgagcaacagcagccagagcgagctggagaaccggctgcaccagctgacagagaccctcatccagaagcagaccatgctggagagcctgagcacagagaagaacagcctggtgttccagctggagcggctggagcagcagatgaacagcgccagcggcagcagcagcaatggcagcagcatcaacatgagcggcatcgacaacggggagggcacccggctgagaaatgtgcctgtgctcttcaatgacacagagaccaacctggccggcatgtatggcaaggtgaggaaggccgccagcagcattgaccagttcagcatccggctgggcatcttcctgcggcgctaccccatcgcccgggtgtttgtgatcatctacatggccctgctgcacctgtgggtgatgattgtgctgctgacctacaccccagagatgcaccacgaccagccctacggcaagtag

SEQ ID NO: 154356 - DNA, 2076 bp, Artificial Sequence
  Description of Artificial Sequence: Synthetic coding sequence
atgtcctggtttgtggacctggccggcaaggccgaggacctgctgaacagagtggaccagggcgccgccacagccctgagcaggaaggacaatgccagcaacatctacagcaagaacacagactacacagagctgcaccagcagaacacagacctgatctaccagacaggccccaagagcacctacatcagcagcgctgctgacaacatccggaaccagaaggccaccatcctggccggcacagccaacgtgaaggtgggcagcaggacccctgtggaggccagccaccctgtggagaatgcctctgtgccccggcccagcagccactttgtgcggaggaagaagtctgagccagatgatgagctgctgtttgacttcctgaacagcagccagaaggagcccaccggccgggtggagatcaggaaggagaagggcaagacccctgtgttccagagcagccagaccagctctgtgtcctctgtgaaccccagcgtgaccaccatcaagaccattgaagaaaattcctttggcagccagacccatgaagctgccagcaacagcgacagcagccatgagggccaggaggagagcagcaaagaaaatgtgagcagcaatgctgcctgcccagaccacacccccaccccaaatgatgatggcaagagccatgagctgagcaacctgcggctggagaaccagctgctgagaaatgaggtgcagagcctgaaccaggagatggccagcctgctgcagaggagcaaggagacccaggaggagctgaacaaggcccgggcccgggtggagaagtggaatgctgaccacagcaagagtgacaggatgacccggggcctgcgggcccaggtggatgacctgacagaagctgtggccgccaaggacagccagctggccgtgctgaaggtgcggctgcaggaggccgaccagctgctgagcaccaggacagaggccctggaggccctgcagagcgagaagagccgcatcatgcaggaccagagcgagggcaacagcctgcagaaccaggccctgcagaccttccaggagcggctgcatgaagcagatgccaccctgaagcgggagcaggagagctacaagcagatgcagagcgagtttgctgcccggctgaacaaggtggagatggagcggcagaacctggccgaggccatcaccctggccgagaggaagtacagtgatgagaagaagagggtggatgagctgcagcagcaggtgaagctgtacaagctgaacctggagagcagcaagcaggagctgattgactacaagcagaaggccacccgcatcctgcagagcaaggagaagctgatcaacagcctgaaggagggcagcggctttgagggcctggacagcagcacagccagctccatggagctggaggagctgcggcatgagaaggagatgcagcgggaggagatccagaagctgatgggccagatccaccagctgcggtctgagctgcaggacatggaggcccagcaggtgaatgaagctgagagcgcccgggagcagctgcaggacctgcatgaccagattgctggccagaaggccagcaagcaggagctggagacagagctggagcggctgaagcaggagttccactacattgaagaagatctctaccgcaccaagaacaccctgcagagccgcatcaaggacagagatgaggagatccagaagctgaggaaccagctgaccaacaagaccctgagcaacagcagccagagcgagctggagaaccggctgcaccagctgacagagaccctcatccagaagcagaccatgctggagagcctgagcacagagaagaacagcctggtgttccagctggagcggctggagcagcagatgaacagcgccagcggcagcagcagcaatggcagcagcatcaacatgagcggcatcgacaacggggagggcacccggctgagaaatgtgcctgtgctcttcaatgacacagagaccaacctggccggcatgtatggcaaggtgaggaaggccgccagcagcattgaccagttccggctgtgcttcaccagcggcagctag

SEQ ID NO: 154357 - DNA, 1923 bp, Artificial Sequence
  Description of Artificial Sequence: Synthetic coding sequence
atgtcctggtttgtggacctggccggcaaggccgaggacctgctgaacagagtggaccagggcgccgccacagccctgagcaggaaggacaatgccagcaacatctacagcaagaacacagactacacagagctgcaccagcagaacacagacctgatctaccagacaggccccaagagcacctacatcagcagcgctgctgacaacatccggaaccagaaggccaccatcaagaccatcgaggagaacagctttggcagccagacccatgaggccgccagcaacagcgacagcagccatgagggccaggaggagagcagcaaagaaaatgtgagcagcaatgctgcctgcccagaccacacccccaccccaaatgatgatggcaagagccatgagctgagcaacctgcggctggagaaccagctgctgagaaatgaggtgcagagcctgaaccaggagatggccagcctgctgcagaggagcaaggagacccaggaggagctgaacaaggcccgggcccgggtggagaagtggaatgctgaccacagcaagagtgacaggatgacccggggcctgcgggcccaggtggatgacctgacagaggccgtggccgccaaggacagccagctggccgtgctgaaggtgcggctgcaggaggccgaccagctgctgagcaccaggacagaggccctggaggccctgcagagcgagaagagccgcatcatgcaggaccagagcgagggcaacagcctgcagaaccaggccctgcagaccttccaggagcggctgcacgaggctgatgccaccctgaagcgggagcaggagagctacaagcagatgcagagcgagtttgctgcccggctgaacaaggtggagatggagcggcagaacctggccgaggccatcaccctggccgagaggaagtacagtgatgagaagaagagggtggatgagctgcagcagcaggtgaagctgtacaagctgaacctggagagcagcaagcaggagctgattgactacaagcagaaggccacccgcatcctgcagagcaaggagaagctgatcaacagcctgaaggagggcagcggctttgagggcctggacagcagcacagccagctccatggagctggaggagctgcggcatgagaaggagatgcagcgggaggagatccagaagctgatgggccagatccaccagctgcggtctgagctgcaggacatggaggcccagcaggtgaatgaggccgagagcgcccgggagcagctgcaggacctgcatgaccagattgctggccagaaggccagcaagcaggagctggagacagagctggagcggctgaagcaggagttccactacatcgaggaggacctgtaccgcaccaagaacaccctgcagagccgcatcaaggacagagatgaggagatccagaagctgaggaaccagctgaccaacaagaccctgagcaacagcagccagagcgagctggagaaccggctgcaccagctgacagagaccctcatccagaagcagaccatgctggagagcctgagcacagagaagaacagcctggtgttccagctggagcggctggagcagcagatgaacagcgccagcggcagcagcagcaatggcagcagcatcaacatgtctggaattgacaatggagagggcacccggctgagaaatgtgcctgtgctcttcaatgacacagagaccaacctggccggcatgtatggcaaggtgaggaaggccgccagcagcattgaccagttcagcatccggctgggcatcttcctgcggcgctaccccatcgcccgggtgtttgtgatcatctacatggccctgctgcacctgtgggtgatgattgtgctgctgacctacaccccagagatgcaccacgaccagccctacggcaagtag

SEQ ID NO: 154358 - DNA, 504 bp, Artificial Sequence
  Description of Artificial Sequence: Synthetic coding sequence
atggccacagaggtgcacaacctgcaggagctgcggcgcagcgccagcctggccaccaaggtgttcatccagagggactacagtgatggcaccatctgccagttccagaccaagttccccccagagctggacagcagaattgagcggcagctgtttgaggagaccgtgaagaccctgaatggcttctacgccgaggccgagaagattggaggcagcagctacctggagggctgcctggcctgtgccacagcctacttcatcttcctgtgcatggagacccactatgagaaggtgctgaagaagatcagccgctacatccaggagcagaatgagaagatctttgccccccggggcctgctgctgacagatcctgtggagcggggcatgagggtcatcgagatcagcatctatgaggaccgctgcagcagcggcagcagcagcagcggcagcagcagcggcagcggcagcagcagcggcggcggcggcggggccggggccaggtag

SEQ ID NO: 154359 - DNA, 1812 bp, Artificial Sequence
  Description of Artificial Sequence: Synthetic coding sequence
atggccgaggagaccggccagagcaagctggccgccgccaagaagaagttcaaggagtactggcagaggaacagacctggggtgcctgctgctgccaagaggaacaccaaggccaacggcagcagccctgagacagctgccagcggcggctgccacagcagcgaggccagcagcagcgccagcagcagcctgcacgcccggcagagcccctgccaggagcaggccgctgtgctgaacagccgcagcatcaagatcagccggctgaatgacaccatcaagagcctgaagcagcagaagaagcaggtggagcaccagctggaggaggagaagaaggccaacaatgagaagcagaaggccgagcgggagctggagggccagatccagaggctgaacacagagaagaagaagctgaacacagacctgtaccacatgaagcacagcctgcgctactttgaggaggagagcaaggacctggccggccgcctgcagaggagcagccagagaattggagagctggagtggagcctgtgtgctgtggccgccacccagaagaagaagccagatggcttcagcagccgcagcaaggccctgctgaagaggcagctggagcagagcatccgggagcagatcctgctgaagggccacgtgacccagctgaaggagagcctgaaggaggtgcagctggagcgggaccagtatgcagagcagatcaagggggagcgggcccagtggcagcagaggatgaggaagatgagccaggaggtgtgcaccctgaaggaggagaagaagcatgacacccaccgggtggaggagctggagaggagcctgagccggctgaagaaccagatggccgagcccctgcccccagatgccccagctgtgagcagcgaggtggagctgcaggacctgaggaaggagctggagcgggtggccggggagctgcaggcccaggtggagaacaaccagtgcatcagcctgctgaacagaggccagaaggagcggctgcgggagcaggaggagcggctgcaggagcagcaggagcggctgcgggagcgggagaagaggctgcagcagctggccgagccccagagcgacctggaggagctgaagcatgagaacaagagcgccctgcagctggagcagcaggtgaaggagctgcaggagaagctgggccaggtgatggagaccctgaccagcgctgagaaggagcctgaggccgctgtgcctgccagcggcactggaggagagagcagcggcctgatggacctgctggaggagaaggctgacctgcgggagcacgtggagaagctggagctgggcttcatccagtacagaagagagcgctgccaccagaaggtgcaccggctgctgacagagcccggggacagcgccaaggatgccagccctgggggcggccaccaccaggccggccctggccagggcggggaggagggggaggccgccggggctgctggagatggagtggccgcctgtggcagctacagcgagggccacggcaagttcctggccgccgccagaaatcctgctgctgagcccagccctggggccccagccccccaggagctgggcgctgctgacaagcatggagacctgtgtgaggccagcctgaccaacagcgtggagcccgcccagggcgaggcccgggagggcagcagccaggacaaccccacagcccagcctgtgctgcagctgctgggggagatgcaggaccaccaggagcaccctggcctgggcagcaactgctgcgtgccctgcttctgctgggcctggctgcccaggagaagaagatag

SEQ ID NO: 154360 - DNA, 1485 bp, Artificial Sequence
  Description of Artificial Sequence: Synthetic coding sequence
gagaagaaggccaacaatgagaagcagaaggccgagcgggagctggagggccagatccagaggctgaacacagagaagaagaagctgaacacagacctgtaccacatgaagcacagcctgcgctactttgaggaggagagcaaggacctggccggccgcctgcagaggagcagccagagaattggagagctggagtggagcctgtgtgctgtggccgccacccagaagaagaagccagatggcttcagcagccgcagcaaggccctgctgaagaggcagctggagcagagcatccgggagcagatcctgctgaagggccacgtgacccagctgaaggagagcctgaaggaggtgcagctggagcgggaccagtatgcagagcagatcaagggggagcgggcccagtggcagcagaggatgaggaagatgagccaggaggtgtgcaccctgaaggaggagaagaagcatgacacccaccgggtggaggagctggagaggagcctgagccggctgaagaaccagatggccgagcccctgcccccagatgccccagctgtgagcagcgaggtggagctgcaggacctgaggaaggagctggagcgggtggccggggagctgcaggcccaggtggagaacaaccagtgcatcagcctgctgaacagaggccagaaggagcggctgcgggagcaggaggagcggctgcaggagcagcaggagcggctgcgggagcgggagaagaggctgcagcagctggccgagccccagagcgacctggaggagctgcacgagaacaagagcgccctgcagctggagcagcaggtgaaggagctgcaggagaagctgggccaggtgatggagaccctgaccagcgctgagaaggagcctgaggccgctgtgcctgccagcggcaccggcggggagagcagcggcctgatggacctgctggaggagaaggctgacctgcgggagcacgtggagaagctggagctgggcttcatccagtaccgccgggagcgctgccaccagaaggtgcaccggctgctgacagagcccggggacagcgccaaggatgccagccctgggggcggccaccaccaggccggccctggccagggcggggaggagggggaggccgccggggctgctggagatggagtggccgcctgtggcagctacagcgagggccacggcaagttcctggccgccgccaggaacccagctgctgagcccagccctggggccccagccccccaggagctgggcgctgctgacaagcacggggacctgtgtgaggccagcctgaccaacagcgtggagcccgcccagggcgaggcccgggagggcagcagccaggacaaccccacagcccagcctgtgctgcagctgctgggggagatgcaggaccaccaggagcaccctggcctgggcagcaactgctgcgtgccctgcttctgctgggcctggctgcccaggagaagaagatag

SEQ ID NO: 154361 - DNA, 1812 bp, Artificial Sequence; identical to SEQ ID NO: 154359
  Description of Artificial Sequence: Synthetic coding sequence

SEQ ID NO: 154362 - DNA, 1902 bp, Artificial Sequence
  Description of Artificial Sequence: Synthetic coding sequence
atgctgcctgtggatggagaggagaggaagtctgagggcagtgacacagaaggagacaggaccagcccctgtgccggccccaccagcagcgccaccctgaaggacctggaggtgggcggcagcggctggcgctgcagcgaccctgctggccagcccagcaacctgctgccccagaggggcctgggcgcccccctgcctgctgagacagcccacacccagcccagccccaatgacaggagcctgtacctgagccccaagagcagcagcgccagcagcagcctgcacgcccggcagagcccctgccaggagcaggccgctgtgctgaacagccgcagcatcaagatcagccggctgaatgacaccatcaagagcctgaagcagcagaagaagcaggtggagcaccagctggaggaggagaagaaggccaacaatgagaagcagaaggccgagcgggagctggagggccagatccagaggctgaacacagagaagaagaagctgaacacagacctgtaccacatgaagcacagcctgcgctactttgaggaggagagcaaggacctggccggccgcctgcagaggagcagccagagaattggagagctggagtggagcctgtgtgctgtggccgccacccagaagaagaagccagatggcttcagcagccgcagcaaggccctgctgaagaggcagctggagcagagcatccgggagcagatcctgctgaagggccacgtgacccagctgaaggagagcctgaaggaggtgcagctggagcgggaccagtatgcagagcagatcaagggggagcgggcccagtggcagcagaggatgaggaagatgagccaggaggtgtgcaccctgaaggaggagaagaagcatgacacccaccgggtggaggagctggagaggagcctgagccggctgaagaaccagatggccgagcccctgcccccagatgccccagctgtgagcagcgaggtggagctgcaggacctgaggaaggagctggagcgggtggccggggagctgcaggcccaggtggagaacaaccagtgcatcagcctgctgaacagaggccagaaggagcggctgcgggagcaggaggagcggctgcaggagcagcaggagcggctgcgggagcgggagaagaggctgcagcagctggccgagccccagagcgacctggaggagctgaagcatgagaacaagagcgccctgcagctggagcagcaggtgaaggagctgcaggagaagctgggccaggtgatggagaccctgaccagcgctgagaaggagcctgaggccgctgtgcctgccagcggcactggaggagagagcagcggcctgatggacctgctggaggagaaggctgacctgcgggagcacgtggagaagctggagctgggcttcatccagtacagaagagagcgctgccaccagaaggtgcaccggctgctgacagagcccggggacagcgccaaggatgccagccctgggggcggccaccaccaggccggccctggccagggcggggaggagggggaggccgccggggctgctggagatggagtggccgcctgtggcagctacagcgagggccacggcaagttcctggccgccgccagaaatcctgctgctgagcccagccctggggccccagccccccaggagctgggcgctgctgacaagcatggagacctgtgtgaggccagcctgaccaacagcgtggagcccgcccagggcgaggcccgggagggcagcagccaggacaaccccacagcccagcctgtgctgcagctgctgggggagatgcaggaccaccaggagcaccctggcctgggcagcaactgctgcgtgccctgcttctgctgggcctggctgcccaggagaagaagatag

SEQ ID NO: 154363 - DNA, 9780 bp, Artificial Sequence
  Description of Artificial Sequence: Synthetic coding sequence
atgctgagccggctgagcggcctggccaacgtggtgctgcacgagctgtctggagatgatgacacagaccagaacatgagggcccccctggaccctgagctgcaccaggagagtgacatggagttcaacaacaccacccaggaggatgtgcaggagcggctggcctatgcagagcagctggtggtggagctgaaggacatcatccggcagaaggatgtgcagctgcagcagaaggatgaggccctgcaggaggagaggaaggctgctgacaacaagatcaagaagctgaagctgcacgccaaggccaagctgaccagcctgaacaagtacatcgaggagatgaaggcccagggcggcaccgtgctgcccacagagccccagagcgaggagcagctgagcaagcatgacaagagcagcacagaggaggagatggagattgagaagatcaagcacaagctgcaggagaaggaggagctgatcagcaccctgcaggcccagctgacccaggcccaggccgagcagcctgcccagagcagcacagagatggaggagtttgtgatgatgaagcagcagctgcaggagaaggaggagttcatcagcaccctgcaggcccagctgagccagacccaggccgagcaggccgcccagcaggtggtgcgggagaaggatgccaggtttgagacccaggtgcggctgcatgaagatgagctgctgcagctggtgacccaggctgatgtggagacagagatgcagcagaagctgcgggtgctgcagaggaagctggaggagcacgaggagagcctggtgggccgggcccaggtggtggacctgctgcagcaggagctgacagctgctgagcagaggaaccagatcctgagccagcagctgcagcagatggaggccgagcacaacaccctgaggaacacagtggagacagagcgggaggagagcaagatcctgctggagaagatggagctggaggtggccgagaggaagctgtccttccacaacctgcaggaggagatgcaccacctgctggagcagtttgagcaggccggccaggcccaggccgagctggagagccgctacagcgccctggagcagaagcacaaggccgagatggaggagaagaccagccacatcctgagcctgcagaagacaggccaggagctgcagagcgcctgtgatgccctgaaggaccagaacagcaagctgctgcaggacaagaatgagcaggccgtgcagagcgcccagaccatccagcagctggaggaccagctgcagcagaagagcaaggagatcagccagttcctgaaccggctgcccctgcagcagcacgagacagccagccagaccagcttcccagatgtgtacaatgaaggcacccaggccgtgacagaggagaacatcgccagcctgcagaagagggtggtggagctggagaatgagaagggggccctgctgctgagcagcattgagctggaggagctgaaggccgagaatgagaagctgagcagccagatcaccctgctggaggcccagaacagaactggagaggccgaccgggaggtgtctgagatcagcatcgtggacatcgccaacaagaggagcagcagcgctgaggagagcggccaggatgtgctggagaacaccttcagccagaagcacaaggagctgtctgtgctgctgctggagatgaaggaggcccaggaggagatcgccttcctgaagctgcagctgcagggcaagagagctgaggaggccgaccacgaggtgctggaccagaaggagatgaagcagatggagggggagggcatcgcccccatcaagatgaaggtgttcctggaggacaccggccaggacttccccctgatgcccaatgaggagagcagcctgcctgctgtggagaaggagcaggccagcacagagcaccagagcaggaccagcgaggagatcagcctgaatgatgctggggtggagctgaagagcaccaagcaggatggagacaagagcctgtctgctgtgcctgacatcggccagtgccaccaggatgagctggagcggctgaagagccagatcctggagctggagctgaacttccacaaggcccaggagatctatgagaagaacctggatgagaaggccaaggagatcagcaacctgaaccagctgattgaggagttcaagaagaatgctgacaacaacagcagcgccttcaccgccctgtctgaggagcgggaccagctgctgagccaggtgaaggagctgtccatggtgacagagctgcgggcccaggtgaagcagctggagatgaacctggccgaggccgagcggcagaggcggctggactatgagagccagacagcccatgacaacctgctgacagagcagatccacagcctgagcattgaggccaagagcaaggatgtgaagattgaggtgctgcagaatgagctggatgatgtgcagctgcagttcagcgagcagagcaccctcatccgcagcctgcagagccagctgcagaacaaggagagcgaggtgctggagggcgctgagcgggtgcgccacatcagcagcaaggtggaggagctgagccaggccctgagccagaaggagctggagatcaccaagatggaccagctgctgctggagaagaagagagatgtggagaccctgcagcagaccatcgaggagaaggaccagcaggtgacagagatctccttctccatgacagagaagatggtgcagctgaatgaggagaagttcagcctgggcgtggagatcaagaccctgaaggagcagctgaacctgctgagcagagctgaggaggccaagaaggagcaggtggaggaggacaatgaggtgagcagcggcctgaagcagaactatgatgagatgagccctgctggccagatcagcaaggaggagctgcagcatgaatttgacctgctgaagaaggaaaatgagcagaggaagaggaagctgcaggccgccctgatcaacaggaaggagctgctgcagagggtgtcccggctggaggaggagctggccaacctgaaggatgagagcaagaaggagatccccctgtctgaaacagagcggggggaggtggaggaggacaaggagaacaaggagtacagcgagaagtgtgtgaccagcaagtgccaggagattgagatctacctgaagcagaccatcagcgagaaggaggtggagctgcagcacatcaggaaggacctggaggagaagctggccgctgaggagcagttccaggccctggtgaagcagatgaaccagaccctgcaggacaagaccaaccagattgacctgctgcaggccgagatcagcgagaaccaggccatcatccagaagctgatcaccagcaacacagatgccagtgatggagacagcgtggccctggtgaaggagaccgtggtgatcagccccccctgcaccggcagcagcgagcactggaagccagagctggaggagaagatcctggccctggagaaggagaaggagcagctgcagaagaagctgcaggaggccctgaccagcaggaaggccatcctgaagaaggcccaggagaaggagcggcacctgcgggaggagctgaagcagcagaaggatgactacaaccggctgcaggagcagtttgatgagcagagcaaagaaaatgaaaatattggagaccagctgcggcagctgcagatccaggtgcgggagagcattgatggcaagctgcccagcacagaccagcaggagagctgcagcagcaccccaggcctggaggagcccctcttcaaggccacagagcagcaccacacccagcctgtgctggagagcaacctgtgcccagactggcccagccacagtgaagatgccagcgccctgcagggcggcacctctgtggcccagatcaaggcccagctgaaggagattgaggccgagaaggtggagctggagctgaaggtgagcagcaccaccagcgagctgaccaagaagtctgaggaggtgttccagctgcaggagcagatcaacaagcagggcctggagattgagagcctgaagacagtgtcccatgaagctgaggtgcatgctgagagcctgcagcagaagctggagagcagccagctgcagattgctggcctggagcacctgcgggagctgcagcccaagctggatgagctgcagaagctgatcagcaagaaggaggaggatgtgtcctacctgagcggccagctgtctgagaaggaggccgccctgaccaagatccagacagagatcatcgagcaggaggacctgatcaaggccctgcacacccagctggagatgcaggccaaggagcatgatgagcgcatcaagcagctgcaggtggagctgtgtgagatgaagcagaagccagaggagattggagaggagagccgggccaagcagcagatccagaggaagctgcaggccgccctgatcagcaggaaggaggccctgaaggagaacaagagcctgcaggaggagctgagcctggcccggggcaccatcgagcggctgaccaagagcctggctgatgtggagagccaggtgtctgcccagaacaaggagaaggacacagtgctgggccgcctggccctgctgcaggaggagcgggacaagctgatcacagagatggacaggagcctgctggagaaccagagcctgagcagcagctgtgagagcctgaagctggccctggagggcctgacagaggacaaggagaagctggtgaaggagattgagagcctgaagagcagcaagattgctgagagcacagagtggcaggagaagcacaaggagctgcagaaggagtatgagatcctgctgcagagctatgaaaatgtgtccaatgaagctgagcgcatccagcacgtggtggaggccgtgcggcaggagaagcaggagctgtatggcaagctgcggagcacagaggccaacaagaaggagacagagaagcagctgcaggaggccgagcaggagatggaggagatgaaggagaagatgaggaagtttgccaagagcaagcagcagaagatcctggagctggaggaggagaatgaccggctgcgggcagaggtgcaccctgctggggacacagccaaggagtgcatggagaccctgctgagcagcaatgcctccatgaaggaggagctggagcgggtgaagatggagtatgagaccctgagcaagaagttccagagcctgatgtctgagaaggacagcctgtctgaggaggtgcaggacctgaagcaccagatcgagggcaatgtgtccaagcaggccaacctggaggccacagagaagcatgacaaccagaccaacgtgacagaggagggcacccagagcatccctggagaaacagaggagcaggacagcctgtccatgagcacccggcccacctgcagcgagagcgtgcccagcgccaagagcgccaacccagctgtgtccaaggacttcagcagccatgatgagatcaacaactacctgcagcagattgaccagctgaaggagagaattgctggcctggaggaggagaagcagaagaacaaggagttcagccagaccctggagaatgagaagaacaccctgctgagccagatcagcaccaaggatggagagctgaagatgctgcaggaggaggtgaccaagatgaacctgctgaaccagcagatccaggaggagctgagccgggtgaccaagctgaaggagacagctgaggaggagaaggatgacctggaggagcggctgatgaaccagctggccgagctgaatggcagcatcggcaactactgccaggatgtgacagatgcccagatcaagaatgagctgctggagagcgagatgaagaacctgaagaagtgtgtgtctgagctggaggaggagaagcagcagctggtgaaggagaagaccaaggtggagagcgagatcaggaaggagtacctggagaagatccagggcgcccagaaggagcccggcaacaagagccacgccaaggagctgcaggagctgctgaaggagaagcagcaggaggtgaagcagctgcagaaggactgcatccgctaccaggagaagatcagcgccctggagaggacagtgaaggccctggagtttgtgcagacagagagccagaaggacctggagatcaccaaggagaacctggcccaggccgtggagcacaggaagaaggcccaggccgagctggccagcttcaaggtgctgctggatgacacccagagcgaggccgcccgggtgctggccgacaacctgaagctgaagaaggagctgcagagcaacaaggagagcgtgaagagccagatgaagcagaaggatgaggacctggagcggcggctggagcaggccgaggagaagcacctgaaggagaagaagaacatgcaggagaagctggatgccctgcggcgggagaaggtgcacctggaggagaccatcggggagatccaggtgaccctgaacaagaaggacaaggaggtgcagcagctgcaggagaacctggacagcacagtgacccagctggccgccttcaccaagtccatgagcagcctgcaggatgaccgggacagagtgattgatgaggccaagaagtgggagaggaagttcagtgatgccatccagagcaaggaggaggagatccggctgaaggaggacaactgcagcgtgctgaaggaccagctgcggcagatgagcatccacatggaggagctgaagatcaacatcagccggctggagcatgacaagcagatctgggagagcaaggcccagacagaggtgcagctgcagcagaaggtgtgtgacaccctgcagggcgagaacaaggagctgctgagccagctggaggagaccaggcacctgtaccacagcagccagaatgagctggccaagctggagagcgagctgaagagcctgaaggaccagctgacagacctgagcaacagcctggagaagtgcaaggagcagaagggcaacctggagggcatcatccggcagcaggaggccgacatccagaacagcaagttctcctatgagcagctggagacagacctgcaggccagccgggagctgaccagccggctgcacgaggagatcaacatgaaggagcagaagatcatcagcctgctgagcggcaaggaggaggccatccaggtggccatcgccgagctgcggcagcagcacgacaaggagatcaaggagctggagaacctgctgagccaggaggaggaggagaacatcgtgctggaggaggagaacaagaaggctgtggacaagaccaaccagctgatggagaccctgaagaccatcaagaaggagaacatccagcagaaggcccagctggacagctttgtgaagtccatgagcagcctgcagaatgaccgggaccgcatcgtgggggactaccagcagctggaggagcggcacctgagcatcatcctggagaaggaccagctgatccaggaggccgctgctgagaacaacaagctgaaggaggagatccggggcctgcggagccacatggatgacctgaacagtgaaaatgccaagctggatgctgagctgatccagtaccgggaggacctgaaccaggtgatcaccatcaaggacagccagcagaagcagctgctggaggtgcagctgcagcagaacaaggagctggagaacaagtatgccaagctggaggagaagctgaaggagagcgaggaggccaatgaagacctgcggcgctccttcaatgccctgcaggaggagaagcaggacctgagcaaggagattgagagcctgaaggtgtccatcagccagctgacccggcaggtgacagccctgcaggaggagggcaccctgggcctgtaccacgcccagctgaaggtgaaggaggaggaggtgcaccggctgagcgccctcttcagcagcagccagaagagaattgctgagctggaggaggagctggtgtgtgtgcagaaggaggccgccaagaaggtgggggagattgaggacaagctgaagaaggagctgaagcacctgcaccatgatgctggcatcatgagaaatgaaacagaaacagctgaggagcgggtggccgagctggcccgggacctggtggagatggagcagaagctgctgatggtgaccaaggaaaataaaggcctgacagcccagatccagagctttggccgctccatgagcagcctgcagaacagccgggaccacgccaatgaggagctggatgagctgaagaggaaatatgatgccagcctgaaggagctggcccagctgaaggagcagggcctgctgaaccgggagagagatgccctgctgtctgaaacagccttctccatgaacagcacagaggagaacagcctgagccacctggagaagctgaaccagcagctgctgagcaaggatgagcagctgctgcacctgagcagccagctggaggacagctacaaccaggtgcagagcttcagcaaggccatggccagcctgcagaatgaaagagaccacctgtggaatgagctggagaagttcaggaagtctgaggagggcaagcagaggtctgctgcccagcccagcaccagccctgctgaggtgcagagcctgaagaaggccatgagcagcctgcagaatgaccgggaccggctgctgaaggagctgaagaacctgcagcagcagtacctgcagatcaaccaggagatcacagagctgcaccccctgaaggcccagctgcaggagtaccaggacaagaccaaggccttccagatcatgcaggaggagctgcggcaggagaacctgtcctggcagcacgagctgcaccagctgaggatggagaagagctcctgggagatccacgagaggaggatgaaggagcagtacctgatggccatcagtgacaaggaccagcagctgagccacctgcagaacctgatccgggagctgcggagcagcagcagccagacccagcccctgaaggtgcagtaccagaggcaggccagccctgagaccagcgccagcccagatggcagccagaacctggtgtatgaaacagagctgctgcggacccagctgaatgacagcctgaaggagatccaccagaaggagctgcgcatccagcagctgaacagcaacttcagccagctgctggaggagaagaacaccctgagcatccagctgtgtgacaccagccagagcctgcgggagaaccagcagcactatggagacctgctgaaccactgtgctgtgctggagaagcaggtgcaggagctgcaggccggccccctgaacattgatgtggcccctggggccccccaggagaagaatggagtgcacaggaagagtgaccctgaggagctgcgggagccccagcagagcttcagcgaggcccagcagcagctgtgcaacacccggcaggaggtgaatgagctgaggaagctgctggaggaggagcgggaccagagggtggccgcagaaaatgccctgtctgtggccgaggagcagatccggcggctggagcacagcgagtgggacagcagcaggacccccatcatcggcagctgtggcacccaggagcaggccctgctgattgacctgaccagcaacagctgcaggaggaccaggtctggagtgggctggaagagggtgctgcggagcctgtgccacagcaggaccagggtgcccctgctggccgccatctacttcctgatgatccacgtgctgctgatcctgtgcttcaccggccacctgtag

SEQ ID NO: 154364 - DNA, 2919 bp, Artificial Sequence
  Description of Artificial Sequence: Synthetic coding sequence
atgaaggcccagggcggcaccgtgctgcccacagagccccagagcgaggagcagctgagcaagcatgacaagagcagcacagaggaggagatggagattgagaagatcaagcacaagctgcaggagaaggaggagctgatcagcaccctgcaggcccagctgacccaggcccaggccgagcagcctgcccagaagctgcgggtgctgcagaggaagctggaggagcacgaggagagcctggtgggccgggcccaggtggtggacctgctgcagcaggagctgacagctgctgagcagaggaaccagatcctgagccagcagctgcagcagatggaggccgagcacaacaccctgaggaacacagtggagacagagcgggaggagagcaagatcctgctggagaagatggagctggaggtggccgagaggaagctgtccttccacaacctgcaggaggagatgcaccacctgctggagcagtttgagcaggccggccaggcccaggccgagctggagagccgctacagcgccctggagcagaagcacaaggccgagatggaggagaagaccagccacatcctgagcctgcagaagacaggccaggagctgcagagcgcctgtgatgccctgaaggaccagaacagcaagctgctgcaggacaagaatgagcaggccgtgcagagcgcccagaccatccagcagctggaggaccagctgcagcagaagagcaaggagatcagccagttcctgaaccggctgcccctgcagcagcacgagacagccagccagaccagcttcccagatgtgtacaatgaaggcacccaggccgtgacagaggagaacatcgccagcctgcagaagagggtggtggagctggagaatgagaagggggccctgctgctgagcagcattgagctggaggagctgaaggccgagaatgagaagctgagcagccagatcaccctgctggaggcccagaacagaactggagaggccgaccgggaggtgtctgagatcagcatcgtggacatcgccaacaagaggagcagcagcgctgaggagagcggccaggatgtgctggagaacaccttcagccagaagcacaaggagctgtctgtgctgctgctggagatgaaggaggcccaggaggagatcgccttcctgaagctgcagctgcagggcaagagagctgaggaggccgaccacgaggtgctggaccagaaggagatgaagcagatggagggggagggcatcgcccccatcaagatgaaggtgttcctggaggacaccggccaggacttccccctgatgcccaatgaggagagcagcctgcctgctgtggagaaggagcaggccagcacagagcaccagagcaggaccagcgaggagatcagcctgaatgatgctggggtggagctgaagagcaccaagcaggatggagacaagagcctgtctgctgtgcctgacatcggccagtgccaccaggatgagctggagcggctgaagagccagatcctggagctggagctgaacttccacaaggcccaggagatctatgagaagaacctggatgagaaggccaaggagatcagcaacctgaaccagctgattgaggagttcaagaagaatgctgacaacaacagcagcgccttcaccgccctgtctgaggagcgggaccagctgctgagccaggtgaaggagctgtccatggtgacagagctgcgggcccaggtgaagcagctggagatgaacctggccgaggccgagcggcagaggcggctggactatgagagccagacagcccatgacaacctgctgacagagcagatccacagcctgagcattgaggccaagagcaaggatgtgaagattgaggtgctgcagaatgagctggatgatgtgcagctgcagttcagcgagcagagcaccctcatccgcagcctgcagagccagctgcagaacaaggagagcgaggtgctggagggcgctgagcgggtgcgccacatcagcagcaaggtggaggagctgagccaggccctgagccagaaggagctggagatcaccaagatggaccagctgctgctggagaagaagagagatgtggagaccctgcagcagaccatcgaggagaaggaccagcaggtgacagagatctccttctccatgacagagaagatggtgcagctgaatgaggagaagttcagcctgggcgtggagatcaagaccctgaaggagcagctgaacctgctgagcagagctgaggaggccaagaaggagcaggtggaggaggacaatgaggtgagcagcggcctgaagcagaactatgatgagatgagccctgctggccagatcagcaaggaggagctgcagcatgaatttgacctgctgaagaaggaaaatgagcagaggaagaggaagctgcaggccgccctgatcaacaggaaggagctgctgcagagggtgtcccggctggaggaggagctggccaacctgaaggatgagagcaagaaggagatccccctgtctgaaacagagcggggggaggtggaggaggacaaggagaacaaggagtacagcgagaagtgtgtgaccagcaagtgccaggagattgagatctacctgaagcagaccatcagcgagaaggaggtggagctgcagcacatcaggaaggacctggaggagaagctggccgctgaggagcagttccaggccctggtgaagcagatgaaccagaccctgcaggacaagaccaaccagattgacctgctgcaggccgagatcagcgagaaccaggccatcatccagaagctgatcaccagcaacacagatgccagtgatggagacagcgtggccctggtgaaggagaccgtggtgatcagccccccctgcaccggcagcagcgagcactggaagccctag

SEQ ID NO: 154365 - DNA, 126 bp, Artificial Sequence
  Description of Artificial Sequence: Synthetic coding sequence
atgctgagccggctgagcggcctggccaacgtggtgctgcacgagctgtctggagatgatgacacagaccagaacatgagggcccccctggaccctgagctgcaccaggagagtgacatggagtag

SEQ ID NO: 154366 - DNA, 4923 bp, Artificial Sequence
  Description of Artificial Sequence: Synthetic coding sequence
atgctgagccggctgagcggcctggccaacgtggtgctgcacgagctgtctggagatgatgacacagaccagaacatgagggcccccctggaccctgagctgcaccaggagagtgacatggagttcaacaacaccacccaggaggatgtgcaggagcggctggcctatgcagagcagctggtggtggagctgaaggacatcatccggcagaaggatgtgcagctgcagcagaaggatgaggccctgcaggaggagaggaaggctgctgacaacaagatcaagaagctgaagctgcacgccaaggccaagctgaccagcctgaacaagtacatcgaggagatgaaggcccagggcggcaccgtgctgcccacagagccccagagcgaggagcagctgagcaagcatgacaagagcagcacagaggaggagatggagattgagaagatcaagcacaagctgcaggagaaggaggagctgatcagcaccctgcaggcccagctgacccaggcccaggccgagcagcctgcccagagcagcacagagatggaggagtttgtgatgatgaagcagcagctgcaggagaaggaggagttcatcagcaccctgcaggcccagctgagccagacccaggccgagcaggccgcccagaagctgcgggtgctgcagaggaagctggaggagcacgaggagagcctggtgggccgggcccaggtggtggacctgctgcagcaggagctgacagctgctgagcagaggaaccagatcctgagccagcagctgcagcagatggaggccgagcacaacaccctgaggaacacagtggagacagagcgggaggagagcaagatcctgctggagaagatggagctggaggtggccgagaggaagctgtccttccacaacctgcaggaggagatgcaccacctgctggagcagtttgagcaggccggccaggcccaggccgagctggagagccgctacagcgccctggagcagaagcacaaggccgagatggaggagaagaccagccacatcctgagcctgcagaagacaggccaggagctgcagagcgcctgtgatgccctgaaggaccagaacagcaagctgctgcaggacaagaatgagcaggccgtgcagagcgcccagaccatccagcagctggaggaccagctgcagcagaagagcaaggagatcagccagttcctgaaccggctgcccctgcagcagcacgagacagccagccagaccagcttcccagatgtgtacaatgaaggcacccaggccgtgacagaggagaacatcgccagcctgcagaagagggtggtggagctggagaatgagaagggggccctgctgctgagcagcattgagctggaggagctgaaggccgagaatgagaagctgagcagccagatcaccctgctggaggcccagaacagaactggagaggccgaccgggaggtgtctgagatcagcatcgtggacatcgccaacaagaggagcagcagcgctgaggagagcggccaggatgtgctggagaacaccttcagccagaagcacaaggagctgtctgtgctgctgctggagatgaaggaggcccaggaggagatcgccttcctgaagctgcagctgcagggcaagagagctgaggaggccgaccacgaggtgctggaccagaaggagatgaagcagatggagggggagggcatcgcccccatcaagatgaaggtgttcctggaggacaccggccaggacttccccctgatgcccaatgaggagagcagcctgcctgctgtggagaaggagcaggccagcacagagcaccagagcaggaccagcgaggagatcagcctgaatgatgctggggtggagctgaagagcaccaagcaggatggagacaagagcctgtctgctgtgcctgacatcggccagtgccaccaggatgagctggagcggctgaagagccagatcctggagctggagctgaacttccacaaggcccaggagatctatgagaagaacctggatgagaaggccaaggagatcagcaacctgaaccagctgattgaggagttcaagaagaatgctgacaacaacagcagcgccttcaccgccctgtctgaggagcgggaccagctgctgagccaggtgaaggagctgtccatggtgacagagctgcgggcccaggtgaagcagctggagatgaacctggccgaggccgagcggcagaggcggctggactatgagagccagacagcccatgacaacctgctgacagagcagatccacagcctgagcattgaggccaagagcaaggatgtgaagattgaggtgctgcagaatgagctggatgatgtgcagctgcagttcagcgagcagagcaccctcatccgcagcctgcagagccagctgcagaacaaggagagcgaggtgctggagggcgctgagcgggtgcgccacatcagcagcaaggtggaggagctgagccaggccctgagccagaaggagctggagatcaccaagatggaccagctgctgctggagaagaagagagatgtggagaccctgcagcagaccatcgaggagaaggaccagcaggtgacagagatctccttctccatgacagagaagatggtgcagctgaatgaggagaagttcagcctgggcgtggagatcaagaccctgaaggagcagctgaacctgctgagcagagctgaggaggccaagaaggagcaggtggaggaggacaatgaggtgagcagcggcctgaagcagaactatgatgagatgagccctgctggccagatcagcaaggaggagctgcagcatgaatttgacctgctgaagaaggaaaatgagcagaggaagaggaagctgcaggccgccctgatcaacaggaaggagctgctgcagagggtgtcccggctggaggaggagctggccaacctgaaggatgagagcaagaaggagatccccctgtctgaaacagagcggggggaggtggaggaggacaaggagaacaaggagtacagcgagaagtgtgtgaccagcaagtgccaggagattgagatctacctgaagcagaccatcagcgagaaggaggtggagctgcagcacatcaggaaggacctggaggagaagctggccgctgaggagcagttccaggccctggtgaagcagatgaaccagaccctgcaggacaagaccaaccagattgacctgctgcaggccgagatcagcgagaaccaggccatcatccagaagctgatcaccagcaacacagatgccagtgatggagacagcgtggccctggtgaaggagaccgtggtgatcagccccccctgcaccggcagcagcgagcactggaagccagagctggaggagaagatcctggccctggagaaggagaaggagcagctgcagaagaagctgcaggaggccctgaccagcaggaaggccatcctgaagaaggcccaggagaaggagcggcacctgcgggaggagctgaagcagcagaaggatgactacaaccggctgcaggagcagtttgatgagcagagcaaagaaaatgaaaatattggagaccagctgcggcagctgcagatccaggtgcgggagagcattgatggcaagctgcccagcacagaccagcaggagagctgcagcagcaccccaggcctggaggagcccctcttcaaggccacagagcagcaccacacccagcctgtgctggagagcaacctgtgcccagactggcccagccacagtgaagatgccagcgccctgcagggcggcacctctgtggcccagatcaaggcccagctgaaggagattgaggccgagaaggtggagctggagctgaaggtgagcagcaccaccagcgagctgaccaagaagtctgaggaggtgttccagctgcaggagcagatcaacaagcagggcctggagattgagagcctgaagacagtgtcccatgaagctgaggtgcatgctgagagcctgcagcagaagctggagagcagccagctgcagattgctggcctggagcacctgcgggagctgcagcccaagctggatgagctgcagaagctgatcagcaagaaggaggaggatgtgtcctacctgagcggccagctgtctgagaaggaggccgccctgaccaagatccagacagagatcatcgagcaggaggacctgatcaaggccctgcacacccagctggagatgcaggccaaggagcatgatgagcgcatcaagcagctgcaggtggagctgtgtgagatgaagcagaagccagaggagattggagaggagagccgggccaagcagcagatccagaggaagctgcaggccgccctgatcagcaggaaggaggccctgaaggagaacaagagcctgcaggaggagctgagcctggcccggggcaccatcgagcggctgaccaagagcctggctgatgtggagagccaggtgtctgcccagaacaaggagaaggacacagtgctgggccgcctggccctgctgcaggaggagcgggacaagctgatcacagagatggacaggagcctgctggagaaccagagcctgagcagcagctgtgagagcctgaagctggccctggagggcctgacagaggacaaggagaagctggtgaaggagattgagagcctgaagagcagcaagattgctgagagcacagagtggcaggagaagcacaaggagctgcagaaggagtatgagatcctgctgcagagctatgaaaatgtgtccaatgaagctgagcgcatccagcacgtggtggaggccgtgcggcaggagaagcaggagctgtatggcaagctgcggagcacagaggccaacaagaaggagacagagaagcagctgcaggaggccgagcaggagatggaggagatgaaggagtag

SEQ ID NO: 154367 - DNA, 9810 bp, Artificial Sequence
  Description of Artificial Sequence: Synthetic coding sequence
atgctgagccggctgagcggcctggccaacgtggtgctgcacgagctgtctggagatgatgacacagaccagaacatgagggcccccctggaccctgagctgcaccaggagagtgacatggagttcaacaacaccacccaggaggatgtgcaggagcggctggcctatgcagagcagctggtggtggagctgaaggacatcatccggcagaaggatgtgcagctgcagcagaaggatgaggccctgcaggaggagaggaaggctgctgacaacaagatcaagaagctgaagctgcacgccaaggccaagctgaccagcctgaacaagtacatcgaggagatgaaggcccagggcggcaccgtgctgcccacagagccccagagcgaggagcagctgagcaagcatgacaagagcagcacagaggaggagatggagattgagaagatcaagcacaagctgcaggagaaggaggagctgatcagcaccctgcaggcccagctgacccaggcccaggccgagcagcctgcccagagcagcacagagatggaggagtttgtgatgatgaagcagcagctgcaggagaaggaggagttcatcagcaccctgcaggcccagctgagccagacccaggccgagcaggccgcccagctgagctccatgcagcaggtggtgcgggagaaggatgccaggtttgagacccaggtgcggctgcatgaagatgagctgctgcagctggtgacccaggctgatgtggagacagagatgcagcagaagctgcgggtgctgcagaggaagctggaggagcacgaggagagcctggtgggccgggcccaggtggtggacctgctgcagcaggagctgacagctgctgagcagaggaaccagatcctgagccagcagctgcagcagatggaggccgagcacaacaccctgaggaacacagtggagacagagcgggaggagagcaagatcctgctggagaagatggagctggaggtggccgagaggaagctgtccttccacaacctgcaggaggagatgcaccacctgctggagcagtttgagcaggccggccaggcccaggccgagctggagagccgctacagcgccctggagcagaagcacaaggccgagatggaggagaagaccagccacatcctgagcctgcagaagacaggccaggagctgcagagcgcctgtgatgccctgaaggaccagaacagcaagctgctgcaggacaagaatgagcaggccgtgcagagcgcccagaccatccagcagctggaggaccagctgcagcagaagagcaaggagatcagccagttcctgaaccggctgcccctgcagcagcatgaaacagccagccagaccagcttcccagatgtgtacaatgaaggcacccaggccgtgacagaagaaaatattgccagcctgcagaagagggtggtggagctggagaatgaaaaaggagccctgctgctgagcagcattgagctggaggagctgaaggcagaaaatgagaagctgagcagccagatcaccctgctggaggcccagaacagaactggagaggccgaccgggaggtgtctgagatcagcatcgtggacatcgccaacaagaggagcagcagcgctgaggagagcggccaggatgtgctggagaacaccttcagccagaagcacaaggagctgtctgtgctgctgctggagatgaaggaggcccaggaggagatcgccttcctgaagctgcagctgcagggcaagagagctgaggaggccgaccacgaggtgctggaccagaaggagatgaagcagatggagggggagggcatcgcccccatcaagatgaaggtgttcctggaggacaccggccaggacttccccctgatgcccaatgaggagagcagcctgcctgctgtggagaaggagcaggccagcacagagcaccagagcaggaccagcgaggagatcagcctgaatgatgctggggtggagctgaagagcaccaagcaggatggagacaagagcctgtctgctgtgcctgacatcggccagtgccaccaggatgagctggagcggctgaagagccagatcctggagctggagctgaacttccacaaggcccaggagatctatgagaagaacctggatgagaaggccaaggagatcagcaacctgaaccagctgattgaggagttcaagaagaatgctgacaacaacagcagcgccttcaccgccctgtctgaggagcgggaccagctgctgagccaggtgaaggagctgtccatggtgacagagctgcgggcccaggtgaagcagctggagatgaacctggccgaggccgagcggcagaggcggctggactatgagagccagacagcccatgacaacctgctgacagagcagatccacagcctgagcattgaggccaagagcaaggatgtgaagattgaggtgctgcagaatgagctggatgatgtgcagctgcagttcagcgagcagagcaccctcatccgcagcctgcagagccagctgcagaacaaggagagcgaggtgctggagggcgctgagcgggtgcgccacatcagcagcaaggtggaggagctgagccaggccctgagccagaaggagctggagatcaccaagatggaccagctgctgctggagaagaagagagatgtggagaccctgcagcagaccatcgaggagaaggaccagcaggtgacagagatctccttctccatgacagagaagatggtgcagctgaatgaggagaagttcagcctgggcgtggagatcaagaccctgaaggagcagctgaacctgctgagcagagctgaggaggccaagaaggagcaggtggaggaggacaatgaggtgagcagcggcctgaagcagaactatgatgagatgagccctgctggccagatcagcaaggaggagctgcagcacgagtttgacctgctgaagaaggaaaatgagcagaggaagaggaagctgcaggccgccctgatcaacaggaaggagctgctgcagagggtgtcccggctggaggaggagctggccaacctgaaggatgagagcaagaaggagatccccctgtctgaaacagagcggggggaggtggaggaggacaaggagaacaaggagtacagcgagaagtgtgtgaccagcaagtgccaggagattgagatctacctgaagcagaccatcagcgagaaggaggtggagctgcagcacatcaggaaggacctggaggagaagctggccgctgaggagcagttccaggccctggtgaagcagatgaaccagaccctgcaggacaagaccaaccagattgacctgctgcaggccgagatcagcgagaaccaggccatcatccagaagctgatcaccagcaacacagatgccagtgatggagacagcgtggccctggtgaaggagaccgtggtgatcagccccccctgcaccggcagcagcgagcactggaagccagagctggaggagaagatcctggccctggagaaggagaaggagcagctgcagaagaagctgcaggaggccctgaccagcaggaaggccatcctgaagaaggcccaggagaaggagcggcacctgcgggaggagctgaagcagcagaaggatgactacaaccggctgcaggagcagtttgatgagcagagcaaagaaaatgaaaacatcggggaccagctgcggcagctgcagatccaggtgcgggagagcattgatggcaagctgcccagcacagaccagcaggagagctgcagcagcaccccaggcctggaggagcccctcttcaaggccacagagcagcaccacacccagcctgtgctggagagcaacctgtgcccagactggcccagccacagtgaagatgccagcgccctgcagggcggcacctctgtggcccagatcaaggcccagctgaaggagattgaagctgagaaggtggagctggagctgaaggtgagcagcaccaccagcgagctgaccaagaagtctgaggaggtgttccagctgcaggagcagatcaacaagcagggcctggagattgagagcctgaagacagtgtcccatgaggccgaggtgcacgccgagagcctgcagcagaagctggagagcagccagctgcagattgctggcctggagcacctgcgggagctgcagcccaagctggatgagctgcagaagctgatcagcaagaaggaggaggatgtgtcctacctgagcggccagctgtctgagaaggaggccgccctgaccaagatccagacagagatcatcgagcaggaggacctgatcaaggccctgcacacccagctggagatgcaggccaaggagcatgatgagcgcatcaagcagctgcaggtggagctgtgtgagatgaagcagaagccagaggagatcggggaggagagccgggccaagcagcagatccagaggaagctgcaggccgccctgatcagcaggaaggaggccctgaaggagaacaagagcctgcaggaggagctgagcctggcccggggcaccatcgagcggctgaccaagagcctggctgatgtggagagccaggtgtctgcccagaacaaggagaaggacacagtgctgggccgcctggccctgctgcaggaggagcgggacaagctgatcacagagatggacaggagcctgctggagaaccagagcctgagcagcagctgtgagagcctgaagctggccctggagggcctgacagaggacaaggagaagctggtgaaggagattgagagcctgaagagcagcaagattgctgagagcacagagtggcaggagaagcacaaggagctgcagaaggagtatgagatcctgctgcagagctatgaaaatgtgtccaatgaggccgagcgcatccagcacgtggtggaggccgtgcggcaggagaagcaggagctgtatggcaagctgcggagcacagaggccaacaagaaggagacagagaagcagctgcaggaggccgagcaggagatggaggagatgaaggagaagatgaggaagtttgccaagagcaagcagcagaagatcctggagctggaggaggagaatgaccggctgcgggcagaggtgcaccctgctggggacacagccaaggagtgcatggagaccctgctgagcagcaatgcctccatgaaggaggagctggagcgggtgaagatggagtatgagaccctgagcaagaagttccagagcctgatgtctgagaaggacagcctgtctgaggaggtgcaggacctgaagcaccagatcgagggcaatgtgtccaagcaggccaacctggaggccacagagaagcatgacaaccagaccaacgtgacagaggagggcacccagagcatccctggagaaacagaggagcaggacagcctgtccatgagcacccggcccacctgcagcgagagcgtgcccagcgccaagagcgccaacccagctgtgtccaaggacttcagcagccatgatgagatcaacaactacctgcagcagattgaccagctgaaggagagaattgctggcctggaggaggagaagcagaagaacaaggagttcagccagaccctggagaatgagaagaacaccctgctgagccagatcagcaccaaggatggagagctgaagatgctgcaggaggaggtgaccaagatgaacctgctgaaccagcagatccaggaggagctgagccgggtgaccaagctgaaggagacagctgaggaggagaaggatgacctggaggagcggctgatgaaccagctggccgagctgaatggcagcatcggcaactactgccaggatgtgacagatgcccagatcaagaatgagctgctggagagcgagatgaagaacctgaagaagtgtgtgtctgagctggaggaggagaagcagcagctggtgaaggagaagaccaaggtggagagcgagatcaggaaggagtacctggagaagatccagggcgcccagaaggagcccggcaacaagagccacgccaaggagctgcaggagctgctgaaggagaagcagcaggaggtgaagcagctgcagaaggactgcatccgctaccaggagaagatcagcgccctggagaggacagtgaaggccctggagtttgtgcagacagagagccagaaggacctggagatcaccaaggagaacctggcccaggccgtggagcacaggaagaaggcccaggccgagctggccagcttcaaggtgctgctggatgacacccagagcgaggccgcccgggtgctggccgacaacctgaagctgaagaaggagctgcagagcaacaaggagagcgtgaagagccagatgaagcagaaggatgaggacctggagcggcggctggagcaggccgaggagaagcacctgaaggagaagaagaacatgcaggagaagctggatgccctgcggcgggagaaggtgcacctggaggagaccatcggggagatccaggtgaccctgaacaagaaggacaaggaggtgcagcagctgcaggagaacctggacagcacagtgacccagctggccgccttcaccaagtccatgagcagcctgcaggatgaccgggacagagtgattgatgaggccaagaagtgggagaggaagttcagtgatgccatccagagcaaggaggaggagatccggctgaaggaggacaactgcagcgtgctgaaggaccagctgcggcagatgagcatccacatggaggagctgaagatcaacatcagccggctggagcatgacaagcagatctgggagagcaaggcccagacagaggtgcagctgcagcagaaggtgtgtgacaccctgcagggcgagaacaaggagctgctgagccagctggaggagaccaggcacctgtaccacagcagccagaatgagctggccaagctggagagcgagctgaagagcctgaaggaccagctgacagacctgagcaacagcctggagaagtgcaaggagcagaagggcaacctggagggcatcatccggcagcaggaggccgacatccagaacagcaagttctcctatgagcagctggagacagacctgcaggccagccgggagctgaccagccggctgcacgaggagatcaacatgaaggagcagaagatcatcagcctgctgagcggcaaggaggaggccatccaggtggccatcgccgagctgcggcagcagcacgacaaggagatcaaggagctggagaacctgctgagccaggaggaggaggagaacatcgtgctggaggaggagaacaagaaggctgtggacaagaccaaccagctgatggagaccctgaagaccatcaagaaggagaacatccagcagaaggcccagctggacagctttgtgaagtccatgagcagcctgcagaatgaccgggacagaattgtgggggactaccagcagctggaggagcggcacctgagcatcatcctggagaaggaccagctgatccaggaggccgctgctgagaacaacaagctgaaggaggagatccggggcctgcggagccacatggatgacctgaacagtgaaaatgccaagctggatgctgagctgatccagtaccgggaggacctgaaccaggtgatcaccatcaaggacagccagcagaagcagctgctggaggtgcagctgcagcagaacaaggagctggagaacaagtatgccaagctggaggagaagctgaaggagagcgaggaggccaatgaagacctgcggcgctccttcaatgccctgcaggaggagaagcaggacctgagcaaggagattgagagcctgaaggtgtccatcagccagctgacccggcaggtgacagccctgcaggaggagggcaccctgggcctgtaccacgcccagctgaaggtgaaggaggaggaggtgcaccggctgagcgccctcttcagcagcagccagaagagaattgctgagctggaggaggagctggtgtgtgtgcagaaggaggccgccaagaaggtgggggagattgaggacaagctgaagaaggagctgaagcacctgcaccatgatgctggcatcatgagaaatgaaacagaaacagctgaggagcgggtggccgagctggcccgggacctggtggagatggagcagaagctgctgatggtgaccaaggagaacaagggcctgacagcccagatccagagctttggccgctccatgagcagcctgcagaacagccgggaccacgccaatgaggagctggatgagctgaagaggaaatatgatgccagcctgaaggagctggcccagctgaaggagcagggcctgctgaaccgggagagagatgccctgctgtctgaaacagccttctccatgaacagcacagaggagaacagcctgagccacctggagaagctgaaccagcagctgctgagcaaggatgagcagctgctgcacctgagcagccagctggaggacagctacaaccaggtgcagagcttcagcaaggccatggccagcctgcagaatgaaagagaccacctgtggaatgagctggagaagttcaggaagtctgaggagggcaagcagaggtctgctgcccagcccagcaccagccctgctgaggtgcagagcctgaagaaggccatgagcagcctgcagaatgaccgggaccggctgctgaaggagctgaagaacctgcagcagcagtacctgcagatcaaccaggagatcacagagctgcaccccctgaaggcccagctgcaggagtaccaggacaagaccaaggccttccagatcatgcaggaggagctgcggcaggagaacctgtcctggcagcacgagctgcaccagctgaggatggagaagagctcctgggagatccatgaaagaaggatgaaggagcagtacctgatggccatcagtgacaaggaccagcagctgagccacctgcagaacctgatccgggagctgcggagcagcagcagccagacccagcccctgaaggtgcagtaccagaggcaggccagccctgagaccagcgccagcccagatggcagccagaacctggtgtatgaaacagagctgctgcggacccagctgaatgacagcctgaaggagatccaccagaaggagctgcgcatccagcagctgaacagcaacttcagccagctgctggaggagaagaacaccctgagcatccagctgtgtgacaccagccagagcctgcgggagaaccagcagcactacggggacctgctgaaccactgtgctgtgctggagaagcaggtgcaggagctgcaggccgtgtccaaggagaagggccccctgaacattgatgtggcccctggggccccccaggagaagaatggagtgcacaggaagagtgaccctgaggagctgcgggagccccagcagagcttcagcgaggcccagcagcagctgtgcaacacccggcaggaggtgaatgagctgaggaagctgctggaggaggagcgggaccagagggtggccgcagaaaatgccctgtctgtggccgaggagcagatccggcggctggagcacagcgagtgggacagcagcaggacccccatcatcggcagctgtggcacccaggagcaggccctgctgattgacctgaccagcaacagctgcaggaggaccaggtctggagtgggctggaagagggtgctgcggagcctgtgccacagcaggaccagggtgcccctgctggccgccatctacttcctgatgatccacgtgctgctgatcctgtgcttcaccggccacctgtag

SEQ ID NO: 154368 - DNA, 741 bp, Artificial Sequence
  Description of Artificial Sequence: Synthetic coding sequence
atgtcctgggccgctgtgctggccgtggccgccgcccgcttcggccacttctggggctgccgctggccaggccccatggcccagggctgggccggcttcagcgaggaggagctgcggcggctgaagcagaccaaggacccctttgagccccagaggcggctgcctgccaagaagagccggcagcagctgcagcgggagaaggccctggtggagcagagccagaagctgggcctgcaggacggcagcaccagcctgctgcctgagcagctgctgagcgcccccaagcagagggtgaatgtgcagaagccacccttcagcagccccaccctgcccagccacttcaccctgaccagccctgtgggagatggccagccccagggcatcgagagccagcccaaggagctgggcctggagaacagccatgatggccacaacaacgtggagatcctgccccccaagccagactgcaagctggagaagaagaaggtggagctgcaggagaagagccgctgggaggtgctgcagcaggagcagaggctgatggaggagaagaacaagaggaagaaggccctgctggccaaggccatcgccgagaggagcaagaggacccaggccgagaccatgaagctgaagaggatccagaaggagctgcaggccctggatgacatggtgtctgctgacatcggcatcctgaggaacagaattgaccaggccagcctggactacagctatgccaggtag

SEQ ID NO: 154369 - DNA, 1185 bp, Artificial Sequence
  Description of Artificial Sequence: Synthetic coding sequence
atgtcctgggccgctgtgctggccgtggccgccgcccgcttcggccacttctggggctgccgctggccaggccccatggcccagggctgggccggcttcagcgaggaggagctgcggcggctgaagcagaccaaggacccctttgagccccagaggcggctgcctgccaagaagagccggcagcagctgcagcgggagaaggccctggtggagcagagccagaagctgggcctgcaggacggcagcaccagcctgctgcctgagcagctgctgagcgcccccaagcagagggtgaatgtgcagaagccacccttcagcagccccaccctgcccagccacttcaccctgaccagccctgtgggagatggccagccccagggcatcgagagccagcccaaggagctgggcctggagaacagccatgatggccacaacaacgtggagatcctgccccccaagccagactgcaagctggagaagaagaaggtggagctgcaggagaagagccgctgggaggtgctgcagcaggagcagaggctgatggaggagaagaacaagaggaagaaggccctgctggccaaggccatcgccgagaggagcaagaggacccaggccgagaccatgaagctgaagaggatccagaaggagctgcaggccctggatgacatggtgtctgctgacatcggcatcctgaggaacagaattgaccaggccagcctggactacagctatgccaggaagagatttgacagagctgaggccgagtacatcgccgccaagctggacatccagaggaagacagagatcaaggagcagctgacagagcacctgtgcaccatcatccagcagaatgagctgaggaaggccaagaagctggaggagctgatgcagcagctggatgtggaggctgatgaggagaccctggagctggaggtggaggtggagcggctgctgcacgagcaggaggtggagagccggcggcctgtggtgcggctggagcggcccttccagcctgctgaggagagcgtgaccctggagtttgccaaggagaacaggaagtgccaggagcaggccgtgagccccaaggtggatgaccagtgtggcaacagcagcagcatccccttcctgagccccaactgccccaaccaggagggcaatgacatctctgctgccctggccacctag

SEQ ID NO: 154370 - DNA, 855 bp, Artificial Sequence
  Description of Artificial Sequence: Synthetic coding sequence
atgcccctggatgccacctggaacatcaccgtgcagtggctggccgtggacatcgcctgcaggaccctgatgttcctgaagctgatggccacctacagcgctgccttcctgcctgtggtgattggcctggaccggcaggccgctgtgctgaaccccctgggcagccgctctggagtgaggaagctgctgggcgccgcctggggcctgtccttcctgctggccttcccccagctgttcctgttccacacagtggccggccctgtgcccttcacccagtgtgtgaccaagggcagcttcaaggcccagtggcaggagaccacctacaacctcttcaccttctgctgcctcttcctgctgcccctgacagccatggccatctgctacagcagaattgtgctgtctgtgtcccggccccagaccaggaagggcagccacgccccagctggggagtttgccctgcccaggagctttgacaactgcccccgggtgcggctgcgggccctgcggctggccctgctgatcctgctgaccttcatcctgtgctggaccccctactacctgctgggcatgtggtactggttcagccccaccatgctgacagaggtgccccccagcctgagccacatcctcttcctgctgggcctgctgaatgcccccctggaccccctgctgtatggagccttcaccctgggctgcagaagaggccaccaggagctgagcattgacagcagcaaggagggcagcggccgcatgctgcaggaggagatccacgccttccggcagctggaggtgcagaagacagtgaccagcagaagagctggggagaccaagggcatcagcatcaccagcatctag

SEQ ID NO: 154371 - DNA, 873 bp, Artificial Sequence
  Description of Artificial Sequence: Synthetic coding sequence
atgtctgctggaaatggcaccccctgggatgccacctggaacatcaccgtgcagtggctggccgtggacatcgcctgcaggaccctgatgttcctgaagctgatggccacctacagcgctgccttcctgcctgtggtgattggcctggaccggcaggccgctgtgctgaaccccctgggcagccgctctggagtgaggaagctgctgggcgccgcctggggcctgtccttcctgctggccttcccccagctgttcctgttccacacagtggccggccctgtgcccttcacccagtgtgtgaccaagggcagcttcaaggcccagtggcaggagaccacctacaacctcttcaccttctgctgcctcttcctgctgcccctgacagccatggccatctgctacagcagaattgtgctgtctgtgtcccggccccagaccaggaagggcagccacgccccagctggggagtttgccctgcccaggagctttgacaactgcccccgggtgcggctgcgggccctgcggctggccctgctgatcctgctgaccttcatcctgtgctggaccccctactacctgctgggcatgtggtactggttcagccccaccatgctgacagaggtgccccccagcctgagccacatcctcttcctgctgggcctgctgaatgcccccctggaccccctgctgtatggagccttcaccctgggctgcagaagaggccaccaggagctgagcattgacagcagcaaggagggcagcggccgcatgctgcaggaggagatccacgccttccggcagctggaggtgcagaagacagtgaccagcagaagagctggggagaccaagggcatcagcatcaccagcatctag

SEQ ID NO: 154372 - DNA, 363 bp, Artificial Sequence
  Description of Artificial Sequence: Synthetic coding sequence
atggccagcagcagaagaggcctgctgctgctgctgctgctgacagcccacctgggccccagcgaggcccagcactggagccacggctggtacccaggcggcaagagggccctgagcagcgcccaggacccccagaatgccctgcggcccccaggccgggccctggacacagctgctggcagccctgtgcagacagcccacggcctgcccagtgatgccctggcccccctggatgacagcatgccctgggagggccgcaccacagcccagtggagcctgcacaggaagaggcacctggcccggaccctgctgacagctgcccgggagcccaggcctgccccacccagcagcaacaaggtgtag

SEQ ID NO: 154373 - DNA, 342 bp, Artificial Sequence
  Description of Artificial Sequence: Synthetic coding sequence
atggccagcagcagaagaggcctgctgctgctgctgctgctgacagcccacctgggccccagcgaggcccagcactggagccacggctggtacccaggcggcaagagggccctgagcagcgcccaggacccccagaatgccctgcggcccccagctggcagccctgtgcagacagcccacggcctgcccagtgatgccctggcccccctggatgacagcatgccctgggagggccgcaccacagcccagtggagcctgcacaggaagaggcacctggcccggaccctgctgacagctgcccgggagcccaggcctgccccacccagcagcaacaaggtgtag

SEQ ID NO: 154374 - DNA, 339 bp, Artificial Sequence
  Description of Artificial Sequence: Synthetic coding sequence
atggccagcagcagaagaggcctgctgctgctgctgctgctgacagcccacctgggccccagcgaggcccagcactggagccacggctggtacccaggcggcaagagggccctgagcagcgcccaggacccccagaatgccctgcggcccccaggcagccctgtgcagacagcccacggcctgcccagtgatgccctggcccccctggatgacagcatgccctgggagggccgcaccacagcccagtggagcctgcacaggaagaggcacctggcccggaccctgctgacagctgcccgggagcccaggcctgccccacccagcagcaacaaggtgtag

SEQ ID NO: 154375 - DNA, 339 bp, Artificial Sequence; identical to SEQ ID NO: 154374
  Description of Artificial Sequence: Synthetic coding sequence

SEQ ID NO: 154376 - DNA, 342 bp, Artificial Sequence; identical to SEQ ID NO: 154373
  Description of Artificial Sequence: Synthetic coding sequence

SEQ ID NO: 154377 - DNA, 945 bp, Artificial Sequence
  Description of Artificial Sequence: Synthetic coding sequence
atgtacaagatggagtacagctacctgaacagcagcgcctatgagagctgcatggccggcatggacaccagcagcctggccagcgcctatgctgacttcagcagctgcagccaggccagcggcttccagtacaaccccatccgcaccacctttggagccaccagcggctgccccagcctgaccccaggcagctgcagcctgggcaccctgcgggaccaccagagcagcccctatgctgctgtgccctacaagctgttcacagaccatggaggcctgaatgagaagaggaagcagaggcgcatccgcaccaccttcaccagcgcccagctgaaggagctggagcgggtgtttgctgagacccactacccagacatctacacccgggaggagctggccctgaagattgacctgacagaggcccgggtgcaggtgtggttccagaacagaagagccaagttcaggaagcaggagagagctgctgctgctgctgctgctgctgccaagaatggcagcagcggcaagaagagtgacagcagcagagatgatgagagcaaggaggccaagagcacagatcctgacagcactggaggccctggccccaaccccaaccccacccccagctgtggggccaatggaggcggcggcggcggccccagccctgctggggcccctggagctgctggccctgggggccctggaggagagcccgggaagggcggcgctgctgctgctgctgctgctgctgctgctgctgctgctgctgctgctgctgctgctgctgggggcctggccgccgccggcggccctggccagggctgggcccctggccctggccccatcaccagcatcccagacagcctgggcggcccctttgcctctgtgctgagcagcctgcagaggcccaacggggccaaggccgccctggtgaagagctccatgttttag

SEQ ID NO: 154378 - DNA, 750 bp, Artificial Sequence
  Description of Artificial Sequence: Synthetic coding sequence
atggccaacagcgccagccctgagcagaaccagaaccactgcagcgccatcaacaacagcatccccctgatgcagggcaacctgcccaccctgaccctgagcggcaagatccgggtgacagtgaccttcttcctgttcctgctgagcgccaccttcaatgccagcttcctgctgaagctgcagaagtggacccagaagaaggagaagggcaagaagctgagcaggatgaagctgctgctgaagcacctgaccctggccaacctgctggagaccctgattgtgatgcccctggatggcatgtggaacatcaccgtgcagtggtacgccggggagctgctgtgcaaggtgctgagctacctgaagctgttctccatgtatgccccagccttcatgatggtggtgatcagcctggacaggagcctggccatcacccggcccctggccctgaagagcaacagcaaggtgggccagagcatggtgggcctggcctggatcctgagctctgtgtttgctggcccccagctgcccctgcaccaccccagcttccaccacgccgacctgcagtgcaagaaccacctgcacccagacaccggccccagcagcggcccccccaggaccaccacagagagcgtgcaggagcagtacaccaagagcacagctgaggacagcaagaatgatggctgcatctgccacttcatctactgcctgctggacagcctgctgtgccccaggaacctggtgctggtgtag

SEQ ID NO: 154379 - DNA, 2055 bp, Artificial Sequence
  Description of Artificial Sequence: Synthetic coding sequence
atggaggagaacctgatctccatgagggaggaccacagcttccacgtgcgctacaggatggaggccagctgcctggagctggccctggagggggagcggctgtgcaagagcggggactgccgggccggcgtgtccttctttgaagctgctgtgcaggtgggcacagaggacctgaagaccctgagcgccatctacagccagctgggcaatgcctacttctacctgcatgactatgccaaggccctggagtaccaccaccacgacctgaccctggcccggaccatcggggaccagctgggggaggccaaggccagcggcaacctgggcaacaccctgaaggtgctgggcaactttgatgaggccatcgtgtgctgccagaggcacctggacatcagccgggagctgaatgacaaggtgggggaggcccgggccctgtacaacctgggcaatgtgtaccacgccaagggcaagagctttggctgccccggcccccaggatgtgggggagttccctgaggaggtgagagatgccctgcaggccgctgtggacttctatgaggagaacctgagcctggtgacagccctgggggacagagctgcccagggccgggcctttggaaacctgggcaacacccactacctgctgggcaacttcagagatgctgtgattgcccacgagcagaggctgctgattgccaaggagtttggagacaaggctgctgagcggcgggcctacagcaacctgggcaatgcctacatcttcctgggggagtttgaaacagccagcgagtactacaagaagaccctgctgctggcccggcagctgaaggacagagctgtggaggcccagagctgctacagcctgggcaacacctacaccctgctgcaggactatgagaaggccatcgactaccacctgaagcacctggccatcgcccaggagctgaatgacagaattggagagggccgggcctgctggagcctgggcaatgcctacacagccctgggcaaccacgaccaggccatgcactttgctgagaagcacctggagatcagccgggaggtgggggacaagtctggagagctgacagcccggctgaacctgagtgacctgcagatggtgctgggcctgagctacagcaccaacaacagcatcatgtctgagaacacagaaattgacagcagcctgaatggagtgcggcccaagctgggcagaagacacagcatggagaacatggagctgatgaagctgaccccagagaaggtgcagaactggaacagcgagatcctggccaagcagaagcccctgattgccaagcccagcgccaagctgctgtttgtgaaccggctgaagggcaagaagtacaagaccaacagcagcaccaaggtgctgcaggatgccagcaacagcattgaccaccgcatccccaacagccagaggaagatctctgctgacaccatcggagatgagggcttctttgacctgctgagccgcttccagagcaacaggatggatgaccagcgctgctgcctgcaggagaagaactgccacacagccagcaccaccaccagcagcaccccacccaagatgatgctgaagaccagctctgtgcctgtggtgagccccaacacagatgagttcctggacctgctggccagcagccagagccggcggctggatgaccagagggccagcttcagcaacctgcccggcctgcggctgacccagaacagccagagcgtgctgagccacctgatgaccaatgacaacaaggaggctgatgaggacttctttgacatcctggtgaagtgccagggcagccggctggatgaccagagatgtgcccctcctccagccaccaccaagggccccaccgtgcctgatgaggacttcttcagcctcatcctgcggagccagggcaagaggatggatgagcagagggtgctgctgcagagggaccagaacagagacacagactttggcctgaaggacttcctgcagaacaatgccctgctggagttcaagaacagcggcaagaagtctgctgaccactag

SEQ ID NO: 154380 - DNA, 2055 bp, Artificial Sequence; identical to SEQ ID NO: 154379
  Description of Artificial Sequence: Synthetic coding sequence

SEQ ID NO: 154381 - DNA, 228 bp, Artificial Sequence
  Description of Artificial Sequence: Synthetic coding sequence
atggaggagaacctgatctccatgagggaggaccacagcttccacgtgcgctacaggatggaggccagctgcctggagctggccctggagggggagcggctgtgcaagagcggggactgccgggccggcgtgtccttctttgaagctgctgtgcaggtgggcacagaggacctgaagaccctgagcgccatctacagccagctgggcaatgcctacttctacctgtag

SEQ ID NO: 154382 - DNA, 642 bp, Artificial Sequence
  Description of Artificial Sequence: Synthetic coding sequence
atggaggagaacctgatctccatgagggaggaccacagcttccacgtgcgctacaggatggaggccagctgcctggagctggccctggagggggagcggctgtgcaagagcggggactgccgggccggcgtgtccttctttgaagctgctgtgcaggtgggcacagaggacctgaagaccctgagcgccatctacagccagctgggcaatgcctacttctacctgcatgactatgccaaggccctggagtaccaccaccacgacctgaccctggcccggaccatcggggaccagctgggggaggccaaggccagcggcaacctgggcaacaccctgaaggtgctgggcaactttgatgaggccatcgtgtgctgccagaggcacctggacatcagccgggagctgaatgacaaggtgggggaggcccgggccctgtacaacctgggcaatgtgtaccacgccaagggcaagagctttggctgccccggcccccaggatgtgggggagttccctgaggaggtgagagatgccctgcaggccgctgtggacttctatgaggagaacctgagcctggtgacagccctgggggacagagctgcccagggccgggcctttggaaacctgggcaacacccactactag

SEQ ID NO: 154383 - DNA, 159 bp, Artificial Sequence
  Description of Artificial Sequence: Synthetic coding sequence
atggaggagaacctgatctccatgagggaggaccacagcttccacgtgcgctacaggatggaggccagctgcctggagctggccctggagggggagcggctgtgcaagagcggggactgccgggccggcgtgtccttctttgaagctgctgtgcagtag

SEQ ID NO: 154384 - DNA, 1290 bp, Artificial Sequence
  Description of Artificial Sequence: Synthetic coding sequence
atggccagcctgtgggagagcccccagcagtgcatcatcctgagccccctgagcggctggtggttcagcatcggcatcagcatcctgaccagcagcgccctggtgctgaagccccagatgctgaagggggagctgcagacccggcccagccagaggcccagcaggaaggccttcagaagaaacaactttgagtacaccctggaggccagcaagagcctgcggcagaagccaggggacagcaccatgacctacctgaacaagggccagttctaccccatcaccctgaaggaggtgagcagcagcgagggcatccaccaccccatcagcaaggtgcgcagcgtcatcatggtggtgtttgctgaggacaagagccgggaggaccagctgcggcactggaagtactggcacagccggcagcacacagccaagcagcgctgcattgatattgctgactacaaggagagcttcaacaccatcagcaacatcgaggagatcgcctacaatgccatctccttcacctgggacatcaatgatgaggccaaggtgttcatctctgtgaactgcctgagcacagacttcagcagccagaagggcgtgaagggcctgcccctgaacatccaggtggacacctacagctacaacaacagaagcaacaagcctgtgcaccgggcctactgccagatcaaggtgttctgtgacaagggagctgagaggaagatcagagatgaggagaggaagcagagcaagaggaaggtgtctgatgtgaaggtgcccctgctgcccagccacaagaggatggacatcaccgtcttcaagcccttcatcgacctggacacccagcctgtgctcttcatcccagatgtgcactttgccaacctgcagaggggcacccacgtgctgcccatcgccagcgaggagctggagggggagggctctgtgctgaagaggggcccctatggaacagaagatgactttgctgtgccccccagcaccaagctggcccgcatcgaggagcccaagagggtgctgctgtatgtgaggaaggagagcgaggaggtgtttgatgccctgatgctgaagacccccagcctgaagggcctgatggaggccatcagtgacaagtatgatgtgccccatgacaagattggcaagatcttcaagaagtgcaagaagggcatcctggtgaacatggatgacaacatcgtgaagcactacagcaatgaagacaccttccagctgcagatcgaggaggccggcggcagctacaagctgaccctgacagagatctag

SEQ ID NO: 154385 - DNA, 1857 bp, Artificial Sequence
  Description of Artificial Sequence: Synthetic coding sequence
atgacccaggagtatgacaacaagaggcctgtgctggtgctgcagaatgaggccctgtacccccagaggaggagctacaccagtgaagatgaggcctggaagagcttcctggagaaccccctgacagctgccaccaaggccatgatgagcatcaatggagatgaagattctgctgctgccctgggcctgctgtatgactactacaaggtgccccgggagcggcgcagcagcacagccaagccagaggtggagcaccctgagccagaccacagcaagagaaattccatccccatcgtgacagagcagcccctcatctctgctggagaaaatagagtgcaggtgctgaagaatgtgcccttcaacatcgtgctgccccacggcaaccagctgggcatcgacaagaggggccacctgacagccccagacaccaccgtgacagtgtccatcgccaccatgcccacccacagcatcaagacagagacccagccccacggctttgctgtgggcatccccccagctgtgtaccaccctgagcccacagagcgggtggtggtgtttgacaggaacctgaacacagaccagttcagcagcggggcccaggccccaaatgcccagaggaggaccccagacagcaccttcagcgagaccttcaaggagggcgtgcaggaggtgttcttccccagcgacctgagcctgaggatgcctggcatgaacagcgaggactatgtgtttgacagcgtgtctggcaacaactttgagtacaccctggaggccagcaagagcctgcggcagaagccaggggacagcaccatgacctacctgaacaagggccagttctaccccatcaccctgaaggaggtgagcagcagcgagggcatccaccaccccatcagcaaggtgcgcagcgtcatcatggtggtgtttgctgaggacaagagccgggaggaccagctgcggcactggaagtactggcacagccggcagcacacagccaagcagcgctgcatcgacattgctgactacaaggagagcttcaacaccatcagcaacatcgaggagatcgcctacaatgccatctccttcacctgggacatcaatgatgaggccaaggtgttcatctctgtgaactgcctgagcacagacttcagcagccagaagggcgtgaagggcctgcccctgaacatccaggtggacacctacagctacaacaacagaagcaacaagcctgtgcaccgggcctactgccagatcaaggtgttctgtgacaagggagctgagaggaagatcagagatgaggagaggaagcagagcaagaggaaggtgtctgatgtgaaggtgcccctgctgcccagccacaagaggatggacatcaccgtcttcaagcccttcatcgacctggacacccagcctgtgctcttcatcccagatgtgcactttgccaacctgcagaggggcacccacgtgctgcccatcgccagcgaggagctggagggggagggctctgtgctgaagaggggcccctacggcacagaagatgactttgctgtgccccccagcaccaagctggccagaattgaggagcccaagagggtgctgctgtatgtgaggaaggagagcgaggaggtgtttgatgccctgatgctgaagacccccagcctgaagggcctgatggaggccatcagtgacaagtatgatgtgccccatgacaagattggcaagatcttcaagaagtgcaagaagggcatcctggtgaacatggatgacaacatcgtgaagcactacagcaatgaagacaccttccagctgcagatcgaggaggccggcggcagctacaagctgaccctgacagagatctag

SEQ ID NO: 154386 - DNA, 1857 bp, Artificial Sequence
  Description of Artificial Sequence: Synthetic coding sequence
ctgcccaaggaggtggagaacaagaggcctgtgctggtgctgcagaatgaggccctgtacccccagaggaggagctacaccagtgaagatgaggcctggaagagcttcctggagaaccccctgacagctgccaccaaggccatgatgagcatcaatggagatgaagattctgctgctgccctgggcctgctgtatgactactacaaggtgccccgggagcggcgcagcagcacagccaagccagaggtggagcaccctgagccagaccacagcaagagaaattccatccccatcgtgacagagcagcccctcatctctgctggagaaaatagagtgcaggtgctgaagaatgtgcccttcaacatcgtgctgccccacggcaaccagctgggcatcgacaagaggggccacctgacagccccagacaccaccgtgacagtgtccatcgccaccatgcccacccacagcatcaagacagagacccagccccacggctttgctgtgggcatccccccagctgtgtaccaccctgagcccacagagcgggtggtggtgtttgacaggaacctgaacacagaccagttcagcagcggggcccaggccccaaatgcccagaggaggaccccagacagcaccttcagcgagaccttcaaggagggcgtgcaggaggtgttcttccccagcgacctgagcctgaggatgcctggcatgaacagcgaggactatgtgtttgacagcgtgtctggcaacaactttgagtacaccctggaggccagcaagagcctgcggcagaagccaggggacagcaccatgacctacctgaacaagggccagttctaccccatcaccctgaaggaggtgagcagcagcgagggcatccaccaccccatcagcaaggtgcgcagcgtcatcatggtggtgtttgctgaggacaagagccgggaggaccagctgcggcactggaagtactggcacagccggcagcacacagccaagcagcgctgcatcgacattgctgactacaaggagagcttcaacaccatcagcaacatcgaggagatcgcctacaatgccatctccttcacctgggacatcaatgatgaggccaaggtgttcatctctgtgaactgcctgagcacagacttcagcagccagaagggcgtgaagggcctgcccctgaacatccaggtggacacctacagctacaacaacagaagcaacaagcctgtgcaccgggcctactgccagatcaaggtgttctgtgacaagggagctgagaggaagatcagagatgaggagaggaagcagagcaagaggaaggtgtctgatgtgaaggtgcccctgctgcccagccacaagaggatggacatcaccgtcttcaagcccttcatcgacctggacacccagcctgtgctcttcatcccagatgtgcactttgccaacctgcagaggggcacccacgtgctgcccatcgccagcgaggagctggagggggagggctctgtgctgaagaggggcccctacggcacagaagatgactttgctgtgccccccagcaccaagctggccagaattgaggagcccaagagggtgctgctgtatgtgaggaaggagagcgaggaggtgtttgatgccctgatgctgaagacccccagcctgaagggcctgatggaggccatcagtgacaagtatgatgtgccccatgacaagattggcaagatcttcaagaagtgcaagaagggcatcctggtgaacatggatgacaacatcgtgaagcactacagcaatgaagacaccttccagctgcagatcgaggaggccggcggcagctacaagctgaccctgacagagatctag

SEQ ID NO: 154387 - DNA, 1878 bp, Artificial Sequence
  Description of Artificial Sequence: Synthetic coding sequence
atgagccaggagagtgacaacaacaagaggctggtggccctggtgcccatgcccagcgacccccccttcaacacccggcgggcctacaccagtgaagatgaggcctggaagagctacctggagaaccccctgacagctgccaccaaggccatgatgagcatcaatggagatgaggacagcgctgctgccctgggcctgctgtatgactactacaaggtgccccgggacaagaggctgctgtctgtgtccaaggccagtgacagccaggaggaccaggagaagaggaactgcctgggcaccagcgaggcccagagcaacctgtctggaggagaaaatagagtgcaggtgctgaagacagtgcctgtgaacctgagcctgaaccaggaccacctggagaacagcaagcgggagcagtacagcatctccttccctgagagcagcgccatcatccctgtgtctggcatcaccgtggtgaaggccgaggacttcacccctgtgttcatggcccctcctgtgcactaccccagaggagatggagaggagcagagggtggtgatctttgagcagacccagtatgatgtgcccagcctggccacccacagcgcctacctgaaggatgaccagaggagcaccccagacagcacctacagcgagagcttcaaggatgctgccacagagaagttccgcagcgcctctgtgggcgctgaggagtacatgtatgaccagaccagcagcggcaccttccagtacaccctggaggccaccaagagcctgcggcagaagcagggcgagggccccatgacctacctgaacaagggccagttctacgccatcaccctgtctgaaacaggagacaacaagtgcttccgccaccccatcagcaaggtgcgctctgtggtgatggtggtgttttctgaggacaagaacagagatgagcagctgaagtactggaagtactggcacagccggcagcacacagccaagcagagggtgctggacattgctgactacaaggagagcttcaacaccatcggcaacatcgaggagatcgcctacaatgctgtgtccttcacctgggatgtgaatgaggaggccaagatcttcatcaccgtgaactgcctgagcacagacttcagcagccagaagggcgtgaagggcctgcccctgatgatccagattgacacctacagctacaacaacagaagcaacaagcccatccaccgggcctactgccagatcaaggtgttctgtgacaagggagctgagaggaagatcagagatgaggagaggaagcagaacaggaagaagggcaagggccaggccagccagacccagtgcaacagcagcagtgatggcaagctggccgccatccccctgcagaagaagagtgacatcacctacttcaagaccatgccagacctgcacagccagcctgtgctcttcatcccagatgtgcactttgccaacctgcagaggacaggccaggtgtactacaacacagatgatgagcgggagggcggctctgtgctggtgaagaggatgttccggcccatggaggaggagtttggacctgtgcccagcaagcagatgaaggaggagggcaccaagagggtgctgctgtatgtgaggaaggagacagatgatgtgtttgatgccctgatgctgaagagccccaccgtgaagggcctgatggaggccatcagcgagaagtatggcctgcctgtggagaagatcgccaagctgtacaagaagagcaagaagggcatcctggtgaacatggatgacaacatcatcgagcactacagcaatgaagacaccttcatcctgaacatggagagcatggtggagggcttcaaggtgaccctgatggagatctag

SEQ ID NO: 154388 - DNA, 1830 bp, Artificial Sequence
  Description of Artificial Sequence: Synthetic coding sequence
atgcccagcgacccccccttcaacacccggcgggcctacaccagtgaagatgaggcctggaagagctacctggagaaccccctgacagctgccaccaaggccatgatgagcatcaatggagatgaggacagcgctgctgccctgggcctgctgtatgactactacaaggtgccccgggacaagaggctgctgtctgtgtccaaggccagtgacagccaggaggaccaggagaagaggaactgcctgggcaccagcgaggcccagagcaacctgtctggaggagaaaatagagtgcaggtgctgaagacagtgcctgtgaacctgagcctgaaccaggaccacctggagaacagcaagcgggagcagtacagcatctccttccctgagagcagcgccatcatccctgtgtctggcatcaccgtggtgaaggccgaggacttcacccctgtgttcatggcccctcctgtgcactaccccagaggagatggagaggagcagagggtggtgatctttgagcagacccagtatgatgtgcccagcctggccacccacagcgcctacctgaaggatgaccagaggagcaccccagacagcacctacagcgagagcttcaaggatgctgccacagagaagttccgcagcgcctctgtgggcgctgaggagtacatgtatgaccagaccagcagcggcaccttccagtacaccctggaggccaccaagagcctgcggcagaagcagggcgagggccccatgacctacctgaacaagggccagttctacgccatcaccctgtctgaaacaggagacaacaagtgcttccgccaccccatcagcaaggtgcgctctgtggtgatggtggtgttttctgaggacaagaacagagatgagcagctgaagtactggaagtactggcacagccggcagcacacagccaagcagagggtgctggacattgctgactacaaggagagcttcaacaccatcggcaacatcgaggagatcgcctacaatgctgtgtccttcacctgggatgtgaatgaggaggccaagatcttcatcaccgtgaactgcctgagcacagacttcagcagccagaagggcgtgaagggcctgcccctgatgatccagattgacacctacagctacaacaacagaagcaacaagcccatccaccgggcctactgccagatcaaggtgttctgtgacaagggagctgagaggaagatcagagatgaggagaggaagcagaacaggaagaagggcaagggccaggccagccagacccagtgcaacagcagcagtgatggcaagctggccgccatccccctgcagaagaagagtgacatcacctacttcaagaccatgccagacctgcacagccagcctgtgctcttcatcccagatgtgcactttgccaacctgcagaggacaggccaggtgtactacaacacagatgatgagcgggagggcggctctgtgctggtgaagaggatgttccggcccatggaggaggagtttggacctgtgcccagcaagcagatgaaggaggagggcaccaagagggtgctgctgtatgtgaggaaggagacagatgatgtgtttgatgccctgatgctgaagagccccaccgtgaagggcctgatggaggccatcagcgagaagtatggcctgcctgtggagaagatcgccaagctgtacaagaagagcaagaagggcatcctggtgaacatggatgacaacatcatcgagcactacagcaatgaagacaccttcatcctgaacatggagagcatggtggagggcttcaaggtgaccctgatggagatctag

SEQ ID NO: 154389 - DNA, 1878 bp, Artificial Sequence
  Description of Artificial Sequence: Synthetic coding sequence
atgggcaaggatggccgcagcaacaagaggctggtggccctggtgcccatgcccagcgacccccccttcaacacccggcgggcctacaccagtgaagatgaggcctggaagagctacctggagaaccccctgacagctgccaccaaggccatgatgagcatcaatggagatgaggacagcgctgctgccctgggcctgctgtatgactactacaaggtgccccgggacaagaggctgctgtctgtgtccaaggccagtgacagccaggaggaccaggagaagaggaactgcctgggcaccagcgaggcccagagcaacctgtctggaggagaaaatagagtgcaggtgctgaagacagtgcctgtgaacctgagcctgaaccaggaccacctggagaacagcaagcgggagcagtacagcatctccttccctgagagcagcgccatcatccctgtgtctggcatcaccgtggtgaaggccgaggacttcacccctgtgttcatggcccctcctgtgcactaccccagaggagatggagaggagcagagggtggtgatctttgagcagacccagtatgatgtgcccagcctggccacccacagcgcctacctgaaggatgaccagaggagcaccccagacagcacctacagcgagagcttcaaggatgctgccacagagaagttccgcagcgcctctgtgggcgctgaggagtacatgtatgaccagaccagcagcggcaccttccagtacaccctggaggccaccaagagcctgcggcagaagcagggcgagggccccatgacctacctgaacaagggccagttctacgccatcaccctgtctgaaacaggagacaacaagtgcttccgccaccccatcagcaaggtgcgctctgtggtgatggtggtgttttctgaggacaagaacagagatgagcagctgaagtactggaagtactggcacagccggcagcacacagccaagcagagggtgctggacattgctgactacaaggagagcttcaacaccatcggcaacatcgaggagatcgcctacaatgctgtgtccttcacctgggatgtgaatgaggaggccaagatcttcatcaccgtgaactgcctgagcacagacttcagcagccagaagggcgtgaagggcctgcccctgatgatccagattgacacctacagctacaacaacagaagcaacaagcccatccaccgggcctactgccagatcaaggtgttctgtgacaagggagctgagaggaagatcagagatgaggagaggaagcagaacaggaagaagggcaagggccaggccagccagacccagtgcaacagcagcagtgatggcaagctggccgccatccccctgcagaagaagagtgacatcacctacttcaagaccatgccagacctgcacagccagcctgtgctcttcatcccagatgtgcactttgccaacctgcagaggacaggccaggtgtactacaacacagatgatgagcgggagggcggctctgtgctggtgaagaggatgttccggcccatggaggaggagtttggacctgtgcccagcaagcagatgaaggaggagggcaccaagagggtgctgctgtatgtgaggaaggagacagatgatgtgtttgatgccctgatgctgaagagccccaccgtgaagggcctgatggaggccatcagcgagaagtatggcctgcctgtggagaagatcgccaagctgtacaagaagagcaagaagggcatcctggtgaacatggatgacaacatcatcgagcactacagcaatgaagacaccttcatcctgaacatggagagcatggtggagggcttcaaggtgaccctgatggagatctag

SEQ ID NO: 154390 - DNA, 21 bp, Artificial Sequence
  Description of Artificial Sequence: Synthetic coding sequence
atgagccaggagagtgactag

SEQ ID NO: 154391 - DNA, 1737 bp, Artificial Sequence
  Description of Artificial Sequence: Synthetic coding sequence
atgctgcggcggctggacaagatccgcttccggggccacaagagagatgacttcctggacctggccgagagccccaatgccagtgacacagaatgttctgatgagatccccctgaaggtgcccaggaccagcccccgggacagcgaggagctgcgggaccctgctggccctggcaccctcatcatggccaccggggtgcaggacttcaacagaacagaatttgaccggctgaatgagatcaagggccacctggagatcgccctgctggagaagcacttcctgcaggaggagctgaggaagctgcgggaggagaccaatgctgagatgctgcggcaggagctggaccgggagcggcagaggaggatggagctggagcagaaggtgcaggaggtgctgaaggccaggacagaggagcagatggcccagcagccccccaagggccaggcccaggccagcaatggagctgagaggaggagccagggcctgagcagccggctgcagaagtggttctatgaaagatttggagaatatgtggaggacttccgcttccagccagaagaaaatacagtggagacagaggagcccctgagcgcccggcggctgacagagaacatgaggcggctgaagagaggagccaagcctgtgaccaactttgtgaagaacctgagcgccctgagtgactggtacagcgtgtacaccagcgccatcgccttcaccgtgtacatgaatgctgtgtggcacggctgggccatccccctcttcctgttcctggccatcctgcggctgagcctgaactacctgattgcccggggctggaggatccagtggagcatcgtgcctgaggtgtctgagcctgtggagccccccaaggaggacctgactgtgtctgagaagttccagctggtgctggatgtggcccagaaggcccagaacctgtttgggaagatggctgacatcctggagaagatcaagaacctcttcatgtgggtgcagcctgagatcacccagaagctgtatgtggccctgtgggccgccttcctggccagctgcttcttcccctaccgcctggtgggcctggccgtgggcctgtatgccggcatcaagttcttcctgattgacttcatcttcaagcgctgcccccggctgcgggccaagtatgacaccccctacatcatctggaggagcctgcccacagacccccagctgaaggagaggagcagcgctgctgtgtcccggcggctgcagaccaccagcagccgctcctatgtgcccagcgccccagctggcctgggcaaggaggaggatgctggccgcttccacagcaccaagaagggcaacttccacgagatcttcaacctgacagaaaatgaaagacccctggccgtgtgtgaaaatggctggcgctgctgcctgatcaacagagacaggaagatgcccacagactacatcagaaatggagtgctgtatgtgacagagaactacctgtgctttgagagcagcaagagcggcagcagcaagaggaacaaggtgatcaagctggtggacatcacagacatccagaagtacaaggtgctgtctgtgctgcccggcagcggcatgggcattgctgtgtccacccccagcacccagaagcccctggtgtttggagccatggtgcacagagatgaggcctttgagaccatcctgagccagtacatcaagatcaccagcgctgctgccagcggcggggacagctag

SEQ ID NO: 154392 - DNA, 1737 bp, Artificial Sequence; identical to SEQ ID NO: 154391
  Description of Artificial Sequence: Synthetic coding sequence

SEQ ID NO: 154393 - DNA, 102 bp, Artificial Sequence
  Description of Artificial Sequence: Synthetic coding sequence
atgctgcggcggctggacaagatccgcttccggggccacaagagagatgacttcctggacctggccgagagccccaatgccagtgacacagaatgttcctag

SEQ ID NO: 154394 - DNA, 1782 bp, Artificial Sequence
  Description of Artificial Sequence: Synthetic coding sequence
atgtggaccctggtgtcctgggtggccctgacagctggcctggtggccggcacccgctgcccagatggccagttctgccctgtggcctgctgcctggaccccggcggggccagctacagctgctgccggcccctgctggacaagtggcccaccaccctgagccgccacctgggcggcccctgccaggtggatgcccactgcagcgctggccacagctgcatcttcaccgtgtctggcaccagcagctgctgccccttccctgaggccgtggcctgtggagatggccaccactgctgcccccggggcttccactgcagcgcagatggccgcagctgcttccagaggagcggcaacaacagcgtgggcgccatccagtgcccagacagccagtttgagtgcccagacttcagcacctgctgcgtgatggtggatggctcctggggctgctgccccatgccccaggccagctgctgtgaagatagagtgcactgctgcccccatggagccttctgtgacctggtgcacacccgctgcatcacccccaccggcacccaccccctggccaagaagctgcctgcccagaggaccaacagagctgtggccctgagcagctctgtgatgtgcccagatgcccggagccgctgcccagatggcagcacctgctgtgagctgcccagcggcaagtatggctgctgccccatgcccaatgccacctgctgcagcgaccacctgcactgctgcccccaggacacagtgtgtgacctgatccagagcaagtgcctgagcaaagaaaatgccaccacagacctgctgaccaagctgcctgcccacacagtgggagatgtgaagtgtgacatggaggtgtcctgcccagatggctacacctgctgccgcctgcagagcggggcctggggctgctgccccttcacccaggccgtgtgctgtgaggaccacatccactgctgcccagctggcttcacctgtgacacccagaagggcacctgtgagcagggcccccaccaggtgccctggatggagaaggccccagcccacctgagcctgcctgacccccaggccctgaagagagatgtgccctgtgacaacgtgagcagctgccccagcagtgacacctgctgccagctgaccagcggggagtggggctgctgccccatccctgaggccgtgtgctgcagcgaccaccagcactgctgcccccagggctacacctgtgtggccgagggccagtgccagaggggcagcgagatcgtggccggcctggagaagatgcctgcccggcgggccagcctgagccacccccgggacatcggctgtgaccagcacaccagctgccctgtgggccagacctgctgccccagcctgggcggctcctgggcctgctgccagctgccccatgctgtgtgctgtgaggaccggcagcactgctgcccagctggctacacctgcaatgtgaaggcccggagctgtgagaaggaggtggtgtctgcccagcctgccaccttcctggcccggagcccccacgtgggcgtgaaggatgtggagtgtggggagggccacttctgccacgacaaccagacctgctgccgggacaaccggcagggctgggcctgctgcccctaccggcagggcgtgtgctgtgccgacagaagacactgctgcccagctggcttccgctgtgccgcccggggcaccaagtgcctgcggcgggaggccccccgctgggatgcccccctgcgggaccctgccctgcggcagctgctgtag

SEQ ID NO: 154395 - DNA, 1317 bp, Artificial Sequence
  Description of Artificial Sequence: Synthetic coding sequence
atgtggaccctggtgtcctgggtggccctgacagctggcctggtggccggcacccgctgcccagatggccagttctgccctgtggcctgctgcctggaccccggcggggccagctacagctgctgccggcccctgctggacaagtggcccaccaccctgagccgccacctgggcggcccctgccaggtggatgcccactgcagcgctggccacagctgcatcttcaccgtgtctggcaccagcagctgctgccccttccctgaggccgtggcctgtggagatggccaccactgctgcccccggggcttccactgcagcgcagatggccgcagctgcttccagaggagcggcaacaacagcgtgggcgccatccagtgcccagacagccagtttgagtgcccagacttcagcacctgctgcgtgatggtggatggctcctggggctgctgccccatgccccaggccagctgctgtgaagatagagtgcactgctgcccccatggagccttctgtgacctggtgcacacccgctgcatcacccccaccggcacccaccccctggccaagaagctgcctgcccagaggaccaacagagctgtggccctgagcagctctgtgatgtgcccagatgcccggagccgctgcccagatggcagcacctgctgtgagctgcccagcggcaagtatggctgctgccccatgcccaatgccacctgctgcagcgaccacctgcactgctgcccccaggacacagtgtgtgacctgatccagagcaagtgcctgagcaaagaaaatgccaccacagacctgctgaccaagctgcctgcccacacagtgggagatgtgaagtgtgacatggaggtgtcctgcccagatggctacacctgctgccgcctgcagagcggggcctggggctgctgccccttcacccaggccgtgtgctgtgaggaccacatccactgctgcccagctggcttcacctgtgacacccagaagggcacctgtgagcagggcccccaccaggtgccctggatggagaaggccccagcccacctgagcctgcctgacccccaggccctgaagagagatgtgccctgtgacaacgtgagcagctgccccagcagtgacacctgctgccgggacaaccggcagggctgggcctgctgcccctaccggcagggcgtgtgctgtgccgaccggcggcactgctgcccagctggcttccgctgtgccgcccggggcaccaagtgcctgcggcgggaggccccccgctgggatgcccccctgcgggaccctgccctgcggcagctgctgtag

SEQ ID NO: 154396 - DNA, 1242 bp, Artificial Sequence
  Description of Artificial Sequence: Synthetic coding sequence
atggccatcacagctgcccatggagccagcacagctgtgcagacaggagaccctgccagcaaggaccaggtgaccaccccctgggtgcccagcagcgccctgattgtgagcagcaatgcccggaccagccccagggctgtgctgtggagcatggcccctggaggagctgccccctgcccccggctgcctgctgtgaagacaggctgcacagctgtgtgtgacctgatccagagcaagtgcctgagcaaagaaaatgccaccacagacctgctgaccaagctgcctgcccacacagtgggagatgtgaagtgtgacatggaggtgtcctgcccagatggctacacctgctgccgcctgcagagcggggcctggggctgctgccccttcacccaggccgtgtgctgtgaggaccacatccactgctgcccagctggcttcacctgtgacacccagaagggcacctgtgagcagggcccccaccaggtgccctggatggagaaggccccagcccacctgagcctgcctgacccccaggccctgaagagagatgtgccctgtgacaacgtgagcagctgccccagcagtgacacctgctgccagctgaccagcggggagtggggctgctgccccatccctgaggccgtgtgctgcagcgaccaccagcactgctgcccccagggctacacctgtgtggccgagggccagtgccagaggggcagcgagatcgtggccggcctggagaagatgcctgcccggcgggccagcctgagccacccccgggacatcggctgtgaccagcacaccagctgccctgtgggccagacctgctgccccagcctgggcggctcctgggcctgctgccagctgccccatgctgtgtgctgtgaggaccggcagcactgctgcccagctggctacacctgcaatgtgaaggcccggagctgtgagaaggaggtggtgtctgcccagcctgccaccttcctggcccggagcccccacgtgggcgtgaaggatgtggagtgtggggagggccacttctgccacgacaaccagacctgctgccgggacaaccggcagggctgggcctgctgcccctaccggcagggcgtgtgctgtgccgacagaagacactgctgcccagctggcttccgctgtgccgcccggggcaccaagtgcctgcggcgggaggccccccgctgggatgcccccctgcgggaccctgccctgcggcagctgctgtag

SEQ ID NO: 154397 - DNA, 789 bp, Artificial Sequence
  Description of Artificial Sequence: Synthetic coding sequence
atgaggaacagctaccgcttcctggccagcagcctgtctgtggtggtgtccctgctgctgatcccagaagatgtgtgtgagaagatcatcggcggcaatgaggtgaccccccacagccggccctacatggtgctgctgagcctggacaggaagaccatctgtgccggggccctgattgccaaggactgggtgctgacagctgcccactgcaacctgaacaagaggagccaggtgatcctgggcgcccacagcatcacccgggaggagcccaccaagcagatcatgctggtgaagaaggagttcccctacccctgctatgaccctgccacccgggagggggacctgaagctgctgcagctgatggagaaggccaagatcaacaagtatgtgaccatcctgcacctgcccaagaagggagatgatgtgaagccaggcaccatgtgccaggtggccggctggggccgcacccacaacagcgcctcctggagcgacaccctgcgggaggtgaacatcaccatcatcgacaggaaggtgtgcaatgacaggaaccactacaacttcaaccctgtgattggcatgaacatggtgtgtgccggcagcctgcggggcggccgggacagctgcaatggagacagcggcagccccctgctgtgtgagggcgtcttccggggcgtgaccagctttggcctggagaacaagtgtggggacccccggggccctggggtgtacatcctgctgagcaagaagcacctgaactggatcatcatgaccatcaagggagctgtgtag

SEQ ID NO: 154398 - DNA, 741 bp, Artificial Sequence
  Description of Artificial Sequence: Synthetic coding sequence
atgcagcccttcctgctgctgctggccttcctgctgacccctggggccggcacagaggagatcatcggcggccacgaggccaagccccacagccggccctacatggcctttgtgcagttcctgcaggagaagagcaggaagagatgtggcggcatcctggtgaggaaggactttgtgctgacagctgcccactgccagggcagcagcatcaacgtgaccctgggcgcccacaacatcaaggagcaggagaggacccagcagttcatccctgtgaagaggcccatcccccacccagcctacaaccccaagaacttcagcaatgacatcatgctgctgcagctggagaggaaggccaagtggaccacagctgtgcggcccctgcggctgcccagcagcaaggcccaggtgaagccaggccagctgtgcagcgtggccggctggggctacgtgtccatgagcaccctggccaccaccctgcaggaggtgctgctgactgtgcagaaggactgccagtgtgagcggctcttccacggcaactacagccgggccacagagatctgtgtgggggaccccaagaagacccagacaggcttcaagggggacagcggcggccccctggtgtgcaaggatgtggcccagggcatcctgtcctatggcaacaagaagggcaccccacctggggtgtacatcaaggtgagccacttcctgccctggatcaagaggaccatgaagaggctgtag

SEQ ID NO: 154399 - DNA, 459 bp, Artificial Sequence
  Description of Artificial Sequence: Synthetic coding sequence
atgcagcccatcctgctgctgctggccttcctgctgctgcccagggctgaccagctggagaggaaggccaagaggaccagggctgtgcagcccctgcggctgcccagcaacaaggcccaggtgaagccaggccagacctgcagcgtggccggctggggccagacagcccccctgggcaagcacagccacaccctgcaggaggtgaagatgacagtgcaggaggacagaaaatgtgagagtgacctgcggcactactatgacagcaccatcgagctgtgtgtgggggaccctgagatcaagaagaccagcttcaagggggacagcggcggccccctggtgtgcaacaaggtggcccagggcatcgtgtcctatggcaggaacaacggcatgccaccccgggcctgcaccaaggtgagcagctttgtgcactggatcaagaagaccatgaagcgctactag

SEQ ID NO: 154400 - DNA, 609 bp, Artificial Sequence
  Description of Artificial Sequence: Synthetic coding sequence
atgcagcccatcctgctgctgctggccttcctgctgctgcccagggcagatgctggggagatcatcggcggccacgaggccaagccccacagccggccctacatggcctacctgatgatctgggaccagaagagcctgaagagatgtggcggcttcctgatcagagatgactttgtgctgacagctgcccactgctggggccgcctggagaggaaggccaagaggaccagggctgtgcagcccctgcggctgcccagcaacaaggcccaggtgaagccaggccagacctgcagcgtggccggctggggccagacagcccccctgggcaagcacagccacaccctgcaggaggtgaagatgacagtgcaggaggacagaaaatgtgagagtgacctgcggcactactatgacagcaccatcgagctgtgtgtgggggaccctgagatcaagaagaccagcttcaagggggacagcggcggccccctggtgtgcaacaaggtggcccagggcatcgtgtcctatggcaggaacaacggcatgccaccccgggcctgcaccaaggtgagcagctttgtgcactggatcaagaagaccatgaagcgctactag

SEQ ID NO: 154401 - DNA, 846 bp, Artificial Sequence
  Description of Artificial Sequence: Synthetic coding sequence
atgaagagcctgagcctgctgcacctgttccccctgccccgggccaagcgggagcagggcggcaacaacagcagcagcaaccagggcagcctgcctgagaagatgcagcccatcctgctgctgctggccttcctgctgctgcccagggcagatgctggggagatcatcggcggccacgaggccaagccccacagccggccctacatggcctacctgatgatctgggaccagaagagcctgaagagatgtggcggcttcctgatcagagatgactttgtgctgacagctgcccactgctggggcagcagcatcaacgtgaccctgggcgcccacaacatcaaggagcaggagcccacccagcagttcatccctgtgaagaggcccatcccccacccagcctacaaccccaagaacttcagcaatgacatcatgctgctgcagctggagaggaaggccaagaggaccagggctgtgcagcccctgcggctgcccagcaacaaggcccaggtgaagccaggccagacctgcagcgtggccggctggggccagacagcccccctgggcaagcacagccacaccctgcaggaggtgaagatgacagtgcaggaggacagaaaatgtgagagtgacctgcggcactactatgacagcaccatcgagctgtgtgtgggggaccctgagatcaagaagaccagcttcaagggggacagcggcggccccctggtgtgcaacaaggtggcccagggcatcgtgtcctatggaagaaataatggcatgccaccccgggcctgcaccaaggtgtcctcctttgtgcactggatcaagaagaccatgaagcgctactag

SEQ ID NO: 154402 - DNA, 708 bp, Artificial Sequence
  Description of Artificial Sequence: Synthetic coding sequence
atgcagaccttccccagcggggagatcatcggcggccacgaggccaagccccacagccggccctacatggcctacctgatgatctgggaccagaagagcctgaagagatgtggcggcttcctgatcagagatgactttgtgctgacagctgcccactgctggggcagcagcatcaacgtgaccctgggcgcccacaacatcaaggagcaggagcccacccagcagttcatccctgtgaagaggcccatcccccacccagcctacaaccccaagaacttcagcaatgacatcatgctgctgcagctggagaggaaggccaagaggaccagggctgtgcagcccctgcggctgcccagcaacaaggcccaggtgaagccaggccagacctgcagcgtggccggctggggccagacagcccccctgggcaagcacagccacaccctgcaggaggtgaagatgacagtgcaggaggacagaaaatgtgagagtgacctgcggcactactatgacagcaccatcgagctgtgtgtgggggaccctgagatcaagaagaccagcttcaagggggacagcggcggccccctggtgtgcaacaaggtggcccagggcatcgtgtcctatggaagaaataatggcatgccaccccgggcctgcaccaaggtgtcctcctttgtgcactggatcaagaagaccatgaagcgctactag

SEQ ID NO: 154403 - DNA, 483 bp, Artificial Sequence
  Description of Artificial Sequence: Synthetic coding sequence
atgcagcccttcctgctgctgctggccttcctgctgacccctggggccggcacagaggagatcatcggcggccacgaggccaagccccacagccggccctacatggcctttgtgcagttcctgcaggagaagagcaggaagagatgtggcggcatcctggtgaggaaggactttgtgctgacagctgcccactgccagggcagcagcatcaacgtgaccctgggcgcccacaacatcaaggagcaggagaggacccagcagttcatccctgtgaagaggcccatcccccacccagcctacaaccccaagaacttcagcaatgacatcatgctgctgcagggcgacagcggcggccccctggtgtgcaaggatgtggcccagggcatcctgtcctatggcaacaagaagggcaccccacctggggtgtacatcaaggtgagccacttcctgccctggatcaagaggaccatgaagaggctgtag

SEQ ID NO: 154404 - DNA, 768 bp, Artificial Sequence
  Description of Artificial Sequence: Synthetic coding sequence
atgcagcccctgctgctgctgctggccttcctgctgcccaccggggctgaggccggggagatcatcggcggccgggagagccggccccacagccggccctacatggcctacctgcagatccagagccctgctggccagagccgctgtggcggcttcctggtgcgggaggactttgtgctgacagctgcccactgctggggcagcaacatcaacgtgaccctgggcgcccacaacatccagaggcgggagaacacccagcagcacatcacagcccggcgggccatccgccacccccagtacaaccagaggaccatccagaatgacatcatgctgctgcagctgagccggcgggtgagaagaaacagaaatgtgaaccctgtggccctgccccgggcccaggagggcctgcggcccggcaccctgtgcaccgtggccggctggggccgggtgtccatgagaagaggaacagacaccctgcgggaggtgcagctgcgggtgcagagggaccggcagtgcctgcgcatcttcggcagctatgacccccggcggcagatctgtgtgggggaccggcgggagaggaaggccgccttcaagggggacagcggcggccccctgctgtgcaacaacgtggcccacggcatcgtgtcctatggcaagagcagtggagtgcccccagaggtgttcaccagggtgtcctccttcctgccctggatccgcaccaccatgaggagcttcaagctgctggaccagatggagacccccctgtag

SEQ ID NO: 154405 - DNA, 348 bp, Artificial Sequence
  Description of Artificial Sequence: Synthetic coding sequence
atgcagcccttcctgctgctgctggccttcctgctgacccctggggccggcacagaggagatcatcggcggccacgaggccaagccccacagccggccctacatggcctttgtgcagttcctgcaggagaagagcaggaagagatgtggcggcatcctggtgaggaaggactttgtgctgacagctgcccactgccagggccgcggggacagcggcggccccctggtgtgcaaggatgtggcccagggcatcctgtcctatggcaacaagaagggcaccccacctggggtgtacatcaaggtgagccacttcctgccctggatcaagaggaccatgaagaggctgtag

SEQ ID NO: 154406 - DNA, 774 bp, Artificial Sequence
  Description of Artificial Sequence: Synthetic coding sequence
atggaggcctgtgtgagcagcctgctggtgctggccctgggcgccctgtctgtgggcagcagctttggcacccagatcattggaggccgggaggtgatcccccacagccggccctacatggccagcctgcagagaaatggcagccacctgtgtggcggcgtgctggtgcaccccaagtgggtgctgacagctgcccactgcctggcccagaggatggcccagctgcggctggtgctgggcctgcacaccctggacagccctggcctgaccttccacatcaaggccgccatccagcacccccgctacaagcctgtgcctgccctggagaatgacctggccctgctgcagctggatggcaaggtgaagcccagcaggaccatccggcccctggccctgcccagcaagaggcaggtggtggccgccggcacccgctgcagcatggccggctggggcctgacccaccagggcggccgcctgagccgggtgctgcgggagctggacctgcaggtgctggacaccaggatgtgcaacaacagccgcttctggaatggcagcctgagccccagcatggtgtgcctggccgctgacagcaaggaccaggccccctgcaagggggacagcggcggccccctggtgtgtgggaagggccgggtgctggcccgggtgctgtccttcagcagccgggtgtgcacagacatcttcaagccccctgtggccacagctgtggccccctacgtgtcctggatcaggaaggtgacaggccgcagcgcctag

SEQ ID NO: 154407 - DNA, 3108 bp, Artificial Sequence
  Description of Artificial Sequence: Synthetic coding sequence
atggctgctgagaccctgaactttggacctgagtggctgcgggccctgagcggcggcggctctgtggccagccccccacccagccctgccatgcccaagtacaagctggccgactaccgctatggccgggaggagatgctggccctgtatgtgaaggagaacaaggtgcctgaggagctgcaggacaaggagtttgctgctgtgctgcaggatgagcccctgcagcccctggccctggagcccctgacagaggaggagcagaggaacttcagcctgtctgtgaacagcgtggccgtgctgcggctgatgggcaaaggagctggcccccccctggccggcaccagccggggccggggcagcaccaggagccggggccggggccgcggggacagctgcttctaccagaggagcattgaggagggagatggagccttcggccgcagcccccgggagatccagaggagccagagctgggatgacagaggagagaggagatttgagaagagcgccaggagagatggagcccgctgtggctttgaggagggcggggccggccccaggaaggagcacgcccggagtgacagcgagaactggaggagcctgcgggaggagcaggaggaggaggaggagggctcctggaggctgggcgccggccccaggagagatggagaccgctggaggtctgccagcccagatggcggccccaggtctgctggctggagggagcacggggagaggaggaggaagtttgaatttgacctgcggggggacagaggaggctgtggggaggaggagggccggggcggcggcggcagcagccacctgcggcgctgccgggcccctgagggctttgaggaggacaaggatggcctgcctgagtggtgcctggatgatgaagatgaggagatgggcacctttgatgccagcggggccttcctgcccctgaagaagggccccaaggagcccatccctgaggagcaggagctggacttccagggcctggaggaggaggaggagcccagcgagggcctggaggaggagggccctgaggccggcggcaaggagctgacccccctgcccccccaggaggagaagagcagcagccccagccccctgcccaccctgggccccctgtggggcaccaatggagatggagatgaaacagctgagaaggagcccccagctgctgaagatgacatccggggcatccagctgagccctggggtgggcagcagcgctggccccccaggggacctggaggatgatgagggcctgaagcacctgcagcaggaggccgagaagctggtggccagcctgcaggacagcagcctggaggaggagcagttcaccgctgccatgcagacccagggcctgcggcacagcgctgctgccacagccctgcccctgagccatggagctgccaggaagtggttctacaaggacccccagggcgagatccagggccccttcaccacccaggagatggccgagtggttccaggccggctacttctccatgagcctgctggtgaagaggggctgtgatgagggcttccagcccctgggggaggtgatcaagatgtggggccgggtgccctttgcccctggccccagccccccacccctgctgggcaacatggaccaggagcggctgaagaagcagcaggagctggccgccgccgccctgtaccagcagctgcagcaccagcagttcctgcagctggtgagcagccggcagctgccccagtgtgccctgcgggagaaggccgccctgggggacctgaccccacctcctcctcctccaccccagcagcagcagcagcagctgacagccttcctgcagcagctgcaggccctgaagccaccccggggcggggaccagaacctgctgcccaccatgagccgcagcctgtctgtgcctgacagcggccgcctgtgggatgtgcacaccagcgccagcagccagagcggcggggaggccagcctgtgggacatccccatcaacagcagcacccagggccccatcctggagcagctgcagctgcagcacaagttccaggagcggcgggaggtggagctgcgggccaagcgggaggaggaggagaggaagaggcgggaggagaagaggcggcagcagcagcaggaggagcagaagaggcggcaggaggaggaggagctgttccggaggaagcacgtgcggcagcaggagctgctgctgaagctgctgcagcagcagcaggccgtgcctgtgcccccagcccccagcagccccccacccctgtgggccggcctggccaagcagggcctgtccatgaagaccctgctggagctgcagctggagggggagcggcagctgcacaagcagcccccaccccgggagcccgcccgggcccaggcccccaaccaccgggtgcagctgggcggcctgggcacagcccccctgaaccagtgggtgtctgaggccggccccctgtggggcggccctgacaagagcggcggcggcagcagcggcctgggcctgtgggaggacacccccaagagcggcggcagcctggtgcggggcctgggcctgaagaacagccgcagcagccccagcctgagtgacagctacagccacctgagcggccggcccatcaggaagaagacagaggaggaggagaagctgctgaagctgctgcagggcatcccccggccccaggacggcttcacccagtggtgtgagcagatgctgcacaccctgagcgccaccggcagcctggatgtgcccatggctgtggccatcctgaaggaggtggagagcccctatgatgtgcatgactacatccgcagctgcctgggggacaccctggaggccaaggagtttgccaagcagttcctggagcggcgggccaagcagaaggccagccagcagaggcagcagcagcaggaggcctggctgagcagcgccagcctgcagacagccttccaggccaaccacagcaccaagctgggccctggagagggcagcaaggccaagaggcgggccctgatgctgcacagcgaccccagcatcctgggctacagcctgcacggcagcagcggggagattgaatctgtggatgactactag

SEQ ID NO: 154408 - DNA, 2265 bp, Artificial Sequence
  Description of Artificial Sequence: Synthetic coding sequence
agcagcttccccagcccccggctgccccaggtgttccaccggctggatgatgaagatgaggagatgggcacctttgatgccagcggggccttcctgcccctgaagaagggccccaaggagcccatccctgaggagcaggagctggacttccagggcctggaggaggaggaggagcccagcgagggcctggaggaggagggccctgaggccggcggcaaggagctgacccccctgcccccccaggaggagaagagcagcagccccagccccctgcccaccctgggccccctgtggggcaccaatggagatggagatgaaacagctgagaaggagcccccagctgctgaagatgacatccggggcatccagctgagccctggggtgggcagcagcgctggccccccaggggacctggaggatgatgagggcctgaagcacctgcagcaggaggccgagaagctggtggccagcctgcaggacagcagcctggaggaggagcagttcaccgctgccatgcagacccagggcctgcggcacagcgctgctgccacagccctgcccctgagccacggggccgccaggaagtggttctacaaggacccccagggcgagatccagggccccttcaccacccaggagatggccgagtggttccaggccggctacttctccatgagcctgctggtgaagaggggctgtgatgagggcttccagcccctgggggaggtgatcaagatgtggggccgggtgccctttgcccctggccccagccccccacccctgctgggcaacatggaccaggagcggctgaagaagcagcaggagctggccgctgctgccctgtaccagcagctgcagcaccagcagttcctgcagctggtgagcagccggcagctgccccagtgtgccctgcgggagaaggccgccctgggggacctgaccccacctcctcctcctccaccccagcagcagcagcagcagctgacagccttcctgcagcagctgcaggccctgaagccaccccggggcggggaccagaacctgctgcccaccatgagccgcagcctgtctgtgcctgattctggccgcctgtgggatgtgcacaccagcgccagcagccagagcggcggggaggccagcctgtgggacatccccatcaacagcagcacccagggccccatcctggagcagctgcagctgcagcacaagttccaggagcggcgggaggtggagctgcgggccaagcgggaggaggaggagaggaagagaagagaggagaagaggcggcagcagcagcaggaggagcagaagaggcggcaggaggaggaggagctgttccggaggaagcacgtgcggcagcaggagctgctgctgaagctgctgcagcagcagcaggccgtgcctgtgcccccagcccccagcagccccccacccctgtgggccggcctggccaagcagggcctgtccatgaagaccctgctggagctgcagctggagggggagcggcagctgcacaagcagcccccaccccgggagcccgcccgggcccaggcccccaaccaccgggtgcagctgggcggcctgggcacagcccccctgaaccagtgggtgtctgaggccggccccctgtggggcggccctgacaagagcggcggcggcagcagcggcctgggcctgtgggaggacacccccaagagcggcggcagcctggtgcggggcctgggcctgaagaacagccgcagcagccccagcctgagtgacagctacagccacctgagcggccggcccatcaggaagaagacagaggaggaggagaagctgctgaagctgctgcagggcatcccccggccccaggacggcttcacccagtggtgtgagcagatgctgcacaccctgagcgccaccggcagcctggatgtgcccatggctgtggccatcctgaaggaggtggagagcccctatgatgtgcatgactacatccgcagctgcctgggggacaccctggaggccaaggagtttgccaagcagttcctggagcggcgggccaagcagaaggccagccagcagaggcagcagcagcaggaggcctggctgagcagcgccagcctgcagacagccttccaggccaaccacagcaccaagctgggccctggagagggcagcaaggccaagagaagagccctgatgctgcacagcgaccccagcatcctgggctacagcctgcacggcagcagtggagaaattgagagcgtggatgactactag

SEQ ID NO: 154409 - DNA, 3900 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggcgccccccggggccgcagcagcagccggggccggggccggggccgcggggagtgtggcttctaccagaggagctttgatgaggtggagggcgtgtttggccggggcggcggccgggagatgcacaggagccagagctgggaggagcggggggacagaagatttgagaagccaggcaggaaggatgtgggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagcccagatggccccaggtctgctggctggagggagcacatggagaggagaagaagatttgaatttgacttccgggacagagatgatgagcggggctacagaagagtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaagaatgtagtgacagcgagggcagccacaatgaggaggccaaggagccagacaagaccaacaagaaggagggggagaagacagacagagtgggcgtggaggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggaagagaagagaggaggaggagctggcccggaggaagcaggaggaggccctgcggcggcagcgggagcaggagatcgccctgcggcggcagcgggaggaggaggagcggcagcagcaggaggaggccctgcggcggctggaggagaggagaagagaggaggaggagaggaggaagcaggaggagctgctgaggaagcaggaggaggaggccgccaagtgggcccgggaggaggaggaggcccagaggcggctggaggagaaccggctgaggatggaggaggaggccgcccggctgcggcatgaggaggaggagaggaagaggaaggagctggaggtgcagaggcagaaggagctgatgaggcagaggcagcagcagcaggaggccctgcggcggctgcagcagcagcagcagcagcagcagctggcccagatgaagctgcccagcagcagcacctggggccagcagagcaacaccacagcctgccagagccaggccaccctgagcctggccgagatccagaagctggaggaggagcgggagcggcagctgcgggaggagcagaggcggcagcagcgggagctgatgaaggccctgcagcagcagcagcagcagcagcagcagaagctgagcggctggggcaatgtgtccaagcccagcggcaccaccaagagcctgctggagatccagcaggaggaggcccggcagatgcagaagcagcagcagcagcagcagcagcaccagcagcccaacagagccaggaacaacacccacagcaacctgcacaccagcatcggcaacagcgtgtggggcagcatcaacacaggcccccccaaccagtgggccagtgacctggtgagcagcatctggagcaatgctgacaccaagaacagcaacatgggcttctgggatgatgctgtgaaggaggtgggccccaggaacagcaccaacaagaacaagaacaatgccagcctgagcaagtctgtgggcgtgagcaaccggcagaacaagaaggtggaggaggaggagaagctgctgaagctgttccagggcgtgaacaaggcccaggacggcttcacccagtggtgtgagcagatgctgcacgccctgaacacagccaacaacctggatgtgcccacctttgtgtccttcctgaaggaggtggagagcccctatgaggtgcatgactacatccgggcctacctgggggacaccagcgaggccaaggagtttgccaagcagttcctggagcggcgggccaagcagaaggccaaccagcagaggcagcagcagcagctgccccagcagcagcagcagcagcccccccagcagcccccccagcagccccagcagcaggacagcgtgtggggcatgaaccacagcaccctgcacagcgtcttccagaccaaccagagcaacaaccagcagagcaactttgaagctgtgcagagcggcaagaagaagaagaagcagaagatggtgcgggctgaccccagcctgctgggcttctctgtgaatgccagcagcgagcggctgaacatgggagaaattgagaccctggatgactactag

SEQ ID NO: 154410 - DNA, 3966 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggcgccccccggggccgcagcagcagccggggccggggccggggccgcggggagtgtggcttctaccagaggagctttgatgaggtggagggcgtgtttggccggggcggcggccgggagatgcacaggagccagagctgggaggagcggggggacagaagatttgagaagccaggcaggaaggatgtgggcaagaagaatggctactactgcatgtacagccctgtgctgctgctgggccagcccctgtgccagggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagcccagatggccccaggtctgctggctggagggagcacatggagaggagaagaagatttgaatttgacttccgggacagagatgatgagcggggctacagaagagtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaagaatgtagtgacagcgagggcagccacaatgaggaggccaaggagccagacaagaccaacaagaaggagggggagaagacagacagagtgggcgtggaggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggaagagaagagaggaggaggagctggcccggaggaagcaggaggaggccctgcggcggcagcgggagcaggagatcgccctgcggcggcagcgggaggaggaggagcggcagcagcaggaggaggccctgcggcggctggaggagaggagaagagaggaggaggagaggaggaagcaggaggagctgctgaggaagcaggaggaggaggccgccaagtgggcccgggaggaggaggaggcccagaggcggctggaggagaaccggctgaggatggaggaggaggccgcccggctgcggcatgaggaggaggagaggaagaggaaggagctggaggtgcagaggcagaaggagctgatgaggcagaggcagcagcagcaggaggccctgcggcggctgcagcagcagcagcagcagcagcagctggcccagatgaagctgcccagcagcagcacctggggccagcagagcaacaccacagcctgccagagccaggccaccctgagcctggccgagatccagaagctggaggaggagcgggagcggcagctgcgggaggagcagaggcggcagcagcgggagctgatgaaggccctgcagcagcagcagcagcagcagcagcagaagctgagcggctggggcaatgtgtccaagcccagcggcaccaccaagagcctgctggagatccagcaggaggaggcccggcagatgcagaagcagcagcagcagcagcagcagcaccagcagcccaacagagccaggaacaacacccacagcaacctgcacaccagcatcggcaacagcgtgtggggcagcatcaacacaggcccccccaaccagtgggccagtgacctggtgagcagcatctggagcaatgctgacaccaagaacagcaacatgggcttctgggatgatgctgtgaaggaggtgggccccaggaacagcaccaacaagaacaagaacaatgccagcctgagcaagtctgtgggcgtgagcaaccggcagaacaagaaggtggaggaggaggagaagctgctgaagctgttccagggcgtgaacaaggcccaggacggcttcacccagtggtgtgagcagatgctgcacgccctgaacacagccaacaacctggatgtgcccacctttgtgtccttcctgaaggaggtggagagcccctatgaggtgcatgactacatccgggcctacctgggggacaccagcgaggccaaggagtttgccaagcagttcctggagcggcgggccaagcagaaggccaaccagcagaggcagcagcagcagctgccccagcagcagcagcagcagcccccccagcagcccccccagcagccccagcagcaggacagcgtgtggggcatgaaccacagcaccctgcacagcgtcttccagaccaaccagagcaacaaccagcagagcaactttgaagctgtgcagagcggcaagaagaagaagaagcagaagatggtgcgggctgaccccagcctgctgggcttctctgtgaatgccagcagcgagcggctgaacatgggagaaattgagaccctggatgactactag

SEQ ID NO: 154411 - DNA, 3966 bp, Artificial Sequence; identical to SEQ ID NO: 154410
  Description of Artificial Sequence: Synthetic coding sequence

SEQ ID NO: 154412 - DNA, 3900 bp, Artificial Sequence; identical to SEQ ID NO: 154409
  Description of Artificial Sequence: Synthetic coding sequence

SEQ ID NO: 154413 - DNA, 2163 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggcgccccccggggccgcagcagcagccggggccggggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagccctggctggagggagcacatggagaggagaagaagatttgaatttgacttccgggacagagatgatgagcggggctaccgccgggtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaggagtgcagcgacagcgagggcagccacaatgaggaggccaaggagccagacaagaccaacaagaaggagggggagaagacagacagagtgggcgtggaggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggtag

SEQ ID NO: 154414 - DNA, 282 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctcctag

SEQ ID NO: 154415 - DNA, 303 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgcctag

SEQ ID NO: 154416 - DNA, 42 bp, Artificial Sequence
  Description of Artificial Sequence: Synthetic coding sequence
atggctgctgagacccagaccctgaactttggacctgagtag

SEQ ID NO: 154417 - DNA, 348 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggctag

SEQ ID NO: 154418 - DNA, 321 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgactggatag

SEQ ID NO: 154419 - DNA, 342 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtgtag

SEQ ID NO: 154420 - DNA, 2619 bp, Artificial Sequence
  Description of Artificial Sequence: Synthetic coding sequence
atgaccaagctgcctgatgaccccggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagcccagatggccccaggtctgctggctggagggagcacatggagaggagaagaagatttgaatttgacttccgggacagagatgatgagcggggctaccgccgggtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaggagtgcagcgacagcgagggcagccacaatgaggaggccaaggagccagacaagaccaacaagaaggagggggagaagacagacagagtgggcgtggaggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggaagaggcgggaggaggaggagctggcccggaggaagcaggaggaggccctgcggcggcagcgggagcaggagatcgccctgcggcggcagcgggaggaggaggagcggcagcagcaggaggaggccctgcggcggctggaggagcggcggcgggaggaggaggagaggaggaagcaggaggagctgctgaggaagcaggaggaggaggccgccaagtgggcccgggaggaggaggaggcccagaggcggctggaggagaaccggctgaggatggaggaggaggccgcccggctgcggcatgaggaggaggagaggaagaggaaggagctggaggtgcagaggcagaaggagctgatgaggcagaggcagcagcagcaggaggccctgcggcggctgcagcagcagcagcagcagcagcagctggcccagatgaagctgcccagcagcagcacctggggccagcagagcaacaccacagcctgccagagccaggccaccctgagcctggccgagatccagaagctggaggaggagcgggagcggcagctgcgggaggaggagagcagcgccagcttctgcttctacgccacagccaaggccccagctgagggcgtggatgagagcagcagcgctgctgctgccacagccacagctgagaccctgcggctgggggagtgccagcagaccttccgctaccacgagatcagcagcggggaccctgctggccggggccaggccaatgccaaggctgctgctgctgctgctgccaccccagccaccaagcagagcagctag

SEQ ID NO: 154421 - DNA, 2364 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggcgccccccggggccgcagcagcagccggggccggggccggggccgcggggagtgtggcttctaccagaggagctttgatgaggtggagggcgtgtttggccggggcggcggccgggagatgcacaggagccagagctgggaggagcggggggacagaagatttgagaagccaggcaggaaggatgtgggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagcccagatggccccaggtctgctggctggagggagcacatggagaggagaagaagatttgaatttgacttccgggacagagatgatgagcggggctacagaagagtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaagaatgtagtgacagcgagggcagccacaatgaggaggccaaggagccagacaagaccaacaagaaggagggggagaagacagacagagtgggcgtggaggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggaagagaagagaggtgggcaagagggacagctag

SEQ ID NO: 154422 - DNA, 3882 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggcgccccccggggccgcagcagcagccggggccggggccggggccgcggggagtgtggcttctaccagaggagctttgatgaggtggagggcgtgtttggccggggcggcggccgggagatgcacaggagccagagctgggaggagcggggggacagaagatttgagaagccaggcaggaaggatgtgggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagccctggctggagggagcacatggagaggagaagaagatttgaatttgacttccgggacagagatgatgagcggggctacagaagagtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaagaatgtagtgacagcgagggcagccacaatgaggaggccaaggagccagacaagaccaacaagaaggagggggagaagacagacagagtgggcgtggaggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggaagagaagagaggaggaggagctggcccggaggaagcaggaggaggccctgcggcggcagcgggagcaggagatcgccctgcggcggcagcgggaggaggaggagcggcagcagcaggaggaggccctgcggcggctggaggagaggagaagagaggaggaggagaggaggaagcaggaggagctgctgaggaagcaggaggaggaggccgccaagtgggcccgggaggaggaggaggcccagaggcggctggaggagaaccggctgaggatggaggaggaggccgcccggctgcggcatgaggaggaggagaggaagaggaaggagctggaggtgcagaggcagaaggagctgatgaggcagaggcagcagcagcaggaggccctgcggcggctgcagcagcagcagcagcagcagcagctggcccagatgaagctgcccagcagcagcacctggggccagcagagcaacaccacagcctgccagagccaggccaccctgagcctggccgagatccagaagctggaggaggagcgggagcggcagctgcgggaggagcagaggcggcagcagcgggagctgatgaaggccctgcagcagcagcagcagcagcagcagcagaagctgagcggctggggcaatgtgtccaagcccagcggcaccaccaagagcctgctggagatccagcaggaggaggcccggcagatgcagaagcagcagcagcagcagcagcagcaccagcagcccaacagagccaggaacaacacccacagcaacctgcacaccagcatcggcaacagcgtgtggggcagcatcaacacaggcccccccaaccagtgggccagtgacctggtgagcagcatctggagcaatgctgacaccaagaacagcaacatgggcttctgggatgatgctgtgaaggaggtgggccccaggaacagcaccaacaagaacaagaacaatgccagcctgagcaagtctgtgggcgtgagcaaccggcagaacaagaaggtggaggaggaggagaagctgctgaagctgttccagggcgtgaacaaggcccaggacggcttcacccagtggtgtgagcagatgctgcacgccctgaacacagccaacaacctggatgtgcccacctttgtgtccttcctgaaggaggtggagagcccctatgaggtgcatgactacatccgggcctacctgggggacaccagcgaggccaaggagtttgccaagcagttcctggagcggcgggccaagcagaaggccaaccagcagaggcagcagcagcagctgccccagcagcagcagcagcagcccccccagcagcccccccagcagccccagcagcaggacagcgtgtggggcatgaaccacagcaccctgcacagcgtcttccagaccaaccagagcaacaaccagcagagcaactttgaagctgtgcagagcggcaagaagaagaagaagcagaagatggtgcgggctgaccccagcctgctgggcttctctgtgaatgccagcagcgagcggctgaacatgggagaaattgagaccctggatgactactag

SEQ ID NO: 154423 - DNA, 3963 bp, Artificial Sequence
  Description of Artificial Sequence: Synthetic coding sequence
atggctgctgagacccagaccctgaactttggacctgagtggctgcgggccctgagcagcggcggcagcatcaccagcccccccctgagccctgccctgcccaagtacaagctggccgactaccgctatggccgggaggagatgctggccctcttcctgaaggacaacaagatccccagcgacctgctggacaaggagttcctgcccatcctgcaggaggagcccctgccccccctggccctggtgcccttcacagaggaggagcagaggaacttctccatgtctgtgaacagcgctgctgtgctgcggctgaccggccggggcggcggcggcaccgtggtgggcgccccccggggccgcagcagcagccggggccggggccggggccgcggggagtgtggcttctaccagaggagctttgatgaggtggagggcgtgtttggccggggcggcggccgggagatgcacaggagccagagctgggaggagcggggggacagaagatttgagaagccaggcaggaaggatgtgggcaagaagaatggctactactgcatgtacagccctgtgctgctgctgggccagcccctgtgccagggccggcccaactttgaggagggcggccccacctctgtgggcaggaagcatgagttcatccgctctgagagcgagaactggaggatcttccgggaggagcagaatggagaagatgaagatggcggctggaggctggccggcagcagaagagatggagagcgctggaggccccacagcccagatggccccaggtctgctggctggagggagcacatggagaggagaagaagatttgaatttgacttccgggacagagatgatgagcggggctacagaagagtgcgcagcggcagcggcagcattgatgatgaccgggacagcctgcctgagtggtgcctggaggatgctgaggaggagatgggcacctttgacagcagcggggccttcctgagcctgaagaaggtgcagaaggagcccatccctgaggagcaggagatggacttccggcctgtggatgaaggagaagaatgtagtgacagcgagggcagccacaatgaggaggccaaggagccagacaagaccaacaagaaggagggggagaagacagacagagtgggcgtggccagcgaggagaccccccagaccagcagcagcagcgcccggcccggcacccccagcgaccaccagagccaggaggccagccagtttgagaggaaggatgagcccaagacagagcagacagagaaggccgaggaggagaccaggatggagaacagcctgcctgccaaggtgcccagcagaggagatgagatggtggctgatgtgcagcagcccctgagccagatccccagcgacacagccagccccctgctgatcctgcccccacctgtgcccaaccccagccccaccctgcggcctgtggagacccctgtggtgggcgcccctggcatgggctctgtgtccacagagccagatgatgaggagggcctgaagcacctggagcagcaggccgagaagatggtggcctacctgcaggacagcgccctggatgatgagcggctggccagcaagctgcaggagcaccgggccaagggcgtgtccatccccctgatgcatgaggccatgcagaagtggtactacaaggacccccagggcgagatccagggccccttcaacaaccaggagatggccgagtggttccaggccggctacttcaccatgagcctgctggtgaagagggcctgtgatgagagcttccagcccctgggggacatcatgaagatgtggggccgggtgcccttcagccctggccctgcccccccaccccacatgggagagctggaccaggagcggctgacccggcagcaggagctgacagccctgtaccagatgcagcacctgcagtaccagcagttcctgatccagcagcagtatgcccaggtgctggcccagcagcagaaggccgccctgagcagccagcagcagcagcagctggccctgctgctgcagcagttccagaccctgaagatgaggatcagtgaccagaacatcatccccagcgtgaccaggtctgtgtctgtgcctgacaccggcagcatctgggagctgcagcccacagccagccagcccaccgtgtgggagggcggctctgtgtgggacctgcccctggacaccaccaccccaggccctgccctggagcagctgcagcagctggagaaggccaaggccgccaagctggagcaggagcggcgggaggccgagatgagggccaagcgggaggaggaggagaggaagaggcaggaggagctgcggcggcagcaggaggagatcctgcggcggcagcaggaggaggagaggaagaggcgggaggaggaggagctggcccggaggaagcaggaggaggccctgcggcggcagcgggagcaggagatcgccctgcggcggcagcgggaggaggaggagcggcagcagcaggaggaggccctgcggcggctggaggagcggcggcgggaggaggaggagaggaggaagcaggaggagctgctgaggaagcaggaggaggaggccgccaagtgggcccgggaggaggaggaggcccagaggcggctggaggagaaccggctgaggatggaggaggaggccgcccggctgcggcatgaggaggaggagaggaagaggaaggagctggaggtgcagaggcagaaggagctgatgaggcagaggcagcagcagcaggaggccctgcggcggctgcagcagcagcagcagcagcagcagctggcccagatgaagctgcccagcagcagcacctggggccagcagagcaacaccacagcctgccagagccaggccaccctgagcctggccgagatccagaagctggaggaggagcgggagcggcagctgcgggaggagcagaggcggcagcagcgggagctgatgaaggccctgcagcagcagcagcagcagcagcagcagaagctgagcggctggggcaatgtgtccaagcccagcggcaccaccaagagcctgctggagatccagcaggaggaggcccggcagatgcagaagcagcagcagcagcagcagcagcaccagcagcccaacagagccaggaacaacacccacagcaacctgcacaccagcatcggcaacagcgtgtggggcagcatcaacacaggcccccccaaccagtgggccagtgacctggtgagcagcatctggagcaatgctgacaccaagaacagcaacatgggcttctgggatgatgctgtgaaggaggtgggccccaggaacagcaccaacaagaacaagaacaatgccagcctgagcaagtctgtgggcgtgagcaaccggcagaacaagaaggtggaggaggaggagaagctgctgaagctgttccagggcgtgaacaaggcccaggacggcttcacccagtggtgtgagcagatgctgcacgccctgaacacagccaacaacctggatgtgcccacctttgtgtccttcctgaaggaggtggagagcccctatgaggtgcatgactacatccgggcctacctgggggacaccagcgaggccaaggagtttgccaagcagttcctggagcggcgggccaagcagaaggccaaccagcagaggcagcagcagcagctgccccagcagcagcagcagcagcccccccagcagcccccccagcagccccagcagcaggacagcgtgtggggcatgaaccacagcaccctgcacagcgtcttccagaccaaccagagcaacaaccagcagagcaactttgaggccgtgcagagcggcaagaagaagaagaagcagaagatggtgcgggctgaccccagcctgctgggcttctctgtgaatgccagcagcgagcggctgaacatgggagaaattgagaccctggatgactactag

SEQ ID NO: 154424 - DNA, 2085 bp, Artificial Sequence
  Description of Artificial Sequence: Synthetic coding sequence
atgtctggaggagaggtggtgtgcagcggctggctgaggaagagccccccagagaagaagctgaagagatatgcctggaagaggcgctggtttgtgctgcggagcggccgcctgactggagaccctgatgtgctggagtactacaagaatgaccacgccaagaagcccatccgcatcatcgacctgaacctgtgccagcaggtggatgctggcctgaccttcaacaagaaggagtttgagaacagctacatctttgacatcaacaccatcgaccgcatcttctacctggtggccgacagcgaggaggagatgaacaagtgggtgcgctgcatctgtgacatctgtggcttcaaccccacagaggaggaccctgtgaagcccccaggcagcagcctgcaggccccagctgacctgcccctggccatcaacacagccccacccagcacccaggccgacagcagcagcgccaccctgcccccaccctaccagctgatcaacgtgcccccccacctggagaccctgggcatccaggaggacccccaggactacctgctgctgatcaactgccagagcaagaagccagagcccaccaggacccatgctgacagcgccaagagcaccagcagcgagacagactgcaatgacaacgtgcccagccacaagaacccagccagcagccagagcaagcacggcatgaatggcttcttccagcagcagatgatctatgacagcccccccagccgggcccccagcgcctctgtggacagcagcctgtacaacctgcccaggagctacagccatgatgtgctgcccaaggtgagccccagcagcacagaagcagatggagagctgtatgtgttcaacaccccatctggcaccagctctgtggagacccagatgagacatgtgtccatctcctatgacatcccccccaccccaggcaacacctaccagatccccaggaccttccctgagggcaccctgggccagaccagcaagctggacaccatcccagacatccccccacccaggcctcccaagccccacccagcccatgacaggagccctgtggagacctgcagcatccccaggacagccagtgacacagacagcagctactgcatccccacagctggcatgagccccagccgcagcaacaccatcagcacagtggacctgaacaagctgaggaaggatgccagcagccaggactgctatgacatcccccgggccttccccagcgacaggagcagcagcctggagggcttccacaaccacttcaaggtgaagaatgtgctgactgtgggctctgtgagcagcgaggagctggatgaaaattatgtgcccatgaaccccaacagccccccccggcagcacagcagcagcttcacagagcccatccaggaggccaactacgtgcccatgaccccaggcacctttgacttcagcagctttggcatgcaggtgcccccaccagcccacatgggcttccgcagcagccccaagaccccaccccggcggcctgtgcctgtggccgactgtgagcccccacctgtggacaggaacctgaagccagacaggaaggtgaagccagcccccctggagatcaagcccctgcctgagtgggaggagctgcaggcccctgtgcgcagccccatcaccaggagctttgcccgggacagcagccgcttccccatgagccccaggccagacagcgtgcacagcaccaccagcagcagtgacagccatgattctgaagaaaattatgtgcccatgaaccccaacctgagcagcgaggaccccaacctgtttggcagcaacagcctggatggcggcagcagccccatgatcaagcccaagggggacaagcaggtggagtacctggacctggacctggacagcggcaagagcaccccacccaggaagcagaagagcagcggcagcggcagctctgtggctgatgagcgggtggactatgtggtggtggaccagcagaagaccctggccctgaagagcacccgggaggcctggacagatggccggcagagcacagagagcgagaccccagccaagtctgtgaagtag

SEQ ID NO: 154425 - DNA, 2175 bp, Artificial Sequence
  Description of Artificial Sequence: Synthetic coding sequence
atgtctggaggagaggtggtgtgcagcggctggctgaggaagagccccccagagaagaagctgaagagatatgcctggaagaggcgctggtttgtgctgcggagcggccgcctgactggagaccctgatgtgctggagtactacaagaatgaccacgccaagaagcccatccgcatcatcgacctgaacctgtgccagcaggtggatgctggcctgaccttcaacaagaaggagtttgagaacagctacatctttgacatcaacaccatcgaccgcatcttctacctggtggccgacagcgaggaggagatgaacaagtgggtgcgctgcatctgtgacatctgtggcttcaaccccacagaggaggaccctgtgaagcccccaggcagcagcctgcaggccccagctgacctgcccctggccatcaacacagccccacccagcacccaggccgacagcagcagcgccaccctgcccccaccctaccagctgatcaacgtgcccccccacctggagaccctgggcatccaggaggacccccaggactacctgctgctgatcaactgccagagcaagaagccagagcccaccaggacccatgctgacagcgccaagagcaccagcagcgagacagactgcaatgacaacgtgcccagccacaagaacccagccagcagccagagcaagcacggcatgaatggcttcttccagcagcagatgatctatgacagcccccccagccgggcccccagcgcctctgtggacagcagcctgtacaacctgcccaggagctacagccatgatgtgctgcccaaggtgagccccagcagcacagaagcagatggagagctgtatgtgttcaacaccccatctggcaccagctctgtggagacccagatgagacatgtgtccatctcctatgacatcccccccaccccaggcaacacctaccagatccccaggaccttccctgagggcaccctgggccagaccagcaagctggacaccatcccagacatccccccacccaggcctcccaagccccacccagcccatgacaggagccctgtggagacctgcagcatccccaggacagccagtgacacagacagcagctactgcatccccacagctggcatgagccccagccgcagcaacaccatcagcacagtggacctgaacaagctgaggaaggatgccagcagccaggactgctatgacatcccccgggccttccccagcgacaggagcagcagcctggagggcttccacaaccacttcaaggtgaagaatgtgctgactgtgggctctgtgagcagcgaggagctggatgaaaattatgtgcccatgaaccccaacagccccccccggcagcacagcagcagcttcacagagcccatccaggaggccaactacgtgcccatgaccccaggcacctttgacttcagcagctttggcatgcaggtgcccccaccagcccacatgggcttccgcagcagccccaagaccccaccccggcggcctgtgcctgtggccgactgtgagcccccacctgtggacaggaacctgaagccagacaggaagggccagagccccaagatcctgcggctgaagccccacggcctggagaggacagacagccagaccatcggggactttgccaccaggaggaaggtgaagccagcccccctggagatcaagcccctgcctgagtgggaggagctgcaggcccctgtgcgcagccccatcaccaggagctttgcccgggacagcagccgcttccccatgagccccaggccagacagcgtgcacagcaccaccagcagcagtgacagccatgattctgaagaaaattatgtgcccatgaaccccaacctgagcagcgaggaccccaacctgtttggcagcaacagcctggatggcggcagcagccccatgatcaagcccaagggggacaagcaggtggagtacctggacctggacctggacagcggcaagagcaccccacccaggaagcagaagagcagcggcagcggcagctctgtggctgatgagcgggtggactatgtggtggtggaccagcagaagaccctggccctgaagagcacccgggaggcctggacagatggccggcagagcacagagagcgagaccccagccaagtctgtgaagtag

SEQ ID NO: 154426 - DNA, 1776 bp, Artificial Sequence
  Description of Artificial Sequence: Synthetic coding sequence
atgaacaagtgggtgcgctgcatctgtgacatctgtggcttcaaccccacagaagaagatcctgtgaagcccccaggcagcagcctgcaggccccagctgacctgcccctggccatcaacacagccccacccagcacccaggccgacagcagcagcgccaccctgcccccaccctaccagctgatcaacgtgcccccccacctggagaccctgggcatccaggaggacccccaggactacctgctgctgatcaactgccagagcaagaagccagagcccaccaggacccacgccgacagcgccaagagcaccagcagcgagacagactgcaatgacaacgtgcccagccacaagaacccagccagcagccagagcaagcacggcatgaatggcttcttccagcagcagatgatctatgacagcccccccagccgggcccccagcgcctctgtggacagcagcctgtacaacctgcccaggagctacagccatgatgtgctgcccaaggtgagccccagcagcacagaagcagatggagagctgtatgtgttcaacacccccagcggcaccagctctgtggagacccagatgagacatgtgtccatctcctatgacatcccccccaccccaggcaacacctaccagatccccaggaccttccctgagggcaccctgggccagaccagcaagctggacaccatcccagacatccccccaccccggccccccaagccccacccagcccatgacaggagccctgtggagacctgcagcatccccaggacagccagtgacacagacagcagctactgcatccccacagctggcatgagccccagccgcagcaacaccatcagcacagtggacctgaacaagctgaggaaggatgccagcagccaggactgctatgacatcccccgggccttccccagcgacaggagcagcagcctggagggcttccacaaccacttcaaggtgaagaatgtgctgactgtgggctctgtgtcctctgaggagctggatgagaactacgtgcccatgaaccccaacagccccccccggcagcacagcagcagcttcacagagcccatccaggaggccaactacgtgcccatgaccccaggcacctttgacttcagcagctttggcatgcaggtgcccccaccagcccacatgggcttccgcagcagccccaagaccccaccaagaagacctgtgcctgtggccgactgtgagcccccacctgtggacaggaacctgaagccagacaggaaggtgaagccagcccccctggagatcaagcccctgcctgagtgggaggagctgcaggcccctgtgcgcagccccatcaccaggagctttgcccgggacagcagccgcttccccatgagccccaggccagattctgtgcacagcaccaccagcagcagtgacagccatgacagcgaggagaactacgtgcccatgaaccccaacctgagcagcgaggaccccaacctgtttggcagcaacagcctggatggcggcagcagccccatgatcaagcccaagggggacaagcaggtggagtacctggacctggacctggacagcggcaagagcaccccacccaggaagcagaagagcagcggcagcggcagctctgtggctgatgagcgggtggactatgtggtggtggaccagcagaagaccctggccctgaagagcacccgggaggcctggacagatggccggcagagcacagaaagtgagaccccagccaagtctgtgaagtag

SEQ ID NO: 154427 - DNA, 1917 bp, Artificial Sequence
  Description of Artificial Sequence: Synthetic coding sequence
atgtctggggaccctgatgtgctggagtactacaagaatgaccacagcaagaagcccctgcgcatcatcaacctgaacttctgtgagcaggtggatgctggcctgaccttcaacaagaaggagctgcaggacagctttgtgtttgacatcaagaccagcgagaggaccttctacctggtggccgagacagaggaggacatgaacaagtgggtgcagagcatctgccagatctgtggcttcaaccaggccgaggagagcacagacagcctgagaaatgtgtcctctgctggccacggccccaggagcagccctgctgagctgagcagcagcagccagcacctgctgcgggagaggaagagcagcgcccccagccacagcagccagcccaccctcttcacctttgagccccctgtgagcaaccacatgcagcccaccctgagcaccagcgccccccaggagtacctgtacctgcaccagtgcatcagcagaagagcagaaaatgcccggagcgccagcttcagccagggcacccgggccagcttcctgatgagaagtgacacagctgtgcagaagctggcccagggcaatggccactgtgtgaatggcatcagcggccaggtgcacggcttctacagcctgcccaagcccagccgccacaacacagagttccgggacagcacctatgacctgcccaggagcctggccagccacggccacaccaagggcagcctgactggaagtgaaacagacaatgaagatgtgtacaccttcaagacccccagcaacaccctgtgccgggagtttggagacctgctggtggacaacatggatgtgcctgccacccccctgagcgcctaccagatccccaggaccttcaccctggacaagaaccacaatgccatgacagtggccacccctggggacagcgccatcgcccccccacccaggcctcccaagcccagccaggccgagaccccccgctggggcagcccccagcagaggcctcccatcagcgagaacagccgctctgtggccgccaccatccccaggaggaacaccctgcctgccatggacaacagccggctgcaccgggccagcagctgtgagacctatgagtacccccagagaggaggagagagcgctggccgctctgctgagagcatgtctgatggagtgggcagcttcctgcccgggaagatgattgtgggccgcagtgacagcaccaacagcgaggacaactacgtgcccatgaaccctggcagcagcaccctgctggccatggagcgggccggggacaacagccagagcgtgtacatccccatgagccctggggcccaccactttgacagcctgggctaccccagcaccaccctgcctgtgcaccggggccccagccggggcagcgagatccagcccccacctgtgaacagaaacctgaagccagacaggaaggccaagcccacccccctggacctgaggaacaacacagtgattgatgagctgcccttcaagagccccatcaccaagtcctggagccgggccaaccacaccttcaacagcagcagcagccagtactgccggcccatcagcacccagagcatcaccagcacagattctggggacagcgaggagaactacgtgcccatgcagaaccctgtgtctgccagccctgtgcccagcggcaccaacagccctgcccccaagaagagcactggatctgtggactacctggccctggacttccagcccagcagccccagcccccacaggaagcccagcaccagctctgtgaccagtgatgagaaggtggactatgtgcaggtggacaaggagaagacccaggccctgcagaacaccatgcaggagtggacagatgtgcggcagagcagcgagcccagcaagggggccaagctgtag

SEQ ID NO: 154428 - DNA, 2031 bp, Artificial Sequence
  Description of Artificial Sequence: Synthetic coding sequence
atgtctggaggaggagatgtggtgtgcaccggctggctgaggaagagccccccagagaagaagctgcggcgctatgcctggaagaagcgctggttcatcctgcggagcggccgcatgtctggggaccctgatgtgctggagtactacaagaatgaccacagcaagaagcccctgcgcatcatcaacctgaacttctgtgagcaggtggatgctggcctgaccttcaacaagaaggagctgcaggacagctttgtgtttgacatcaagaccagcgagaggaccttctacctggtggccgagacagaggaggacatgaacaagtgggtgcagagcatctgccagatctgtggcttcaaccaggccgaggagagcacagacagcctgagaaatgtgtcctctgctggccacggccccaggagcagccctgctgagctgagcagcagcagccagcacctgctgcgggagaggaagagcagcgcccccagccacagcagccagcccaccctcttcacctttgagccccctgtgagcaaccacatgcagcccaccctgagcaccagcgccccccaggagtacctgtacctgcaccagtgcatcagcagaagagcagaaaatgcccggagcgccagcttcagccagggcacccgggccagcttcctgatgagaagtgacacagctgtgcagaagctggcccagggcaatggccactgtgtgaatggcatcagcggccaggtgcacggcttctacagcctgcccaagcccagccgccacaacacagagttccgggacagcacctatgacctgcccaggagcctggccagccacggccacaccaagggcagcctgactggaagtgaaacagacaatgaagatgtgtacaccttcaagacccccagcaacaccctgtgccgggagtttggagacctgctggtggacaacatggatgtgcctgccacccccctgagcgcctaccagatccccaggaccttcaccctggacaagaaccacaatgccatgacagtggccacccctggggacagcgccatcgcccccccacccaggcctcccaagcccagccaggccgagaccccccgctggggcagcccccagcagaggcctcccatcagcgagaacagccgctctgtggccgccaccatccccaggaggaacaccctgcctgccatggacaacagccggctgcaccgggccagcagctgtgagacctatgagtacccccagagaggaggagagagcgctggccgctctgctgagagcatgtctgatggagtgggcagcttcctgcccgggaagatgattgtgggccgcagtgacagcaccaacagcgaggacaactacgtgcccatgaaccctggcagcagcaccctgctggccatggagcgggccggggacaacagccagagcgtgtacatccccatgagccctggggcccaccactttgacagcctgggctaccccagcaccaccctgcctgtgcaccggggccccagccggggcagcgagatccagcccccacctgtgaacagaaacctgaagccagacaggaaggccaagcccacccccctggacctgaggaacaacacagtgattgatgagctgcccttcaagagccccatcaccaagtcctggagccgggccaaccacaccttcaacagcagcagcagccagtactgccggcccatcagcacccagagcatcaccagcacagattctggggacagcgaggagaactacgtgcccatgcagaaccctgtgtctgccagccctgtgcccagcggcaccaacagccctgcccccaagaagagcactggatctgtggactacctggccctggacttccagcccagcagccccagcccccacaggaagcccagcaccagctctgtgaccagtgatgagaaggtggactatgtgcaggtggacaaggagaagacccaggccctgcagaacaccatgcaggagtggacagatgtgcggcagagcagcgagcccagcaagggggccaagctgtag

SEQ ID NO: 154429 - DNA, 396 bp, Artificial Sequence
  Description of Artificial Sequence: Synthetic coding sequence
atgtctggggaccctgatgtgctggagtactacaagaatgaccacagcaagaagcccctgcgcatcatcaacctgaacttctgtgagcaggtggatgctggcctgaccttcaacaagaaggagctgcaggacagctttgtgtttgacatcaagaccagcgagaggaccttctacctggtggccgagacagaggaggacatgaacaagtgggtgcagagcatctgccagatctgtggcttcaaccaggccgaggagagcacagacagcctgagaaatgtgtcctctgctggccacggccccaggagcagccctgctgagctgagcagcagcagccagcacctgctgcgggagaggaagagcagcgcccccagccacagcagccagcccaccctgtag

SEQ ID NO: 154430 - DNA, 309 bp, Artificial Sequence
  Description of Artificial Sequence: Synthetic coding sequence
atgtctggggaccctgatgtgctggagtactacaagaatgaccacagcaagaagcccctgcgcatcatcaacctgaacttctgtgagcaggtggatgctggcctgaccttcaacaagaaggagctgcaggacagctttgtgtttgacatcaagaccagcgagaggaccttctacctggtggccgagacagaggaggacatgaacaagtgggtgcagagcatctgccagatctgtggcttcaaccaggccgaggagagcacagacagcctgagaaatgtgtcctctgctggccacggccccaggagctag

SEQ ID NO: 154431 - DNA, 993 bp, Artificial Sequence
  Description of Artificial Sequence: Synthetic coding sequence
atggaggccgtggccaagtttgacttcaccgccagcggggaggatgagctgtccttccacactggagatgtgctgaagatcctgagcaaccaggaggagtggttcaaggccgagctgggcagccaggagggctacgtgcccaagaacttcatcgacatccagttccccaagtggttccacgagggcctgagccgccaccaggccgagaacctgctgatgggcaaggaggtgggcttcttcatcatccgggccagccagagcagccctggggacttcagcatctctgtgagacatgaagatgatgtgcagcacttcaaggtgatgagggacaacaagggcaactacttcctgtggacagagaagttccccagcctgaacaagctggtggactactaccgcaccaacagcatcagccggcagaagcagatcttcctgcgggacaggacccgggaggaccagggccaccggggcaacagcctggaccggcgcagccagggcggcccccacctgtctggagctgtgggggaggagatccggcccagcatgaacaggaagctgagtgaccacccccccaccctgcccctgcagcagcaccagcaccagccccagcccccccagtatgccccagccccccagcagctgcagcagcccccccagcagcgctacctgcagcaccaccacttccaccaggagcggcggggcggcagcctggacatcaatgatggccactgcggcaccggcctgggcagcgagatgaatgctgccctgatgcacagaagacacacagatcctgtgcagctgcaggccgccggccgggtgcgctgggcccgggccctgtatgactttgaggccctggaggatgatgagctgggcttccacagcggggaggtggtggaggtgctggacagcagcaaccccagctggtggacaggccgcctgcacaacaagctgggcctcttccctgccaactacgtggcccccatgaccaggtag

SEQ ID NO: 154432 - DNA, 654 bp, Artificial Sequence
  Description of Artificial Sequence: Synthetic coding sequence
atggtgtcccggcggcccctgagcaccccaggccgggagctgacccacggccagggcggctggctgctgcaccaccctggccagcctgagctgccccggggcctgctgcacctgtgccagggccaccggggcaacagcctggacagaagaagccagggcggcccccacctgagcggggctgtgggggaggagatccggcccagcatgaacaggaagctgagtgaccacccccccaccctgcccctgcagcagcaccagcaccagccccagcccccccagtatgccccagccccccagcagctgcagcagcccccccagcagcgctacctgcagcaccaccacttccaccaggagaggagaggaggcagcctggacatcaatgatggccactgcggcaccggcctgggcagcgagatgaatgctgccctgatgcaccggcggcacacagatcctgtgcagctgcaggccgccggccgggtgcgctgggcccgggccctgtatgactttgaggccctggaggatgatgagctgggcttccacagcggggaggtggtggaggtgctggacagcagcaaccccagctggtggacaggccgcctgcacaacaagctgggcctcttccctgccaactacgtggcccccatgaccaggtag

SEQ ID NO: 154433 - DNA, 993 bp, Artificial Sequence; identical to SEQ ID NO: 154431
  Description of Artificial Sequence: Synthetic coding sequence

SEQ ID NO: 154434 - DNA, 294 bp, Artificial Sequence
  Description of Artificial Sequence: Synthetic coding sequence
atggaggccgtggccaagtttgacttcaccgccagcggggaggatgagctgtccttccacactggagatgtgctgaagatcctgagcaaccaggaggagtggttcaaggccgagctgggcagccaggagggctacgtgcccaagaacttcatcgacatccagttccccaagtggttccacgagggcctgagccgccaccaggccgagaacctgctgatgggcaaggaggtgggcttcttcatcatccgggccagccagagcagccctggggacttcagcatctctgtgaggtag

SEQ ID NO: 154435 - DNA, 795 bp, Artificial Sequence
  Description of Artificial Sequence: Synthetic coding sequence
atgctggagtttgtgtccctgctggccaggaaggacagcaacaacagcgtgtccaagcccaggcacaagctgaaccccttcagcagcaagagacatgaagatgatgtgcagcacttcaaggtgatgagggacaacaagggcaactacttcctgtggacagagaagttccccagcctgaacaagctggtggactactaccgcaccaacagcatcagccggcagaagcagatcttcctgcgggacaggacccgggaggaccagggccaccggggcaacagcctggaccggcgcagccagggcggcccccacctgtctggagctgtgggggaggagatccggcccagcatgaacaggaagctgagtgaccacccccccaccctgcccctgcagcagcaccagcaccagccccagcccccccagtatgccccagccccccagcagctgcagcagcccccccagcagcgctacctgcagcaccaccacttccaccaggagcggcggggcggcagcctggacatcaatgatggccactgcggcaccggcctgggcagcgagatgaatgctgccctgatgcacagaagacacacagatcctgtgcagctgcaggccgccggccgggtgcgctgggcccgggccctgtatgactttgaggccctggaggatgatgagctgggcttccacagcggggaggtggtggaggtgctggacagcagcaaccccagctggtggacaggccgcctgcacaacaagctgggcctcttccctgccaactacgtggcccccatgaccaggtag

SEQ ID NO: 154436 - DNA, 837 bp, Artificial Sequence
  Description of Artificial Sequence: Synthetic coding sequence
atggaggccgtggccaagtttgacttcaccgccagcggggaggatgagctgtccttccacactggagatgtgctgaagatcctgagcaaccaggaggagtggttcaaggccgagctgggcagccaggagggctacgtgcccaagaacttcatcgacatccagttccccaagcatgaagatgatgtgcagcacttcaaggtgatgagggacaacaagggcaactacttcctgtggacagagaagttccccagcctgaacaagctggtggactactaccgcaccaacagcatcagccggcagaagcagatcttcctgcgggacaggacccgggaggaccagggccaccggggcaacagcctggaccggcgcagccagggcggcccccacctgtctggagctgtgggggaggagatccggcccagcatgaacaggaagctgagtgaccacccccccaccctgcccctgcagcagcaccagcaccagccccagcccccccagtatgccccagccccccagcagctgcagcagcccccccagcagcgctacctgcagcaccaccacttccaccaggagcggcggggcggcagcctggacatcaatgatggccactgcggcaccggcctgggcagcgagatgaatgctgccctgatgcacagaagacacacagatcctgtgcagctgcaggccgccggccgggtgcgctgggcccgggccctgtatgactttgaggccctggaggaggtgctggacagcagcaaccccagctggtggacaggccgcctgcacaacaagctgggcctcttccctgccaactacgtggcccccatgaccaggtag

SEQ ID NO: 154437 - DNA, 915 bp, Artificial Sequence
  Description of Artificial Sequence: Synthetic coding sequence
atgctggagtttgtgtccctgctggccaggaaggacagcaacaacagcgtgtccaagcccaggcacaagctgaaccccttcagcagcaagcgctggttccacgagggcctgagccgccaccaggccgagaacctgctgatgggcaaggaggtgggcttcttcatcatccgggccagccagagcagccctggggacttcagcatctctgtgagacatgaagatgatgtgcagcacttcaaggtgatgagggacaacaagggcaactacttcctgtggacagagaagttccccagcctgaacaagctggtggactactaccgcaccaacagcatcagccggcagaagcagatcttcctgcgggacaggacccgggaggaccagggccaccggggcaacagcctggaccggcgcagccagggcggcccccacctgtctggagctgtgggggaggagatccggcccagcatgaacaggaagctgagtgaccacccccccaccctgcccctgcagcagcaccagcaccagccccagcccccccagtatgccccagccccccagcagctgcagcagcccccccagcagcgctacctgcagcaccaccacttccaccaggagcggcggggcggcagcctggacatcaatgatggccactgcggcaccggcctgggcagcgagatgaatgctgccctgatgcacagaagacacacagatcctgtgcagctgcaggccgccggccgggtgcgctgggcccgggccctgtatgactttgaggccctggaggatgatgagctgggcttccacagcggggaggtggtggaggtgctggacagcagcaaccccagctggtggacaggccgcctgcacaacaagctgggcctcttccctgccaactacgtggcccccatgaccaggtag

SEQ ID NO: 154438 - DNA, 777 bp, Artificial Sequence
  Description of Artificial Sequence: Synthetic coding sequence
atgggcaaggaggtgggcttcttcatcatccgggccagccagagcagccctggggacttcagcatctctgtgagacatgaagatgatgtgcagcacttcaaggtgatgagggacaacaagggcaactacttcctgtggacagagaagttccccagcctgaacaagctggtggactactaccgcaccaacagcatcagccggcagaagcagatcttcctgcgggacaggacccgggaggaccagggccaccggggcaacagcctggaccggcgcagccagggcggcccccacctgtctggagctgtgggggaggagatccggcccagcatgaacaggaagctgagtgaccacccccccaccctgcccctgcagcagcaccagcaccagccccagcccccccagtatgccccagccccccagcagctgcagcagcccccccagcagcgctacctgcagcaccaccacttccaccaggagcggcggggcggcagcctggacatcaatgatggccactgcggcaccggcctgggcagcgagatgaatgctgccctgatgcacagaagacacacagatcctgtgcagctgcaggccgccggccgggtgcgctgggcccgggccctgtatgactttgaggccctggaggatgatgagctgggcttccacagcggggaggtggtggaggtgctggacagcagcaaccccagctggtggacaggccgcctgcacaacaagctgggcctcttccctgccaactacgtggcccccatgaccaggtag

SEQ ID NO: 154439 - DNA, 507 bp, Artificial Sequence
  Description of Artificial Sequence: Synthetic coding sequence
atgttctggaagctgagcctgagcctcttcctggtggccgtgctggtgaaggtggccgaggccaggaagaacagacctgctggggccatccccagcccctacaaggatggcagcagcaacaacagcgagcgctggcagcaccagatcaaggaggtgctggccagcagccaggaggccctggtggtgacagagaggaagtacctgaagagtgactggtgcaagacccagcccctgcggcagacagtgtctgaggagggctgccgcagcaggaccatcctgaaccgcttctgctacggccagtgcaacagcttctacatccccaggcatgtgaagaaggaggaggagagcttccagagctgtgccttctgcaagccccagagggtgacctctgtgctggtggagctggagtgccccggcctggacccccccttccggctgaagaagatccagaaggtgaagcagtgccgctgcatgtctgtgaacctgagtgacagcgacaagcagtag

SEQ ID NO: 154440 - DNA, 1443 bp, Artificial Sequence
  Description of Artificial Sequence: Synthetic coding sequence
atggccggcacccgctgggtgctgggcgccctgctgcggggctgcggctgcaactgcagcagctgcagaagaactggagctgcctgcctgcccttctacagcgctgctggcagcatccccagcggcgtgtctggaagaagaaggctgctgctgctgctgggcgctgctgctgctgctgccagccagacccggggcctgcagacaggccctgtgcccccaggccgcctggccggccccccagctgtggccaccagcgctgctgctgctgctgctgccagctacagcgccctgcgggccagcctgctgccccagagcctggccgctgctgctgctgtgcccaccaggagctacagccaggagagcaagaccacctacctggaggacctgcccccacctccagaatatgagctggcccccagcaagctggaggaggaggtggatgatgtgttcctgatccgggcccagggcctgccctggagctgcaccatggaggatgtgctgaacttcttcagtgactgccgcatcagaaatggagaaaatggcatccacttcctgctgaacagagatggcaagagaagaggagatgccctgattgagatggagagcgagcaggatgtgcagaaggccctggagaagcacaggatgtacatgggccagagatatgtggaggtgtatgagatcaacaatgaagatgtggatgccctgatgaagagcctgcaggtgaagagcagccctgtggtgaatgatggagtggtgcggctgcggggcctgccctacagctgcaatgagaaggacatcgtggacttctttgctggcctgaacatcgtggacatcacctttgtgatggactaccggggccgcaggaagacaggagaggcctacgtgcagtttgaggagcctgagatggccaaccaggccctgctgaagcaccgggaggagatcggcaaccgctacatcgagatcttccccagcagaagaaatgaggtgaggacccacgtgggcagctacaagggcaagaagatcgccagcttccccacagccaagtacatcacagagcctgagatggtgtttgaggagcacgaggtgaatgaagacatccagcccatgacagcctttgagagcgagaaggagattgagctgcccaaggaggtgcctgagaagctgcctgaggccgctgactttggcaccaccagcagcctgcactttgtgcacatgaggggcctgcccttccaggccaatgcccaggacatcatcaacttctttgcccccctgaagcctgtgcgcatcaccatggagtacagcagcagcggcaaggccaccggggaggctgatgtgcactttgagacccatgaagatgctgtggccgccatgctgaaggacaggagccacgtgcaccaccgctacatcgagctgttcctgaacagctgccccaagggcaagtag

SEQ ID NO: 154441 - DNA, 957 bp, Artificial Sequence
  Description of Artificial Sequence: Synthetic coding sequence
atggaggatgtgctgaacttcttcagtgactgccgcatcagaaatggagaaaatggcatccacttcctgctgaacagagatggcaagagaagaggagatgccctgattgagatggagagcgagcaggatgtgcagaaggccctggagaagcacaggatgtacatgggccagagatatgtggaggtgtatgagatcaacaatgaagatgtggatgccctgatgaagagcctgcaggtgaagagcagccctgtggtgaatgatggagtggtgcggctgcggggcctgccctacagctgcaatgagaaggacatcgtggacttctttgctggcctgaacatcgtggacatcacctttgtgatggactaccggggccgcaggaagacaggagaggcctacgtgcagtttgaggagcctgagatggccaaccaggccctgctgaagcaccgggaggagatcggcaaccgctacatcgagatcttccccagcagaagaaatgaggtgaggacccacgtgggcagctacaagggcaagaagatcgccagcttccccacagccaagtacatcacagagcctgagatggtgtttgaggagcacgaggtgaatgaagacatccagcccatgacagcctttgagagcgagaaggagattgagctgcccaaggaggtgcctgagaagctgcctgaggccgctgactttggcaccaccagcagcctgcactttgtgcacatgaggggcctgcccttccaggccaatgcccaggacatcatcaacttctttgcccccctgaagcctgtgcgcatcaccatggagtacagcagcagcggcaaggccaccggggaggctgatgtgcactttgagacccatgaagatgctgtggccgccatgctgaaggacaggagccacgtgcaccaccgctacatcgagctgttcctgaacagctgccccaagggcaagtag

SEQ ID NO: 154442 - DNA, 1362 bp, Artificial Sequence
  Description of Artificial Sequence: Synthetic coding sequence
gctgctgctgtgcccaccaggagctacagccaggtgcggggcagaagagagggccctggggcccggagcctgcccggccgggtgcacgccccaccccggcccagcgtgcccccctgtgccccccggggccacgcccggggcagcgccaccctggccgcccaccccccacccagcaccctgtgcagctactgggccctggagcagggcaagctgagccaggccagcggcctgctgctggtgctcttcagcccccgggtgtctggccgcctgggcagcgagagcaagaccacctacctggaggacctgcccccacctccagaatatgagctggcccccagcaagctggaggaggaggtggatgatgtgttcctgatccgggcccagggcctgccctggagctgcaccatggaggatgtgctgaacttcttcagtgactgccgcatcagaaatggagaaaatggcatccacttcctgctgaacagagatggcaagagaagaggagatgccctgattgagatggagagcgagcaggatgtgcagaaggccctggagaagcacaggatgtacatgggccagcgctacgtggaggtgtatgagatcaacaatgaagatgtggatgccctgatgaagagcctgcaggtgaagagcagccctgtggtgaatgatggagtggtgcggctgcggggcctgccctacagctgcaatgagaaggacatcgtggacttctttgctggcctgaacatcgtggacatcacctttgtgatggactaccggggccgcaggaagacaggagaggcctacgtgcagtttgaggagcctgagatggccaaccaggccctgctgaagcaccgggaggagatcggcaaccgctacatcgagatcttccccagcagaagaaatgaggtgaggacccacgtgggcagctacaagggcaagaagatcgccagcttccccacagccaagtacatcacagagcctgagatggtgtttgaggagcacgaggtgaatgaagacatccagcccatgacagcctttgaaagtgagaaggagattgagctgcccaaggaggtgcctgagaagctgcctgaggccgctgactttggcaccaccagcagcctgcactttgtgcacatgaggggcctgcccttccaggccaatgcccaggacatcatcaacttctttgcccccctgaagcctgtgcgcatcaccatggagtacagcagcagcggcaaggccactggagaggctgatgtgcactttgagacccatgaagatgctgtggccgccatgctgaaggacaggagccacgtgcaccaccgctacatcgagctgttcctgaacagctgccccaagggcaagtag

SEQ ID NO: 154443 - DNA, 957 bp, Artificial Sequence; identical to SEQ ID NO: 154441
  Description of Artificial Sequence: Synthetic coding sequence

SEQ ID NO: 154444 - DNA, 1254 bp, Artificial Sequence
  Description of Artificial Sequence: Synthetic coding sequence
tgaccaccacccagcaccctgtgcagctactgggccctggagcagggcaagctgagccaggccagcggcctgctgctggtgctcttcagcccccgggtgtctggccgcctgggctctgtgtctgtggccggcgtgaatgtggaggccctcttccctgcctggcccatggagagcaagaccacctacctggaggacctgcccccacctccagaatatgagctggcccccagcaagctggaggaggaggtggatgatgtgttcctgatccgggcccagggcctgccctggagctgcaccatggaggatgtgctgaacttcttcagtgactgccgcatcagaaatggagaaaatggcatccacttcctgctgaacagagatggcaagagaagaggagatgccctgattgagatggagagcgagcaggatgtgcagaaggccctggagaagcacaggatgtacatgggccagcgctacgtggaggtgtatgagatcaacaatgaagatgtggatgccctgatgaagagcctgcaggtgaagagcagccctgtggtgaatgatggagtggtgcggctgcggggcctgccctacagctgcaatgagaaggacatcgtggacttctttgctggcctgaacatcgtggacatcacctttgtgatggactaccggggccgcaggaagacaggagaggcctacgtgcagtttgaggagcctgagatggccaaccaggccctgctgaagcaccgggaggagatcggcaaccgctacatcgagatcttccccagcagaagaaatgaggtgaggacccacgtgggcagctacaagggcaagaagatcgccagcttccccacagccaagtacatcacagagcctgagatggtgtttgaggagcacgaggtgaatgaagacatccagcccatgacagcctttgaaagtgagaaggagattgagctgcccaaggaggtgcctgagaagctgcctgaggccgctgactttggcaccaccagcagcctgcactttgtgcacatgaggggcctgcccttccaggccaatgcccaggacatcatcaacttctttgcccccctgaagcctgtgcgcatcaccatggagtacagcagcagcggcaaggccactggagaggctgatgtgcactttgagacccatgaagatgctgtggccgccatgctgaaggacaggagccacgtgcaccaccgctacatcgagctgttcctgaacagctgccccaagggcaagtag

SEQ ID NO: 154445 - DNA, 1239 bp, Artificial Sequence
  Description of Artificial Sequence: Synthetic coding sequence
atggccggcacccgctgggtgctgggcgccctgctgcggggctgcggctgcaactgcagcagctgcagaagaactggagctgcctgcctgcccttctacagcgctgctggcagcatcccagctgctgctgtgcccaccaggagctacagccaggagagcaagaccacctacctggaggacctgcccccacctccagaatatgagctggcccccagcaagctggaggaggaggtggatgatgtgttcctgatccgggcccagggcctgccctggagctgcaccatggaggatgtgctgaacttcttcagtgactgccgcatcagaaatggagaaaatggcatccacttcctgctgaacagagatggcaagagaagaggagatgccctgattgagatggagagcgagcaggatgtgcagaaggccctggagaagcacaggatgtacatgggccagagatatgtggaggtgtatgagatcaacaatgaagatgtggatgccctgatgaagagcctgcaggtgaagagcagccctgtggtgaatgatggagtggtgcggctgcggggcctgccctacagctgcaatgagaaggacatcgtggacttctttgctggcctgaacatcgtggacatcacctttgtgatggactaccggggccgcaggaagacaggagaggcctacgtgcagtttgaggagcctgagatggccaaccaggccctgctgaagcaccgggaggagatcggcaaccgctacatcgagatcttccccagcagaagaaatgaggtgaggacccacgtgggcagctacaagggcaagaagatcgccagcttccccacagccaagtacatcacagagcctgagatggtgtttgaggagcacgaggtgaatgaagacatccagcccatgacagcctttgagagcgagaaggagattgagctgcccaaggaggtgcctgagaagctgcctgaggccgctgactttggcaccaccagcagcctgcactttgtgcacatgaggggcctgcccttccaggccaatgcccaggacatcatcaacttctttgcccccctgaagcctgtgcgcatcaccatggagtacagcagcagcggcaaggccaccggggaggctgatgtgcactttgagacccatgaagatgctgtggccgccatgctgaaggacaggagccacgtgcaccaccgctacatcgagctgttcctgaacagctgccccaagggcaagtag

SEQ ID NO: 154446 - DNA, 1089 bp, Artificial Sequence
  Description of Artificial Sequence: Synthetic coding sequence
atggagagcaagaccacctacctggaggacctgcccccacctccagaatatgagctggcccccagcaagctggaggaggaggtggatgatgtgttcctgatccgggcccagggcctgccctggagctgcaccatggaggatgtgctgaacttcttcagtgactgccgcatcagaaatggagaaaatggcatccacttcctgctgaacagagatggcaagagaagaggagatgccctgattgagatggagagcgagcaggatgtgcagaaggccctggagaagcacaggatgtacatgggccagagatatgtggaggtgtatgagatcaacaatgaagatgtggatgccctgatgaagagcctgcaggtgaagagcagccctgtggtgaatgatggagtggtgcggctgcggggcctgccctacagctgcaatgagaaggacatcgtggacttctttgctggcctgaacatcgtggacatcacctttgtgatggactaccggggccgcaggaagacaggagaggcctacgtgcagtttgaggagcctgagatggccaaccaggccctgctgaagcaccgggaggagatcggcaaccgctacatcgagatcttccccagcagaagaaatgaggtgaggacccacgtgggcagctacaagggcaagaagatcgccagcttccccacagccaagtacatcacagagcctgagatggtgtttgaggagcacgaggtgaatgaagacatccagcccatgacagcctttgagagcgagaaggagattgagctgcccaaggaggtgcctgagaagctgcctgaggccgctgactttggcaccaccagcagcctgcactttgtgcacatgaggggcctgcccttccaggccaatgcccaggacatcatcaacttctttgcccccctgaagcctgtgcgcatcaccatggagtacagcagcagcggcaaggccaccggggaggctgatgtgcactttgagacccatgaagatgctgtggccgccatgctgaaggacaggagccacgtgcaccaccgctacatcgagctgttcctgaacagctgccccaagggcaagtag

SEQ ID NO: 154447 - DNA, 1401 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggatgtgcgggccaccctggagaaggtgaggaagaggatgtatggagactatgatgagatgaggcagaagatccggcagctgacccaggagctgtctgtgagccacgcccagcaggagtacctggagaaccacatccagacccagagcagcgccctggaccgcttcaatgccatgaacagcgccctggccagtgacagcatcggcctgcagaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggacaggctcatcgagaggatggagaaggagcggcaccagctgcagctgcagctgctggagcatgaaacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagattgagagcctgaagaagaagctgcagcagaagcagctgctgatcctgcagctgctggagaagatctccttcctggagggagaaaataatgagctgcagagccggctggactacctgacagagacccaggccaagacagaggtggagacccgggagattggagtgggctgtgacctgctgcccagccagacaggccgcacccgggagatcgtgatgcccagcaggaactacaccccctacaccagggtgctggagctgaccatgaagaagaccctgacctag

SEQ ID NO: 154448 - DNA, 1194 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggacaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggaccggctgattgaaagaatggagaaggagcggcaccagctgcagctgcagctgctggagcacgagacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagattgagagcctgaagaagaagctgcagcagaagcagctgctgatcctgcagctgctggagaagatctccttcctggagggggagaacaatgagctgcagagccggctggactacctgacagagacccaggccaagacagaggtggagacccgggagattggagtgggctgtgacctgctgcccagccagacaggccgcacccgggagatcgtgatgcccagcaggaactacaccccctacaccagggtgctggagctgaccatgaagaagaccctgacctag

SEQ ID NO: 154449 - DNA, 1248 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggatgtgtcccatgcccagcaggagtacctggagaaccacatccagacccagagcagcgccctggaccgcttcaatgccatgaacagcgccctggccagtgacagcatcggcctgcagaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggaccggctgattgaaagaatggagaaggagcggcaccagctgcagctgcagctgctggagcacgagacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagaacaatgagctgcagagccggctggactacctgacagagacccaggccaagacagaggtggagacccgggagattggagtgggctgtgacctgctgccccggcagagcaggaagtttgagaaggtgctgaatgaatttgtgcagctgctgcccctgccccaccacctgctgtgggcctttggaaatgtgtgctggaggaggcacttcggcctgctgcagtag

SEQ ID NO: 154450 - DNA, 1317 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggatgtgcgggccaccctggagaaggtgaggaagaggatgtatggagactatgatgagatgaggcagaagatccggcagctgacccaggagctgtctgtgagccacgcccagcaggagtacctggagaaccacatccagacccagagcagcgccctggaccgcttcaatgccatgaacagcgccctggccagtgacagcatcggcctgcagaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggacaggctcatcgagaggatggagaaggagcggcaccagctgcagctgcagctgctggagcatgaaacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagaacaatgagctgcagagccggctggactacctgacagagacccaggccaagacagaggtggagacccgggagattggagtgggctgtgacctgctgcccagccagacaggccgcacccgggagatcgtgatgcccagcaggaactacaccccctacaccagggtgctggagctgaccatgaagaagaccctgacctag

SEQ ID NO: 154451 - DNA, 1338 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggatgtgcgggccaccctggagaaggtgaggaagaggatgtatggagactatgatgagatgaggcagaagatccggcagctgacccaggagctgtctgtgagccacgcccagcaggagtacctggagaaccacatccagacccagagcagcgccctggaccgcttcaatgccatgaacagcgccctggccagtgacagcatcggcctgcagaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggacaggctcatcgagaggatggagaaggagcggcaccagctgcagctgcagctgctggagcatgaaacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagattgagagcctgaagaagaagctgcagcagaagcagctgctgatcctgcagctgctggagaagatctccttcctggagggagaaaataatgagctgcagagccggctggactacctgacagagacccaggccaagacagaggtggagacccgggagattggagtgggctgtgacctgctgccccggcgctgcaagcagagcagccagaggaagaactag

SEQ ID NO: 154452 - DNA, 1653 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggatgtgcgggccaccctggagaaggtgaggaagaggatgtatggagactatgatgagatgaggcagaagatccggcagctgacccaggagctgtctgtgagccacgcccagcaggagtacctggagaaccacatccagacccagagcagcgccctggaccgcttcaatgccatgaacagcgccctggccagtgacagcatcggcctgcagaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggacaggctcatcgagaggatggagaaggagcggcaccagctgcagctgcagctgctggagcatgaaacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagattgagagcctgaagaagaagctgcagcagaagcagctgctgatcctgcagctgctggagaagatctccttcctggagggagaaaataatgagctgcagagccggctggactacctgacagagacccaggccaagacagaggtggagacccgggagattggagtgggctgtgacctgctgccccggctgcccttccggcagaatgacagcagcagccactgccagaagagcggcagccccatcagcagcgaggagaggagaagaagagacaagcagcacctggatgacatcacagctgcccggctgctgcccctgcaccacatgcccacccagctgctgagcattgaggagagcctggccctgcagaagcagcagaagcagaactatgaggagatgcaggccaagctggccgcccagaagctggccgagcggctgaacatcaagatgaggagctacaaccctgagggggagagcagcggccgctaccgggaggtgagagatgaagatgatgactggagcagtgatgagttctag

SEQ ID NO: 154453 - DNA, 1308 bp, Artificial Sequence
  Description of Artificial Sequence: Synthetic coding sequence
atgctgcggagcaccagcacagtgaccctgctgagcggcggggccgcccggacccctggggcccccagccggcgggccaacgtgtgccgcctgcggctgactgtgcccccagagagccctgtgcctgagcagtgtgagaagaagattgaaaggaaggagcagctgctggacctgagcaatggagagcccaccaggaagctgccccagggcgtggtgtatggagtggtgagaagaagtgaccagaaccagcagaaggagatggtggtgtatggctggagcaccagccagctgaaggaggagatgaactacatcaaggatgtgtcccatgcccagcaggagtacctggagaaccacatccagacccagagcagcgccctggaccgcttcaatgccatgaacagcgccctggccagtgacagcatcggcctgcagaagaccctggtggatgtgaccctggagaacagcaacatcaaggaccagatccggaacctgcagcagacctatgaggcctccatggacaagctgcgggagaagcagaggcagctggaggtggcccaggtggagaaccagctgctgaagatgaaggtggagagcagccaggaggccaatgctgaggtgatgagggagatgaccaagaagctgtacagccagtatgaggagaagctgcaggaggagcagaggaagcacagcgctgagaaggaggccctgctggaggagaccaacagcttcctgaaggccatcgaggaggccaacaagaagatgcaggccgctgagatcagcctggaggagaaggaccagagaattggagagctggaccggctgattgaaagaatggagaaggagcggcaccagctgcagctgcagctgctggagcacgagacagagatgtctggagagctgacagacagcgacaaggagcgctaccagcagctggaggaggccagcgccagcctgcgggagcgcatccgccacctggatgacatggtgcactgccagcagaagaaggtgaagcagatggtggaggagattgagagcctgaagaagaagctgcagcagaagcagctgctgatcctgcagctgctggagaagatctccttcctggagggggagaacaatgagctgcagagccggctggactacctgacagagacccaggccaagacagaggtggagacccgggagattggagtgggctgtgacctgctgcccagccagacaggccgcacccgggagatcgtgatgcccagcaggaactacaccccctacaccagggtgctggagctgaccatgaagaagaccctgacctag

SEQ ID NO: 154454 - DNA, 1401 bp, Artificial Sequence; identical to SEQ ID NO: 154447
  Description of Artificial Sequence: Synthetic coding sequence

SEQ ID NO: 154455 - DNA, 1317 bp, Artificial Sequence; identical to SEQ ID NO: 154450
  Description of Artificial Sequence: Synthetic coding sequence

SEQ ID NO: 154456 - DNA, 1401 bp, Artificial Sequence; identical to SEQ ID NO: 154447
  Description of Artificial Sequence: Synthetic coding sequence

SEQ ID NO: 154457 - DNA, 2328 bp, Artificial Sequence
  Description of Artificial Sequence: Synthetic coding sequence
atggagaagtttggcatgaactttggaggcggccccagcaagaaggacctgctggagaccatcgagacccagaagaagcagctgctgcagtaccaggcccggctgaaggatgtggtgcgggcctacaagagcctgctgaaggagaaggaggccctggaggccagcatcaaggtgctgtctgtgtcccatgaagcagatgtgggcctggccggcgtgcagctgcccggcctgaccttcccagacagcgtggatgaccgctgcagcacccacagcgaggacagcactggaacagccaccagcctggacacagctgccagcctgaccagcaccaagggggagtttggagtggaggatgacaggcctgcccggggccccccaccacccaagtctgaggaggcctcctggagcgagagcggcgtgagcagcagcagtggagatggcccctttgctggaggagaggtggacaagaggctgcaccagctgaagacccagctggccaccctgaccagcagcctggccaccgtgacccaggagaagagcaggatggaggccagctacctggccgacaagaagaagatgaagcaggacctggaggatgccagcaacaaggccgaggaggagcgggcccggctggagggggagctgaagggcctgcaggagcagattgctgagaccaaggcccggctcatcacccagcagcacgaccgggcccaggagcagagcgaccacgccctgatgctgcgggagctgcagaagctgctgcaggaggagaggacccagaggcaggacctggagctgcggctggaggagacccgggaggccctggccggccgggcctatgctgctgagcagatggagggctttgagctgcagaccaagcagctgacccgggaggtggaggagctgaagtctgagctgcaggccatcagagatgagaagaaccagcctgacccccggctgcaggagctgcaggaggaggccgcccggctgaagagccacttccaggcccagctgcagcaggagatgaggaagacagccctggccgaggaccagctgcggcagcagagccaggtggaggagcagagggtggccgccctggagaaccagatcagcgaggtgtctgagctgctgggcacctatgagaaggccaagcagaaggaccagctggccatccagaagctgaaggagcgcatcctgcagctggacctggagaacaagaccctggccctggccgccagcagccgcagccccctggacagccatggagaggagagcagcctggatgtgaatgtgctgaaggacaagatggagaagctgaagaggctgctgcaggtggccgccaggaagagccaggtgaccctggatgtggagaagctgtgtgacctggagatcatgcccagcagcgaggccgcagatggagagaaggccacagccctgtactaccagcaggagctgaagcagctgaaggaggagtttgagcgctacaagatgagggcccaggtggtgctgaagagcaagaacaccaaggatggcaacctgggcaaggagctggaggccgcccaggagcagctggccgagctgaaggagaagtacatcagcctgcggctgagctgtgaggagctggagcaccagcaccagcaggaggctgatgactggaagcaggagctggcccggctgcagcagctgcaccggcaggagctggagcgctgccagctggacttccgggacaggaccctgaagctggaggaggagctgcacaagcagagggaccgggccctggccgtgctgacagagaaggacctggagctggagcagctgcggtctgtggccctggccagcggcctgcccggccgccgcagccctgtgggcggcggcggccctggggaccctgctgacaccagcagcagtgacagcctgacccaggccctgcagctggccgccgccaatgagcccaccttcttcctgtatgcagagcagctggccaggaaggaggtggagatcaccagcctgaggaagcagaagcaccggctggaggtggaggtgcaccagctgcaggaccggctgctggaggagggggagcggcaccgggaggaggtggccgccctgcagagccacatcgagaagaacatccgggaccagagccgggagggcgccaacctggagtacctgaagaacatcatctaccgcttcctgaccctgcctgacagcctgggccggcagcagaccctgacagccatcctgaccatcctgcacttcagccctgaggagaagcaggtgatcatgaggctgcccaccagcgcctcctggtggcccagcggcaagaggtag

SEQ ID NO: 154458 - DNA, 5055 bp, Artificial Sequence
  Description of Artificial Sequence: Synthetic coding sequence
atggaggacctggtgcaggatggagtggccagccctgccaccccaggcaccgggaagagcaagctggagaccctgcccaaggaggacctgatcaagtttgccaagaagcagatgatgctgatccagaaggccaagagccgctgcacagagctggagaaggagattgaggagctgcggagcaagcctgtgacagagggcactggagacatcatcaaggccctgacagagcggctggatgccctgctgctggagaaggccgagacagagcagcagtgcctgagcctgaagaaggagaacatcaagatgaagcaggaggtggaggacagcgtgaccaagatgggagatgcccacaaggagctggagcagagccacatcaactacgtgaaggagattgagaacctgaagaatgagctgatggctgtgcgcagcaagtacagcgaggacaaggccaacctgcagaagcagctggaggaggccatgaacacccagctggagctgtctgagcagctgaagttccagaacaacagtgaagataatgtgaagaagctgcaggaggagattgagaagatccggcccggctttgaggagcagatcctgtacctgcagaagcagctggatgccaccacagatgagaagaaggagaccgtgacccagctgcagaacatcatcgaggccaacagccagcactaccagaagaacatcaacagcctgcaggaggagctgctgcagctgaaggccatccaccaggaggaggtgaaggagctgatgtgccagatcgaggccagcgccaaggagcacgaggccgagatcaacaagctgaatgagctgaaggagaacctggtgaagcagtgtgaggccagcgagaagaacatccagaagaagtatgaatgtgagctggagaacctgaggaaggccaccagcaatgccaaccaggacaaccagatctgcagcatcctgctgcaggagaacacctttgtggagcaggtggtgaatgagaaggtgaagcacctggaggacaccctgaaggagctggagagccagcacagcatcctgaaggatgaggtgacctacatgaacaacctgaagctgaagctggagatggatgcccagcacatcaaggatgagttcttccacgagcgggaggacctggagttcaagatcaatgagctgctgctggccaaggaggagcagggctgtgtgattgagaagctgaagtctgagctggccggcctgaacaagcagttctgctacacagtggagcagcacaaccgggaggtgcagagcctgaaggagcagcaccagaaggagatcagcgagctgaatgagaccttcctgagtgacagcgagaaggagaagctgaccctgatgtttgagatccagggcctgaaggagcagtgtgagaacctgcagcaggagaagcaggaggccatcctgaactatgagagcctgcgggagatcatggagatcctgcagacagagctgggggagagcgctgggaagatcagccaggagtttgagagcatgaagcagcagcaggccagtgatgtgcatgagctgcagcagaagctgaggacagccttcacagagaaggatgccctgctggagaccgtgaaccggctgcagggagaaaatgagaagctgctgagccagcaggagctggtgcctgagctggagaacaccatcaagaacctgcaggagaagaatggagtgtacctgctgagcctgagccagagggacaccatgctgaaggagctggagggcaagatcaacagcctgacagaggagaaggatgacttcatcaacaagctgaagaacagccatgaggagatggacaacttccacaagaagtgtgagcgggaggagcggctcatcctggagctgggcaagaaggtggagcagaccatccagtacaacagcgagctggagcagaaggtgaatgagctgactggaggcctggaggagaccctgaaggagaaggaccagaatgaccagaagctggagaagctgatggtgcagatgaaggtgctgtctgaggacaaggaggtgctgtctgctgaggtgaagagcctgtatgaggagaacaacaagctgagcagcgagaagaagcagctgagccgggacctggaggtgttcctgagccagaaggaggatgtgatcctgaaggagcacatcacccagctggagaagaagctgcagctgatggtggaggagcaggacaacctgaacaagctgctggagaatgagcaggtgcagaagctgtttgtgaagacccagctgtatggcttcctgaaggagatgggcagcgaggtgtctgaggacagcgaggagaaggatgtggtgaatgtgctgcaggccgtgggggagagcctggccaagatcaatgaggagaagtgcaacctggccttccagagagatgagaaggtgctggagctggagaaggagatcaagtgcctgcaggaggagagcgtggtgcagtgtgaggagctgaagagcctgctgcgggactatgagcaggagaaggtgctgctgaggaaggagctggaggagatccagagcgagaaggaggccctgcagagcgacctgctggagatgaagaatgccaatgagaagacccggctggagaaccagaacctgctgatccaggtggaggaggtgtcccagacctgcagcaagtctgagatccacaatgagaaggagaagtgcttcatcaaggagcacgagaacctgaagcccctgctggagcagaaggagctgcgggacagaagagctgagctgatcctgctgaaggacagcctggccaagagccccagcgtgaagaatgaccccctgagctctgtgaaggagctggaggagaagattgagaacctggagaaggagtgcaaggagaaggaggagaagatcaacaagatcaagctggtggccgtgaaggccaagaaggagctggacagcagcaggaaggagacccagacagtgaaggaggagctggagagcctgcggtctgagaaggaccagctgagcgcctccatgagggacctgatccagggcgctgagagctacaagaacctgctgctggagtatgagaagcagagcgagcagctggatgtggagaaggagcgggccaacaactttgagcacagaattgaggacctgacccggcagctgaggaacagcaccctgcagtgtgagaccatcaacagcgacaatgaagacctgctggccagaattgagaccctgcagagcaatgccaagctgctggaggtgcagatcctggaggtgcagagggccaaggccatggtggacaaggagctggaggccgagaagctgcagaaggagcagaagatcaaggagcacgccaccaccgtgaatgagctggaggagctgcaggtgcagctgcagaagcagaagaagcagctgcagaagaccatgcaggagctggagctggtgaagaaggatgcccagcagaccaccctgatgaacatggagattgctgactatgagcggctgatgaaggagctgaaccagaagctgaccaacaagaacaacaagattgaggacctggagcaggagatcaagatccagaagcagaagcaggagaccctgcaggaggagatcaccagcctgcagagctctgtgcagcagtatgaggagaagaacaccaagatcaagcagctgctggtgaagaccaagaaggagctggccgacagcaagcaggccgagacagaccacctgatcctgcaggccagcctgaagggggagctggaggccagccagcagcaggtggaggtgtacaagatccagctggccgagatcaccagcgagaagcacaagatccacgagcacctgaagaccagcgctgagcagcaccagaggaccctgagcgcctaccagcagagggtgacagccctgcaggaggagtgccgggccgccaaggccgagcaggccaccgtgaccagcgagtttgagagctacaaggtgcgggtgcacaacgtgctgaagcagcagaagaacaagtccatgagccaggccgagacagagggcgccaagcaggagcgggagcacctggagatgctgattgaccagctgaagatcaagctgcaggacagccagaacaacctgcagatcaacgtgtctgagctgcagaccctgcagagcgagcatgacaccctgctggagcggcacaacaagatgctgcaggagaccgtgtccaaggaggccgagctgcgggagaagctgtgcagcatccagagcgagaacatgatgatgaagtctgagcacacccagacagtgtcccagctgaccagccagaatgaggtgctgaggaacagcttccgggaccaggtgcgccacctgcaggaggagcacaggaagacagtggagaccctgcagcagcagctgagcaagatggaggcccagctgttccagctgaagaatgagcccaccaccaggagccctgtgagcagccagcagagcctgaagaacctgcgggagaggaggaacacagacctgcccctgctggacatgcacacagtgacccgggaggagggggagggcatggagaccacagacacagaatctgtgagcagcgccagcacctacacccagagcctggagcagctgctgaacagccctgagaccaagctggagccccccctgtggcacgccgagttcaccaaggaggagctggtgcagaagctgagcagcaccaccaagtctgctgaccacctgaatggcctgctgcgggagacagaggccaccaatgccatcctgatggagcagatcaagctgctgaagtctgagatccggcggctggagaggaaccaggagcgggagaagtctgctgccaacctggagtacctgaagaatgtgctgctgcagttcatcttcctgaagccaggcagcgagcgggagcggctgctgcccgtcatcaacaccatgctgcagctgagccctgaggagaagggcaagctggccgctgtggcccagggcgaggaggagaatgccagccgcagcagcggctgggccagctacctgcacagctggagcggcctgaggtag

SEQ ID NO: 154459 - DNA, 2052 bp, Artificial Sequence
  Description of Artificial Sequence: Synthetic coding sequence
atgtgccagatcgaggccagcgccaaggagcatgaagctgagatcaacaagctgaatgagctgaaggagaacctggtgaagcagtgtgaggccagcgagaagaacatccagaagaagtatgaatgtgagctggagaacctgaggaaggccaccagcaatgccaaccaggacaaccagatctgcagcatcctgctgcaggagaacacctttgtggagcaggtggtgaatgagaaggtgaagcacctggaggacaccctgaaggagctggagagccagcacagcatcctgaaggatgaggtgacctacatgaacaacctgaagctgaagctggagatggatgcccagcacatcaaggatgagttcttccacgagcgggaggacctggagttcaagatcaatgagctgctgctggccaaggaggagcagggctgcgtcatcgagaagctgaagtctgagctggccggcctgaacaagcagttctgctacacagtggagcagcacaaccgggaggtgcagagcctgaaggagcagcaccagaaggagatcagcgagctgaatgagaccttcctgagtgacagcgagaaggagaagctgaccctgatgtttgagatccagggcctgaaggagcagtgtgagaacctgcagcaggagaagcaggaggccatcctgaactatgagagcctgcgggagatcatggagatcctgcagacagagctgggggagagcgctgggaagatcagccaggagtttgagagcatgaagcagcagcaggccagtgatgtgcatgagctgcagcagaagctgaggacagccttcacagagaaggatgccctgctggagaccgtgaaccggctgcagggagaaaatgagaagctgctgagccagcaggagctggtgcctgagctggagaacaccatcaagaacctgcaggagaagaatggagtgtacctgctgagcctgagccagagggacaccatgctgaaggagctggagggcaagatcaacagcctgacagaggagaaggatgacttcatcaacaagctgaagaacagccatgaggagatggacaacttccacaagaagtgtgagcgggaggagcggctcatcctggagctgggcaagaaggtggagcagaccatccagtacaacagcgagctggagcagaaggtgaatgagctgaccggcggcctggaggagaccctgaaggagaaggaccagaatgaccagaagctggagaagctgatggtgcagatgaaggtgctgtctgaggacaaggaggtgctgtctgctgaggtgaagagcctgtatgaggagaccatcaacagcgtgcagaagaagcagctgagccgggacctggaggtgttcctgagccagaaggaggatgtgatcctgaaggagcacatcacccagctggagaagaagctgcagctgatggtggaggagcaggacaacctgaacaagctgctggagaatgagcaggtgcagaagctgtttgtgaagacccagctgtatggcttcctgaaggagatgggcagcgaggtgtctgaggacagcgaggagaaggatgtggtgaatgtgctgcaggccgtgggggagagcctggccaagatcaatgaggagaagtgcaacctggccttccagagagatgagaaggtgctggagctggagaaggagatcaagtgcctgcaggaggagagcgtggtgcagtgtgaggagctgaagagcctgctgcgggactatgagcaggagaaggtgctgctgaggaaggagctggaggagatccagagcgagaaggaggccctgcagagcgacctgctggagatgaagaatgccaatgagaagacccggctggagaaccagaacctgctgatccaggtggaggaggtgtcccagacctgcagcaagtctgagatccacaatgagaaggagaagtgcttcatcaaggagcacgagaacctgaagcccctgctggagcagaaggagctgcgggacagaagagctgagctgatcctgctgaaggacagcctggccaagagccccagcaagaagtag

SEQ ID NO: 154460 - DNA, 1347 bp, Artificial Sequence
  Description of Artificial Sequence: Synthetic coding sequence
atggaggacctggtgcaggatggagtggccagccctgccaccccaggcaccgggaagagcaagctggagaccctgcccaaggaggacctgatcaagtttgccaagaagcagatgatgctgatccagaaggccaagagccgctgcacagagctggagaaggagattgaggagctgcggagcaagcctgtgacagagggcactggagacatcatcaaggccctgacagagcggctggatgccctgctgctggagaaggccgagacagagcagcagtgcctgagcctgaagaaggagaacatcaagatgaagcaggaggtggaggacagcgtgaccaagatgggagatgcccacaaggagctggagcagagccacatcaactacgtgaaggagattgagaacctgaagaatgagctgatggctgtgcgcagcaagtacagcgaggacaaggccaacctgcagaagcagctggaggaggccatgaacacccagctggagctgtctgagcagctgaagttccagaacaacagtgaagataatgtgaagaagctgcaggaggagattgagaagatccggcccggctttgaggagcagatcctgtacctgcagaagcagctggatgccaccacagatgagaagaaggagaccgtgacccagctgcagaacatcatcgaggccaacagccagcactaccagaagaacatcaacagcctgcaggaggagctgctgcagctgaaggccatccaccaggaggaggtgaaggagctgatgtgccagatcgaggccagcgccaaggagcacgaggccgagatcaacaagctgaatgagctgaaggagaacctggtgaagcagtgtgaggccagcgagaagaacatccagaagaagtatgaatgtgagctggagaacctgaggaaggccaccagcaatgccaaccaggacaaccagatctgcagcatcctgctgcaggagaacacctttgtggagcaggtggtgaatgagaaggtgaagcacctggaggacaccctgaaggagctggagagccagcacagcatcctgaaggatgaggtgacctacatgaacaacctgaagctgaagctggagatggatgcccagcacatcaaggatgagttcttccacgagcgggaggacctggagttcaagatcaatgagctgctgctggccaaggaggagcagggctgtgtgattgagaagctgaagtctgagctggccggcctgaacaagcagttctgctacacagtggagcagcacaaccgggaggtgcagagcctgaaggagcagcaccagaaggagatcagcgagctgaatgagaccttcctgagtgacagctag

SEQ ID NO: 154461 - DNA, 1878 bp, Artificial Sequence
  Description of Artificial Sequence: Synthetic coding sequence
atggcccaggccctgtctgaggaggagttccagaggatgcaggcccagctgctggagctgcggaccaacaactaccagctgagtgatgagctgaggaagaatggagtggagctgaccagcctgcggcagaaggtggcctacctggacaaggagttcagcaaggcccagaaggccctgagcaagagcaagaaggcccaggaggtggaggtgctgctgtctgaaaatgagatgctgcaggccaagctgcacagccaggaggaggacttccggctgcagaacagcaccctgatggccgagttcagcaaggagagatatggcaaggaggccggcaagttctctgctgtgtctgagggccagggcgaccccccaggcggccctgcccccaccgtgctggcccccatgcccctggccgaggtggagctgaagtgggagatggagaaggaggagaagaggctgctgtgggagcagctgcagggcctggagagcagcaagcaggccgagaccagccggctgcaggaggagctggccaagctgtctgagaagctgaagaagaagcaggagagcttctgccgcctgcagacagagaaggagaccctcttcaatgacagcaggaacaagattgaggagctgcagcagaggaaggaggccgaccacaaggcccagctggcccggacccagaagctgcagcaggagctggaggccgccaaccagagcctggccgagctgcgggaccagaggcagggcgagcggctggagcacgccgccgccctgcgggccctgcaggaccaggtgtccatccagagcgcagatgcccaggagcaggtggagggcctgctggctgaaaataatgccctgcggaccagcctggccgccctggagcagatccagacagccaagacccaggagctgaacatgctgcgggagcagaccaccggcctggccgctgagctgcagcagcagcaggccgagtatgaggacctgatgggccagaaggatgacctgaacagccagctgcaggagagcctgcgggccaacagccggctgctggagcagctgcaggagatcggccaggagaaggagcagctgacccaggagctgcaggaggccaggaagtctgctgagaagaggaaggccatgctggatgagctggccatggagaccctgcaggagaagagccagcacaaggaggagctgggcgctgtgcggctgcggcatgagaaggaggtgctgggcgtgcgggcccgctatgaaagagagctgcgggagctgcacgaggacaagaagaggcaggaggaggagctgcggggccagatccgggaggagaaggcccggacccgggagctggagaccctgcagcagacagtggaggagctgcaggcccaggtgcacagcatggatggagccaagggctggtttgagcggcggctgaaggaggccgagggcaaggaggaggagctgcaggatgtgcgggaccagctggagcaggcccaggaggagcgggactgccacctgaagaccatcagcagcctgaagcaggaggtgaaggacacagtggatggccagaggatcctggagaagaagggcagcgctgccctgaaggacctgaagaggcagctgcacctggagaggaagagagctgacaagctgcaggagcggctgcaggacatcctgaccaacagcaagagccgcagcggcctggaggagctggtgctgtctgagatgaacagccccagcaggacccagacaggagacagcagcagcatcagcagcttctcctaccgggagatcctgcgggagaaggagagcagcgctgtgcctgcccgggtgcggggcaaggaggagcccacagccccagccagcctgaaccccaagatctag

SEQ ID NO: 154462 - DNA, 2433 bp, Artificial Sequence
  Description of Artificial Sequence: Synthetic coding sequence
atggcccaggccctgtctgaggaggagttccagaggatgcaggcccagctgctggagctgcggaccaacaactaccagctgagtgatgagctgaggaagaatggagtggagctgaccagcctgcggcagaaggtggcctacctggacaaggagttcagcaaggcccagaaggccctgagcaagagcaagaaggcccaggaggtggaggtgctgctgtctgaaaatgagatgctgcaggccaagctgcacagccaggaggaggacttccggctgcagaacagcaccctgatggccgagttcagcaagctgtgcagccagatggagcagctggagcaggagaaccagcagctgaaggagggcgccgccggggccggcgtggcccaggccggccccctggtggatggagagctgctgcggctgcaggctgaaaatacagccctgcagaagaatgtggccgccctgcaggagagatatggcaaggaggccggcaagttctctgctgtgtctgagggccagggcgaccccccaggcggccctgcccccaccgtgctggcccccatgcccctggccgaggtggagctgaagtgggagatggagaaggaggagaagaggctgctgtgggagcagctgcagggcctggagagcagcaagcaggccgagaccagccggctgcaggaggagctggccaagctgtctgagaagctgaagaagaagcaggagagcttctgccgcctgcagacagagaaggagaccctcttcaatgacagcaggaacaagattgaggagctgcagcagaggaaggaggccgaccacaaggcccagctggcccggacccagaagctgcagcaggagctggaggccgccaaccagagcctggccgagctgcgggaccagaggcagggcgagcggctggagcacgccgccgccctgcgggccctgcaggaccagatccagacagccaagacccaggagctgaacatgctgcgggagcagaccaccggcctggccgctgagctgcagcagcagcaggccgagtatgaggacctgatgggccagaaggatgacctgaacagccagctgcaggagagcctgcgggccaacagccggctgctggagcagctgcaggagatcggccaggagaaggagcagctgacccaggagctgcaggaggccaggaagtctgctgagaagaggaaggccatgctggatgagctggccatggagaccctgcaggagaagagccagcacaaggaggagctgggcgctgtgcggctgcggcatgagaaggaggtgctgggcgtgcgggcccgctatgaaagagagctgcgggagctgcacgaggacaagaagaggcaggaggaggagctgcggggccagatccgggaggagaaggcccggacccgggagctggagaccctgcagcagacagtggaggagctgcaggcccaggtgcacagcatggatggagccaagggctggtttgagcggcggctgaaggaggccgaggagagcctgcagcagcagcagcaggagcaggaggaggccctgaagcagtgccgggagcagcacgccgctgagctgaagggcaaggaggaggagctgcaggatgtgcgggaccagctggagcaggcccaggaggagcgggactgccacctgaagaccatcagcagcctgaagcaggaggtgaaggacacagtggatggccagaggatcctggagaagaagggcagcgctgccctgaaggacctgaagaggcagctgcacctggagaggaagagagctgacaagctgcaggagcggctgcaggacatcctgaccaacagcaagagccgcagcggcctggaggagctggtgctgtctgagatgaacagccccagcaggacccagacaggagacagcagcagcatcagcagcttctcctaccgggagatcctgcgggagaaggagagcagcgctgtgcctgcccggagcctgagcagcagcccccaggcccagccccccaggcctgctgagctgagtgatgaggaggtggccgagctgttccagaggctggccgagacccagcaggagaagtggatgctggaggagaaggtgaagcacctggaggtgtcctctgcctccatggccgaggacctgtgcaggaagagcgccatcatcgagacctacgtgatggacagcagaattgatgtgtctgtggccgccggccacacagacaggagcggcctgggctctgtgctgcgggacctggtgaagccaggagatgagaacctgcgggagatgaacaagaagctgcagaacatgctggaggagcagctgaccaagaacatgcacctgcacaaggacatggaggtgctgagccaggagatcgtgcggctgagcaaagaatgtgtgggccccccagaccctgacctggagcccggggagaccagctag

SEQ ID NO: 154463 - DNA, 2526 bp, Artificial Sequence
  Description of Artificial Sequence: Synthetic coding sequence
atggcccaggccctgtctgaggaggagttccagaggatgcaggcccagctgctggagctgcggaccaacaactaccagctgagtgatgagctgaggaagaatggagtggagctgaccagcctgcggcagaaggtggcctacctggacaaggagttcagcaaggcccagaaggccctgagcaagagcaagaaggcccaggaggtggaggtgctgctgtctgaaaatgagatgctgcaggccaagctgcacagccaggaggaggacttccggctgcagaacagcaccctgatggccgagttcagcaagctgtgcagccagatggagcagctggagcaggagaaccagcagctgaaggagggcgccgccggggccggcgtggcccaggccggccccctggtggatggagagctgctgcggctgcaggctgaaaatacagccctgcagaagaatgtggccgccctgcaggagagatatggcaaggaggccggcaagttctctgctgtgtctgagggccagggcgaccccccaggcggccctgcccccaccgtgctggcccccatgcccctggccgaggtggagctgaagtgggagatggagaaggaggagaagaggctgctgtgggagcagctgcagggcctggagagcagcaagcaggccgagaccagccggctgcaggaggagctggccaagctgtctgagaagctgaagaagaagcaggagagcttctgccgcctgcagacagagaaggagaccctcttcaatgacagcaggaacaagattgaggagctgcagcagaggaaggaggccgaccacaaggcccagctggcccggacccagaagctgcagcaggagctggaggccgccaaccagagcctggccgagctgcgggaccagaggcagggcgagcggctggagcacgccgccgccctgcgggccctgcaggaccaggtgtccatccagagcgcagatgcccaggagcaggtggagggcctgctggccgagaacaatgccctgcggaccagcctggccgccctggagcagatccagacagccaagacccaggagctgaacatgctgcgggagcagaccaccggcctggccgctgagctgcagcagcagcaggccgagtatgaggacctgatgggccagaaggatgacctgaacagccagctgcaggagagcctgcgggccaacagccggctgctggagcagctgcaggagatcggccaggagaaggagcagctgacccaggagctgcaggaggccaggaagtctgctgagaagaggaaggccatgctggatgagctggccatggagaccctgcaggagaagagccagcacaaggaggagctgggcgctgtgcggctgcggcatgagaaggaggtgctgggcgtgcgggcccgctatgagcgggagctgcgggagctgcacgaggacaagaagaggcaggaggaggagctgcggggccagatccgggaggagaaggcccggacccgggagctggagaccctgcagcagacagtggaggagctgcaggcccaggtgcacagcatggatggagccaagggctggtttgaaagaaggctgaaggaggccgaggagagcctgcagcagcagcagcaggagcaggaggaggccctgaagcagtgccgggagcagcacgccgctgagctgaagggcaaggaggaggagctgcaggatgtgcgggaccagctggagcaggcccaggaggagcgggactgccacctgaagaccatcagcagcctgaagcaggaggtgaaggacacagtggatggccagaggatcctggagaagaagggcagcgctgccctgaaggacctgaagaggcagctgcacctggagaggaagagagctgacaagctgcaggagcggctgcaggacatcctgaccaacagcaagagccgcagcggcctggaggagctggtgctgtctgagatgaacagccccagcaggacccagacaggagacagcagcagcatcagcagcttctcctaccgggagatcctgcgggagaaggagagcagcgctgtgcctgcccggagcctgagcagcagcccccaggcccagccccccaggcctgctgagctgagtgatgaggaggtggccgagctgttccagaggctggccgagacccagcaggagaagtggatgctggaggagaaggtgaagcacctggaggtgagcagcgcctccatggccgaggacctgtgcaggaagagcgccatcatcgagacctacgtgatggacagcagaattgatgtgtctgtggccgccggccacacagacagaagtggcctgggctctgtgctgcgggacctggtgaagccaggagatgagaacctgcgggagatgaacaagaagctgcagaacatgctggaggagcagctgaccaagaacatgcacctgcacaaggacatggaggtgctgagccaggagatcgtgcggctgagcaaagaatgtgtgggccccccagaccctgacctggagcctggagagaccagctag

SEQ ID NO: 154464 - DNA, 2391 bp, Artificial Sequence
  Description of Artificial Sequence: Synthetic coding sequence
atggcccaggccctgtctgaggaggagttccagaggatgcaggcccagctgctggagctgcggaccaacaactaccagctgagtgatgagctgaggaagaatggagtggagctgaccagcctgcggcagaaggtggcctacctggacaaggagttcagcaaggcccagaagctgtgcagccagatggagcagctggagcaggagaaccagcagctgaaggagggcgctgctggagctggggtggcccaggccggccccctggtggatggagagctgctgcggctgcaggccgagaacacagccctgcagaagaatgtggccgccctgcaggagagatatggcaaggaggccggcaagttctctgctgtgtctgagggccagggcgaccccccaggcggccctgcccccaccgtgctggcccccatgcccctggccgaggtggagctgaagtgggagatggagaaggaggagaagaggctgctgtgggagcagctgcagggcctggagagcagcaagcaggccgagaccagccggctgcaggaggagctggccaagctgtctgagaagctgaagaagaagcaggagagcttctgccgcctgcagacagagaaggagaccctcttcaatgacagcaggaacaagattgaggagctgcagcagaggaaggaggccgaccacaaggcccagctggcccggacccagaagctgcagcaggagctggaggccgccaaccagagcctggccgagctgcgggaccagaggcagggcgagcggctggagcacgccgccgccctgcgggccctgcaggaccaggtgtccatccagagcgcagatgcccaggagcaggtggagggcctgctggctgaaaataatgccctgcggaccagcctggccgccctggagcagatccagacagccaagacccaggagctgaacatgctgcgggagcagaccaccggcctggccgctgagctgcagcagcagcaggccgagtatgaggacctgatgggccagaaggatgacctgaacagccagctgcaggagagcctgcgggccaacagccggctgctggagcagctgcaggagatcggccaggagaaggagcagctgacccaggagctgcaggaggccaggaagtctgctgagaagaggaaggccatgctggatgagctggccatggagaccctgcaggagaagagccagcacaaggaggagctgggcgctgtgcggctgcggcatgagaaggaggtgctgggcgtgcgggcccgctatgaaagagagctgcgggagctgcacgaggacaagaagaggcaggaggaggagctgcggggccagatccgggaggagaaggcccggacccgggagctggagaccctgcagcagacagtggaggagctgcaggcccaggtgcacagcatggatggagccaagggctggtttgagcggcggctgaaggaggccgaggagagcctgcagcagcagcagcaggagcaggaggaggccctgaagcagtgccgggagcagcacgccgctgagctgaagggcaaggaggaggagctgcaggatgtgcgggaccagctggagcaggcccaggaggagcgggactgccacctgaagaccatcagcagcctgaagcaggaggtgaaggacacagtggatggccagaggatcctggagaagaagggcagcgctgccctgaaggacctgaagaggcagctgcacctggagaggaagagagctgacaagctgcaggagcggctgcaggacatcctgaccaacagcaagagccgcagcggcctggaggagctggtgctgtctgagatgaacagccccagcaggacccagacaggagacagcagcagcatcagcagcttctcctaccgggagatcctgcgggagaaggagagcagcgctgtgcctgcccggagcctgagcagcagcccccaggcccagccccccaggcctgctgagctgagtgatgaggaggtggccgagctgttccagaggctggccgagacccagcaggagaagtggatgctggaggagaaggtgaagcacctggaggtgtcctctgcctccatggccgaggacctgtgcaggaagagcgccatcatcgagacctacgtgatggacagcagaattgatgtgtctgtggccgccggccacacagacaggagcggcctgggctctgtgctgcgggacctggtgaagccaggagatgagaacctgcgggagatgaacaagaagctgcagaacatgctggaggagcagctgaccaagaacatgcacctgcacaaggacatggaggtgctgagccaggagatcgtgcggctgagcaaagaatgtgtgggccccccagaccctgacctggagcccggggagaccagctag
